United States Patent 8,781,750 (CELL-TYPE-SPECIFIC PATTERNS OF GENE EXPRESSION) - sequence listing, part 47

SEQ ID NO: 37961 - DNA, 385754 bp, Homo sapiens
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggtgggtgcaccgagctcggcgcagggcggcccctcaggggtcgggggaaggcgctccccagagggagtaagacttggagcagtggcctctctaagcaagttgggggtctccaagcagagtcggggcgtgccacgcgggccccagggggcctcaggactggggtgctcctcactgctgggcacctcgggtcgggcgcgcttcgtgccgtcccggaaggttcagggagagtctttcggcggcagttcgcgggctgaggggcgttcttgattatgggggaactccacagggttggagtttttcaggattgggagttactaagcagaaacctcgcgggtccgaaggtccggccggttgaccactgggtagcgagcgcccagaacgccgggggttgaggcgacgcgcgatcgtggaaagtgggcgtgggggtgaccgggacgcggcggaggcactggaggagcgacttcgaggcagcgggtagtcggaggagtgtgcactcggaaggctggtgcgagcaggcgagggtggcgcagagtcccagggccccgcactggccgcctcccttcagccaggagtcgccgcctcaggtcggaaacagcagcacatttgcggatcacattagaccaggcccttaatgccttctccagatggagagaagccaccgacccgcccccggacaccagctccgccaaggcgcccgcgaggcgaagcgggagtcgagtgtgacctcggcttttccagtctcgactcatactgatttccctgtaaattgacaggaaaagtaagggaaaaagtccccgcttccctcctggtttcagctgacctctgctggctggccctcacctacttttaggagattgtgttaggctggctcaggggctgtgtcctccaaacctccctgaacttagctctcaggcgtctctctgggtgtgggtcccggacctcgagggcgcacggtgtcatctagcgaggaaagccttgaactatcagaagatctgcgtttcagccctaaaatgtcactatcttgctgtgtgaccttaggcaggtcctttccctctctgggcggctttgttgtcttagactcatttttgccgcgagcagcagaagctagcctaaaccttggctctgtgctggcttcctgagtcaaatgccaatagcgacaccctgctgctgacagataggcttgggcagggatatctcagcttctgaagagctggaggtatgagatgcccactggagacaggtccagccctcgcctgactttgttgtggaccttctaaagggagcccagttagcctgcaccctgcagtaggcagcggcaacctgggccaacacaaacctttccaaaatagtatatgggcttcagggtccctccatctaatgggtcgcttaagtcacggtttactgccatgggggccagagctggttggtaatgaactctttcctcgtttgtaggctacaactgagacccggaggagactagaccccatggcttcctggacgagcccctggtgggtgctgatagggatggtcttcatgcactctcccctcccgcaggtaaggtcatatagggaggggaagggaaatggtggacatccctctgtttactcagaggcattattgtataccacctaagatgtggcatgattagtgttaatcctacaccagagaaccagactttctttcctatctctagccaatggtatttctggttggcttagctgtaaggattatccagatcccttgggtcctctctgaatcctgagtagggctttaatagcactgtggataccatacaccggtgatgacctggggctgtgatggaccctgtcatttcagactagaatggctgtctgcatgtgcccagcagaggctgggttgctggagaccaggaaacaatgggcagagccaggttctggccctagctaagctgctaaataaatattctgagtttacatctatcatcacatatcccactgttttatcccacagtcctctctttagacttctgctgtcttttccaaccaacttgagaggacccggctcatgaattgcatctttatttgcctaaaggacagactcaaacaaaggaatgaggctagcattgcctaagagacaatagagagtaacggagacagtggcaaagtgcagaacgcgtgctccatctattaagagcagtctctactcaattccatctgatcgttgctaagtggagacataagcccaggattgccagatcttatttttcaagatagctggatcatctagacttcttacaaaatttcccagtttttaaagtattgaaaggcagataaatgtgtttgcagcctggattcagccaagcagtttgcagccccagatctaaaggcagggcacatcttagtattgtgtcccaagggctgctgctagctccatacagtgtcttatgaattagaacaaggcaatccctccctgcagacatagcttctcaaatacatggcttggtggcctgtgtaccctcagggtctcggaagggacttgtcacttaagggcttaaatgtctgttaaataaacatgcatccatgaatgaagatatataccctgggataaattaatcagactcctctgcctcttgtttcactttcttggacttagtgcctctaaagcctcttttggctccaatgccctgtgaattctgtgatgcacaaagaactggtcagcaaggtacatcttctccccactatcccattttatcgatactatcccataatcatattaatagagctcttttgttagaacaaaagttaagtcttttcaggatgatgttagggttctctggccagcgagatgactgttgaggtaaaagcgtggagacttacgtttctgtctcatcagcggatctgaaacaggctttgagagcttcagagatttgttcctggtcaaatggggctgaggcttcaaggcacagtgttcattttgccttctttcaccttataaaatttaaatatgctttgaggcagtctgttgacctttggccaagggcagtgtttgcccagcttgaatcactcactgacctcttttggatttttccatatctgtgtgcctgtggcagtgctgtttccatgtatccaggcagtgtgcatagaaggtcataaaaggagatttcagaccagcagtcttcatcattcacgccactcactgttcggatcccagctctaccacttcattactgtgtcacgcaaacgtctctgcatcgcatctcagttttcacatctatacagaggagataatattagtatagacctcagaattgtttggaagagttaatccattgtgaagtggaaaaaagtgaaaaaccaaaccaaacaatgtctggcacatagtaagtgtacaataaatgtcagcattctgctgttgctgctgcttgtcagcattagaagcttgaagcaagcgcagtgcctgtattttctggtgtagagcctgtagggggcactcaagaggtatcagctgtggagggcctgatcttcagggagtgtgggtgggcatggctaggtctgtctcaccagaggccctgagaaaaggttctaatgaagggtggtaggtcagccctgtgtccctgtccgtgggttggatgctctgttttttccgtagggtcagcctgggtttgactcaaggccgccctttctgaagtatcttgtgattttggtgtttgggtggggcttaaggtgttccctggcgtctacccttgcttcgtatgtgctgccaccaaggtggttgttagaaaactgctagatgtgtgaggctgagctgtgaggagcaagggatgtgccaactaattaataacaaatagagtttcctttcttttcttttcttttgagacatggtttcacactgttgctcaggctagaatgcagtggcatgatctcagctcactgcaacctctgcttgctgggttcaagcaattctcgtgtctcagcctctgagtagctgggactacaggcgcacactaccacatccagctaatttttgtattatcggtagagatgaggttttgccatgttggccaggctggtctcgaactcctgacctcaagtgatctgcccacctcggcctcctaaagtgctgggattacagatgtgagccactgcgcccgtccacaaatatattttctttattgaatcagctaaaatgtaaactcttatattcactgcccacaaataattgtgagagattgtagaacaaggtaagaggctggtagttccttgtttttgtaactcgttcttgaccattcctcgaggagctcactgttcccctcatccaggcagctggagcggcctcccctcttcctgtctcacaggccctggaagcttcctgttgctccaggcttctccttagggatctgattttcccagagaagacagcagctgctgttcctactctctcttccagcctggagtatttgaaagcttttcaaactttatccagcctggagtatttgagagctttccaaactttatctagcctggagtatttgagagctttccaaactttatcctgaacaccttgaagatgagtcctgtgttgactgtgccctgaattacaacgtgcccccccttttttttctcttgcccatgagaagaataaacagccttatctgttcactaatttaattgtcataggatggcttcctagctctctggccaagtgcctttagaaactgttttaacattggtcatgtggcttgcgattatctctttaaacaaccatgtcaagatggcttcgtgtatatctgaatggccctccaccgtgtttgcccctcgggaggtgctgtactgtttagattctctggcaaattctgtcctctcccatttcctgtgactctggatggaatagccttttcagaagaatgacttgatctttgactgtctccactgccaagttcatagatatctactggaacagatccctcgaggccacagttttgaaaggcaggagacatttggatgaagaagtcctgggaggtcttataagtctgtggtgacctcctctgcagggaagattttgaaaatttcaaaacacagcttgtaaaataagcaatatctgggttggctccgatcctgtcccctgggtcttgttggtgcataagtataggacagaattatttaacttcttttttctgatcctgaggctggaggctagtgtagaaggctgatcttacagagggctttgaggtagggtgggaatggaaggccaggtggcctcgggtagatgccctttgagctcctgttgccttcatcataatatttggtggagctcccaggctgacagtgtggatgtccttgggatatgtggtaggttgcctaatgacccccagatatgtccatgtcctaatccctggaactcataaatattcccttatatggcaaaaaggacttggcagatgtgattaagaatattgaattggggagactatcctggattatgcaatcacaacagtccttataagagagccacaggagagtcagaggcagaggtagtagaagatgctaccatggaagccagagactgggagaatgtagccaggagctaacgcatgccagcaacctctagaagttggaagagataagaaatggattttctgctcaagtcttcagatgtaactggctgtagtgacaccttgattttagtcctgtaaaaatgcatttcagatttctgaccttcagaactgtaaaagaataaacttatgttgttttaagacctaaatttgtggtaatttgttacagcaccaagaggaaactaatacaggatgtcaggggtgggctttgaatcttgacctctttgctgccaccaacacaggcatcctctctccacctccggtaacccaggtgcaatcataggggctgagagaggctggcaaagtcacataattgacatgaggacaaaagaagtgccatttgagtattggtggcttagtccaggcctcttattcaccttctacagcaatctcacactccatagcaatttcaccatccaagttcccccagttacccctgctattgctatcacccttgatcatgtcaatcatgggcagtgaggatggaatcctaaggaaggtagtcctgggtcagggttcagggaactttctctgtgggtaaatcagctcaaggtagccctgactctgacatggcacataattccttttaggtcagcctagatttggttgggtttggcccctcgacaagtcataaccttgtgtctgagtgttgccccatgctgggtgatctgggagagttggggcctctgaaagacacagatttattgagaagtctcatttcagtaaggtataaatatggagccaatcactggtccagccatgccttgtgaaatcgccttttcccatcccctaatggaatcttaggaagatccagttttggttattaaaagttcagttccaaaaattttctcccattttgtaggttgcctgttccctctgatggtagtttcttttgccgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcacatagcgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttcttccatttgtttgtatcctcttttatttccttgagcagaggtttgtagttctccttgaagaggtccttcacatcccttgtaagttggattcctaggtattttattctctttgaagcaattgtgaacgggagttcactcatgatttggctctctgtttgtcttttgttggtgtataagaatgcttgtgatttttgtacattgattttgtatcctgagactttgctgaagttgcttatcagctactcatctgacaaagggctaatatccagaatctacaatgaactcaaacaaatttacgagaaaaaaacaaacaaccccatcaaaaagtgggcaaaggacatgaacagaaacttctcaaaagaagacatttatgcagccaaaaaacacatgaaaaaatgctcatcatcactggccatcagagaaatgcaaatcaaaaccactatgagataccacctcacaccagttagaatggcaatcattaaaaagtcaggaaacaacatgtgctggagaggatgtggagaaataggaacacttttacactgttggtgggactgtaaactagttcaaccattgtggaagtcagtgtggcgattcctcagggatctagaactagaaataccatttgacccagccatcccattactgggtatacacccaaatgactataaatcatgctgctataaagacacatgcacacgtatgtttattgcggcattattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgagatcacatggacacaggaaggggaatatcacactctggggactgtggtggggtggggggagggggggatagcattgggagatatacctaatgctagatgacgagttagtgggttcagcgcaccagcatggcacatgtatacgtatgtaactaacctgcacaatgtgcacatgtaccctaaaacttaaagtataataaaaaaaaaaaagaaaaaaaagaaagaaagaaaaaaaaaaagttcagttcatttaaagttttgattctcaacttgatttaaatctcatctccctttcctctagtctgggcttgacacatggcttcaggtacctgaagttgcacagggctcttttccctctaccatggaatggtacgggtgtggtgggcactggttctgagatacttcttccttttatttcttctggatctagctttccaagggtaggaaacaaggaaaggggaaggggataagggctatcagctctttactcaactggatacctctctctggtagttgtcactgccactccagctctccctcaaccctctgccctctgggtagcagatgtgagttctttggagggctccacaggacacttcctgcagcaggtagtccagcttcagcttgccacttgctgccggggtcttctcacctagcaggcagccttattggatggagtgtaggctggagagttcaaacccagctccctttggtgtagtctacctgacccataggaaatgcatgcttcttactgtgccagacagtgagaagacggaatgcttcaatgctgcctcctctctctgtcctgccaactcccttcagttctcctttccttgttctgatagatccagggagagatcagcagacccacggtctaagcagatgttcatctgtagagtggacggacattctctccttgcagccgcccccaatctctatgagtatttctcgttttctttattttcatttctaatggctgtgttccattgtagttatggttataccataatggcataagtggcattatgtgttatttaaacccattatttccttattgaatatttgggttgcttcctggatggtttgttcactcgtgtttaccatcagacacctgaaatgaacatctcatgctcacatctttgcttacttgagtatttccttagaataatcctttcttagtgtactgtgctttgctacacacttgatacacattgtggccttcctcctttcaccctgtttcagttctgtgtagagcttttccagcactccgggttttatgtcataaatgtacttcccatgaccttgtcccccaagtgattttggatcaatattccagtctgtgttgacactggtgatggagtctgagcaggaagatcttgggtcgtcttggatgcagacaccgctttattgccaagttgccctgaaaatctgcaatacagagttattggctagatccagtgagaatctggtgggagaatgaatgggagctctctccttgtgtgttgcctgtgatcccggcactcctttttctctttctacctctctgacctttccatctcactctccttctttggctcctctctggcttttaaaaaatgctcctcaattccagagctctgcctttgccctcccgtctgtccctccacatgctctcccaggcagcctccatctctccagaggctcctgcctgggggttatcaggtggagacccaggtctcatgacgatgtcgtctctcaaatgtaaacttttgaggttttcttcaaatagcattatatataccgaaaagataaaaagttgtccattattttacattaactgttaaatgtaaacattaaaaataaacacaatcttcataactctgttttggcttttcttgtttctttctttttcttttcttttcgtttttttttttaactcaaggttccctccaaagtggaagaggctcagcacctcagaggggcttctgtttgcctcttcaatgagctgcagaccaatatatgcatgagctaccatgcaccagaatgttccttggtggtgtcaagcacaaatgcttctcaaaccaaagtccttacctctcactgcgctctcttgctgtgcctagattctccatcacccagccatttgagccagatcctggcatcactgtagatgccttctttattcctgtacctgccctgtacccattcagccactaactcccatttttcccatctcagaaatgtcttttaaatgtttcctcctctcagtttccattgatgctgtgtttgaagactagggacatggcagcgtggagtatgagataatgatgaacaaagatagtctgtgtttgggcacagtggctcatgcctgtgatccgagcaccttgggagaccaaggcaggaggattagttgaggccagaagcttgagatcaggttggaaaacatagcaagacctcatccctaccaaaaatgtaaaaaattagctggttatgatagctgtgcttgtagtcccagctacttgggaggctgaggtgggagggtcgcttaagcccaggcagtttgtggctaccctggggacgaccttgaagagcatgtaaaggattttactcagttagtaacatggagttctgtggttgctgatcaggaggtggtggaggcaccgttgcgacaccattggaccatggggacacacttcagcaaaacataattgggagacctcttctaggcgggcaatgatgagaccttaaactcagttttcaagagcaaactgggtggagagttagctgtggacaagaggatatgaacgtggggatgatgttagaacctgaaggagtggaacttggtaagtgattacatgggcttgagagagagagggaggaatcaaaattccttcaggttccaaacaagtgttagggacacgtgagggtggaaattcaccctgatcttgggaaataattggttacatttgaaggagtagtttgggggactacatggagtctcaccttcgggggaaggtgaggcactgaataaaggaaggatatactactctttgagagagaaacaggatcattagagaggttttccttagcagagtgtattccgtatattcatactctaaaaggaaagcagccaggagaaagggagagattgaagatagaagaggaaaaaaccaattacatgtaattgtttcataacagaaaaaacttaggcagtgttcctccattgcattactaatgtatcttaaagcaccaaagctaacatcttatggaaaccacatttcaaggtttatgattgtgattgctttcagtttatttttacaaagatgctaatttccataaataacatggaagcataaagcagtttcctctccaagtatttcatggaattactttctggaatttgtcagcactgaacagctccggccaacgtatgctataaattattgtggtcaaatactcagaaatgcttttattgtccaagccttcatttacaaataaacggtattttattttgaaaataatttaaaaacaaagaagagtaactattttactaataaaagaatatttaaagtattaaaggactctaaattctctttactctcttttgaaattgcctttttttaaaatttaaaaacagcacatattcattataaaaatgtagaaaacacaggaagggacaatgatgaaaataagcatcacctttaattatactaattgttaggattttgttgtatagatttctgatattcttcttagaatattaacaaatatgtatcttttaaacagtgactatactccattttgataactatttaaaaaatttaatattatgaggagtattttctacatgtcattaaatattttcctataatgatattaaatgtattcctgctgttacatcatttggatgtgtcatgctttattgaccaattcttcactactgagtgttgaaatgtattcaaagaaatgtttgttaagacacataatttttgggtcaagaagtttgtgaaattttaagacctttaatatatactacagattgtcttttagaaaattccattgatgtctatgcttaccttgcaatagttgccactataagattaaggaaattttattagtaagaggttattaaaaatactttgggccatttgtattacttcttttttgtgtgttgtctccttaaggcattagaaatggaataacaggactgggcacaatggccacacctgtactcccagcactttaggaggctgaggtggaagggttgcttgactgcaggagttcaagaccagtctgcacaatatagggagacccccatccctacaacagataaagataaattatctgggcgtggtggtgtgtgtgcctgtggtgccagctacttgaaaggctgaagcaagaggatcacttgaatttgggaggttgaggctgcagtgagctctgattgtgccactgcactccagcctgggtgacagagcaagaccctgtctcaagaaaaaaaaaaaaagaaaagaaatagaaaaataaattttcatcttcatatgtatgccccatttttctatgagaatcttattaatttgtaagtactcctcatatacaaagagtattaattttttatcttatgttgcaaataattttcccattttgtcatttacattttatttttgtttatgttttggatatactgccattaaaaaattttaagtagtctaggaggctcttaattttttaactctctacttttgtcatgcttagaagtaacttcatgttgggagaaaatatatggatatctatattatcacctagtcttatatttctttttaaatatttaaatctttattttagaatatatgttgtcggttaatctttccgtcttttcttgtgctgatgcatacttttaaagttattgtacctttgtaatgtgttggtatccactaaggcaagacctcccttcattattacagttttgactagtccaggtctttaagtttttggtcacattccaggaacaaaaagttctcttgtcttaaatggcatatggtataatggaggagtaacaaaagttccttctctcaaaactttgtaaaacaaacaacaacaaaaagaacagtttatctctaatgaagcaaggaaatggtgccagcttccaaacacaaattatgaaggttttttttttttttttttttgagtactgtgaagtttggatgtaggggagggaggatcctgaagactgacatgtgtttccttggattctgagcaggacagagatttctgtaaggatgtcctatgtaataaactttttaaagaacagtgaaattggtggccctgagtgggtcttggaaaaagcaggtattgtccccaaaaaggcctagtttgacaccaaaaatgacatggtacatagaattgaaagggaacccttattgaccaaaaattggattgtccatttgtacaaaacagcctcctacagagggagattggtgcagatgaaatgggatgaaggggtgggtgggtggaagagcaaccctttccataacaaagagactgtaggttaggggctctcttgagatccctgatgacttttgaatgctgaaaatgaagagaagataggactccagagaaaagaaaataacatatttagtgataggattaaccaaacaccaaagcatagtggaagttagggactactctattcattttctgtctcgtaccccatgtcctctttatgctgctcttcagcttgaaacaacaaaaataagtgccatggaataagcaattgggaacatgctagacaaaatatacacccaacaagatgaaatgtaaaaaacaaaaatatacaaatggtgatagaaaaatgatgacaaaggaggcccaacatatgcatagttaatatttttgaaaaagagaacagaaaatattcaacaatataattaaggaaaacttttctcactcttttttttcaggtcattgtaaatattgattctgtttttttggtattgagtattactgaagagaagtctgtggtcaatctgatattttctcttttttttttctcactttgacactatacctacatgatttcttccttattctgaagtgtcatatcaggacatgatataaacaatttttatgtaaattattttttatttctgtgtgtatgtgtgtttgtgtttcagtaactttaaaaaatggggtcatcaaatatgtaatgttttcatttttatttttgctattcttttcctaagctcactttttctgttgtcttgaaatgtttcctttaaactcatatttctacctgagcttttaaaaagggagatcaagttgtccataatgtatttttgacttttttttgagtaatttatttagtaatacatgttctttgactacattttggttctgtttcttgctatttttaaaaatttgtgtgcatcaatcttgtgaacattctgttctgatgggtattctcttcttaatggggctctgctctgtgtgtctcccatcctccttggaccaagagactaaccagaacatattttttttcttggtaatgatagagatacaaaaaacccaaatgcacatgagtcttttaagcttctgcttatgtcatttctgctaacatcccactggccaaagcagctcacacagctgaagccaaagtcagggaatagggaaacatccttacctactatgaggccagagggcagagcaaattatacagccttgtccgatgttattagggcaggggagtgtgctccacccatggagattttctgtatctctgtgtgttggaggagtgagtatttatttattttttttagacggagtctcactcggctgcccagcctggagtgcagtggcgcagtcttggctcactgcaacctccgcctcctgggttcaagcgattctcctgccttagccaccccagtagctgggattacagttgtgcaccaccacgcgcggctaatttttgtatttttagtagagacggggtttcaccatattggccaggctggtctggaactcctgaccttgtgatctgcccgcatcggcctcccaaagtactgagatcacaggcgtgagccactgcacctggccgggagtgaggttttttttttttttttttttttttttttttttgagacagagtcttgctctgtctcccaggctggagtgctgtggcgtgatctcggctcgctgcaagctctgcctcctgggttcactccattctcctgcctcagcctcctgagtagctgggactacaggtgcccgccaccacgcccggctaatttttttgtatttttagtagagacggggtttcaccctgttagccaggatggtctcaatctcctgacgtcgtgatctgtccgcctcggcctcccaaagtgctgggattacaggtgtgagccaccgcgcccggccaggagtgagtatttttgaaaaataatctactctactgttgtggcaggcttttctttaaggcagcctagttccagagagcatgctttaatcactatactctcacaaccctcataaatgaaattatgactttgggaggagttgacacaaatcaggtctccctgatctgccacagccttacttcatgaaatagttgtttatacaacataggggctgagcatggtggctcacgcttgtaatcccagcactttgggaggccaaggcgggcagatcacctgaggttgggagttcgagaccagcctggccaacatggtgaaatctcatctctactaaaaatacaaaaattagccaagcttggtggtgcacgcctgtagtcccagctacttgggaggctgaggcaggagaattatttgaacctgggaggcagaggttgcagtgagctgagattgcgccactgcactccagcctgggtgacagtgagagactctgtctccaaaaaaaaaaaaaaaaaaaaaaaaagaacagaaaaagaaagatgttcataaattataggaagaagctttgattctttatttactatctcactcataatcctaactctaaccctagaccaaagtctgtagcagtagaaatccagaaaataattcctcttaatcccctaagtcagtggtgttatttaaattttttgactgtgactcacaggaagaaatgcattttatattatgaccacacacacacacacatatgcacacgtatgtttttcataatacttaaacaaaagttttgggaaacaatacttaatcctatttgtttttcttttccattctatttcatttcattctattccaattgattccatgaaaaaatggctaagacctaatcaattcattttataacccactaatggaatgtattcacagtgtgaaaaaatactgctctggttaatagaccccattctctgtctacctgtgtgtgtattgaggttggtatctggtaactgagacacttagcacaactgcctgattctggtcaactgatgtctattgtaactctgctctcctgggatggtatctcctgggctaaaccaactattgccaatggtgtgcagatacaactataatttccagcatgcttagtaattagcgttcttcagagctatctagatgttcatattctttcactcctttgacctagtaacatgaggaaacatagtaataggtttctgaatattgaatcatccttgtgttcctggcattaactgtacttggccatgatatattgttttttttaatattcagctggatttggtttgcaaatattttattgaaaattactacatctgtattcataagagatgttggtttgtactatatttttcaggtttttatatcaagattttcagtaacctcataaaatgcattgggtacttttcataattttcatttcctgggtctgtttaaattgcacagaaataacctgtttcttgaaggttggaaagaacttgccaataaaataaagagggcacagaactttttgggggcagcccttctttgacgtcctctttactttttatacaattgttggtgtgttcgggatttctccagattctttaatccaatttgatcaatataaaatacaaaaagataatttgtattttcctagaagccttctggacagcaaaggcaaatattttatactattttaaaatattttcaagttattttgcagtgatattttgatttattctctcttcagagaatgtgggttttatttagtctcattttttgaaatgttgtaaggtgctcaattttatgtgtatcccaaggatatttgatagttggacattttgtaaattttcacagctatttgacaataaattatattctctgcattgaagaatattgttctgctgtccccgactcttctttactagttctctccctctgcttttgcactcccatactaattcccctttagctctagtggggagcaatctaactcttttgttttcttgtctcctattgatctgtgtccttaggagctctgccaacaaatgcttgcctagctgtttttgtaagcaaagatacttctctccttaagaggaataatgggcctagctgttgggtaagattaaattctgctttccaatttgctgattttgcctctgggttgctttttagtttttacaatattatcaataaaggatatttaacgcctttgtgcaacaagcatttctctttattactaagttgtaccattagtagcctgggagagtgtcttgcgacctatactcactcgcatttgatgtcactaataaaatgttaactccatagaatcctgggcattttaaaccctgtcacccttaaatccaaatagaagtgaccaccctgggaatcagagtagagaattctgagggttggtatagctcatttaggagtacattttaagctatgttataaaatggatactctgagtctatagtttgtgaaaagagtgacccatatatgttagaatgcaaaaataaggtgtcagtgaagcaggggtgtaaatcataagcaaagcttgctggtgctccagggggtctggaagataggactcaaagtgtgtttggaaaggagaaagcactattgacatcttttgctaaggtgaaggcagggcctgtgaagaggctcttcctgcctggatgggtattctccgtgaagctgagggatgactgcccatttgctgggtgtgcagattgtagatcgtagcagaaagaagccagcctgaatgtgagggacatgcctgcccttctggaggaaagttgcccatttgttggcagtcatttgtaatcattattcctccagttgagagagaagagaaaagaggtgtgggatgggcagatgaaacaagtccaacaccctttactgttcaacccaaattcctttcaaagcaaacacttcacacttagaatgcagagcctcgtttccaaagaacagggataggtgggacatttgcaacgttgcttccttgtgccatgactctccaagggaaacagaccttcccagagcccagtcaggcctttgctgggggcctgagcagtggccttacttcttaggacaggctttgtgggtttgcatcttggaggtagaccggtggctttgagctgaccttggagctctccttcccgtccctgggaggtccagcatgtggcaggcatcattgttcacagctccagaggtggagcacttatgctgcaccctctgtaaatcctttctgggatgcattagcagcttccattgtcagagccaggaaagcattttggtgcatggagcaaagaaggaatgcatggagtggcaggcggccatgatctggcaggcgctgttcaggccctgtttgtgagagggctgttcacctaggtggtgccttctatgcacctggctgatgtctggtgggtctttagcagtgcgcttagcaaccagacactttaaaagataacagagcttttggggagagggagagaaacccagcctacaccatggaatgaactagccactgtttattatagtgttaattgataaacgaatagacaggcacacatacataattgtacgacacagagcaagatagataatgtactgattgctatcctcagtttttccccagtagagcattggtgagtccctagagtgtgacaggccaaggtggtgtctcagtctgttggcatcattgctgggttttttttctatgctgtctgctgaccctctctcatgcccttcccaggacacagagtgcattgagtaagccttggctcccaagatgcttcattggccagccctggggtagtgtcctagatgttaacagttttttttccactctaggaataaccaagggaagtttgtccttcaaaagacacatggcacgcaggacataggcatcttttttaagctgtcatgtggaagtactcactgacctcagagctctgttttgtaacataggattagcacataattctgaggtgcaattaatgaatccattgactgacaatccctgataaggtcaagaaagaaagctatcttaagagaaactaatatgagactagggttggcaccagaagtgcaagtggagtcctcatctgtattcagcatttagaattcatggcttcttctctgctttctgtttgtaaggttgttgtatactgcggacttttagcttctttaatatgaaatgtgtggtttgtaaatattttctcccagtatgtagcttgattcttttaccctcttataggtttttattttttatttttatgtttttttttttttggagaggaaaagttataaattttggtgaagttctatttatcaaattttttcacttatagatcatggtttttggtgtcatggctaagaatgctttgcctaccctaagtcctgaagattttctcctatgttttcttctaaatattttatagttttatattttatatttaagtaaatgatccattttgaattaatttgttcatacagtgtgaggttaaggtcacatcttacgttatatggtgtgaggttaaggtcaagactcacttttgcctatgatgtccaattgcaccatcgtcatttcttgaaaagacattcatcctccattacattacttttgctcctttgtcaaaaattagttgagggtatttgtttgggtctattttcagattcttcattttgttccattgatctatgtatctatttgtcctactgtgtcacactatcttgattactgtagctttacagtaagtcttagagtgattcctctttattattctttatcaaaattattttaactcttctagattctttgcatttccatgtaagttttgcttgtctatatataaacatatatatacacacatatacatatacacatatatacatatatacacacatatatacatatatacacatatatatacatatatacacacatatatacatatatacacacatatatacatatatacacacatatatacatatatatatatatatatatataaatcttgctggaattttgataggaattgtgttaaacctataggtcgcttttgggggaggataaacatttttactgtgttgagtcttcccaatccatgaatatggtctgtctcttcattatgtagctgtttcttgacttctatcataatgttttgtaaaattctgaacaatccttgttggatttataattacatattctatatttttttggagtgatggtaaatggtggtgggtttttcatttcattacccatctgttggttgctaatacacagaaatacaattgatttttgtgtattgatcttgtatcttgcaacctttctgaaatcatatactggttctaggaagggttcttttttagatttcttgggattctctacatagacaaagggatataagacctaaaattaacaaccaatactatgtgctgccttgatatctggtgaaactaggaggtccttgaatggcttaatgttaagtttctctccctaatccattcccatgggtaaggtccatggaagaattttttttaaatcatgaataggtgtttaattatgtgaaatgctcttttccgcatcagtttatatgatcacatgatttatctttttttcttttaatgctgttgatttgatgtattacattgattttcaggtattgaaccagccttgcatccctgaaataaactccacttggtcatggcctatcattctttttatatatattgctgaattctatttactaatattttgttgagaatttttgcatctaaattcatgagagatattcacgtgctgttttctttttttttttttttgtcctgtcattgtctggttttagtactatcttcataaaatgagttggagagtgttctctcttctgtttcctgaagagattggtgttctttacatgtttggtataattctccagtgaaacttggatatttcatttttgacagattttaaactgtgaactcaatttccttaacagttatatagtattattcaggttatctattttatattgagtgaattttggtattttttgtttttcaaggaatgggtctatttcaaattgttgaatttttctgtgtagaattgtttgttgcatttccttgttatccttttaatggttgcaggatctgtagtgatacccatttcattcctgatatttgaagtttgcattttttctcttttattctttgtaatattgcttacttttttctttgtcagcttattgttttgttgatctttaaaaagaattaggtttttgttttatacatttcctctgttgtttttctgttttctatttcagtgaattttgctctttattattttcttccttctggtcactttttttctccctctgttttccattttcttgggggtaggattagattattgatttgagatcttttcttttttttctaatgcaagcatttagtgctataaatttctctctctgtaactgagtttgccataccacaaaatttgatatgttttactttcattttcattcttattaaacaatatttttaagctttcctttgtgctatgttctcaatgtttgtgtccatccacctccaaattcatatgttaaaatcttaccctttggccaggcgtggtggctgacacctgtaatcctagcactttgggaggctgaggtgggcggatcatgaggtcaggagatcgagaccatcctggctaacatggtgaaaccccgtctctgctaaaaatacaaaaaattagccgggcttggtggtgggcgcctgtagtcccagctactcaggaggctgaggcaggagaatggcgtgaacccgggaaggggagcttgcagtgagcggagattgcaccgctgcactccagcctgggcgacagagtaacactccatctcaacaacaacaacaataacaaaatcctaccctccaaggttatggtattaggaagtgggaggtgatcaactcatgagggcaagccctcctgaatgagatcaatgcccttataaaataggccaaaaggcgcttgtttgccccttcttccacgtgaaaacacagtgagaagacacatctatgaaccagagagtaggccctcaccagatactggacttgctggaaccatgatcttggacctcccactctccagaactgtgagaaatacatttctgttttttataaactacccagtttgtgatattttgttaaagcatcccaaatggactaagacattttgagaatttctctttgactcatggattatttagaaacatgttatttactttcccagtgtttggaaattttcctgttacctttctgttactgatttctagttttattccattgtggtcaaataatagactctgtctgattttaatccttttaaattcactgaagtttgttttgtgtccaataatatggtctgttttggtgaatgttccatgggcactcttgaaaaaaatgtgtattctgctgttgttgggtggagtgttctttagatgtcaattagattttgttggttgatggcgttgtttagttcttctataatcttgctgattttctatctagttattcaaaattgctgagagagagatgatgaaatcctcaagtatagtttcattgagtataatttttctttcagttttatcagtttttgcttcaaatattttgaaactttgttgtttggtgcatacacatttagaattcctatgtcttcttggtggtagaactttgctctatgtctccgatatttttctttactctgaggtttactttatctaatatgaatgtagccacttcttttaaaaattactatgaaatatattattagcatagtatatgtgttttcatcgtttactttgaacctgcctacattatcatatttgaggtgagtttcttatagagagcatatggttgagtcatgtttttaaaaaattcattctgcccatctctatctggtatatcagtgtatttgctgtaatttgactatttacatgaaaagtaattatactaaataatacttcagttttccagttttaaacttattttgtctttagtctcacttttttttgttctgctgtttcccttttcttgccttcctgtgggttacttgaattttttttttaagattggatgttgatttttctatgggagttttcattttctctctctctctctctgtctctctctatttctctccctgcctctccccttcctgctttatcttattaaagtctactgataccaactttaccacctcacttagtgtagaaaccttacctctatttaggtccccttattctttacccttttgaatatagctgtcttaatatgtcctcaatatagtttgagcaccacatcagatgacataatttttgtttcaactgtcaaatacgtttaacaaactcataaggagaaggatattctattatcttcacccctatttttgcccattaattgttgtttcttccttccaagagttttgaagccatcttctgttattttatcctttctttttggaacacttcttttatctcttctttaatggtaggccttctggtgacaaattcttagttttgcttcatttgagaatgtcttgattccagaaggatatttttgctggatatagaattataggctaagagttcccctctcttttttagcacttgaaacacgttgtgctactgccttctgtctctgtggtttcagatgagaaatttaatgttattcaaattgtttttttcctgtaggtaatgcattgtttctctctagctgatttttagatttttgtttgtccttagatttgaaatgtttaatagtgatatatcttcttgtagttctttgggtttatgctgtttagaattcagattattgaatctttagttttagtcttttcccccaaattgggaaaattttagccattatttcttcaagtgttattttaggcaatatatatattgcctaatatatatattatatatatattgtgtatatatataacattaatatatatgtatatataatatatatttatataatataaaatataaatatatataaatatatatataaaatataaatatattatgaccatattattggatacaaaacaaacttcagtgaatttaaaaggaaatatatattttatatatatatatttcttctcctttttgttctgtgatagtgaaagtatcatatcctttgttattctcccataggcctcagatgttctgtttattttattttcagtatattttctttctgttgttcatattaagtaatttctcttgatttttgttgaagtatactgatctgtcatctcagtgtgctaaaaacctctatccagtgaggttttaaaaattttttaaatttaagatattgcgttttcagttctgtaatttctatttgggttttaaaacatatcttctatttcttttatgagattttctattttttgtttgtttcaagagtgctcataattgctcatagaaacatttttaagatggctgctttaacatcattggcagataatttgaacatctgagttcatttcagtgtaggtatctgttgattgtcttttcccatttaagttattttcctaattcgtagtataaaaagtgatttttaaattatatcctaaacattttgagtattatgagactctggatcttatttgattcaatttaaatctatcttctatttcagcagacagtgatcatgtttagatctagtgtgtaggtccctgcctcctttcgtaggccataattataagagtttaatttttagtgccctgcaatgctactctgatctgcttcattcacatgcagtggtattccacacagtagttcagttctcaaaccttttgtattgttaattctggtcagtttcatgtgtgagttggttaggggtctgcctagagctttatgtgaagttttaaggatttcctttctccagctcccttctctccaagttgtgcctccccagcccccactctatttgtgagggagaggagcaccgcctgccaccactgggtaagggtggaagtccaggcttctcacttcatctcagcagatattgtccagcagtggttaaggggagtgttactctgtgttacccattattaccaggattaaggtgggagtccaaaatcctgacttggtctttgctgacaccatgccaccattggtgggagggtagcatgtcccagagtgtccactaccatttattagggtgtagaaattcagacttttcactctttgcagggcaggagttggggaaggcatccatggtgtttggctgatgtaagggggttattgtcaaaaagatgtttgttgtgctgggctgtctcctagtcctttgactggagagagcaggcttttatttcctttttgtctctgcttgttggcatttatgagttgcattgttctctagcacacagtccagaacatatggaatgtgaaaggaaaacccagtgaacccaccactatattgttccttaagttctgaggttcctagccagtcttttctcttctttttacttttcagaggctcttcttatgatggtttgtgtgattatgtccagggtgtttagttgtatttgggtgatgggcaagggggacatgagtatacaccattttgtccataatccaagattcctttttgtaatctttgataatttcgatacttttactaagatatgactaggtcctaatttttgattggcacaccttagttgttgttttttttttttttgacttaggaatgttttcttctagtatgtctttaaatattttttcttctcttttagtttttctgttcccttctttaagaacatcaattttccatatgtagatattgtactgtttaatcatcttttataatttttgtgttttcctttttatccctaattctcacactgatctgctacttaactgacttaattttctgtaatgtaatttctgctctgtaccttttctggtgctttaagacattatttcctttcattatttttttatactagctcttttttaaatttcaaattattgtcttaataagatattgttcatggtattattcatgtcttatttttcaaaggtcatgttttctttaatttccttaagagttcaaagcaaatgttatccaaaatttagtttattttctagaataaaaatttaaaacattttctcttacagattacattattattattttaatgctacagattctcgtagttttcaagttggttttattcctgtttacatattcttcaataagcatttgcaatagccctatcactatttgcagtattccccaaacttgggaggcacacttttccttggatctgataccagctagaataggctatatcatgcttcagtaacaaataatcaaaatattttagtgacataatacagaaaggattttttcttgttcatttacatatctatcacatttctcctcagtgctgttgccatctgaaacattgcagatttccatgtcagaggaaaatagaaaatgtggcaaattgggtgcttgatcttaaagacttctgaatagaggtgacacgtcatttatattttgttagttaaaataagtcatgtggacatacttaacttcaaagggatggggtcgtgcacttctatcatggacccaggaggagaactgaaaatatttagtgagaagcactaatggctaccatagatccaccgttgtttgcttttgtgccctagaaattcatctttaaggtgatcaagaatggattcgggattaatgttaggcaaatatttgccagcctagacatatcaatagttctggttgacatttctctgattggttagtgcctgtggattaaatagtttgaatagcactctaaaagggctggctgtggaagctggggtcatggacagccctaactacagactcacattggatgtggtcgacttgctttcccaatttccctaactgctgtcggtgcatggtaagagaaagagagagacctcaagtgaaggtgttcccgtctcccctgtgccctgtcatggtcttcagctgctaaccctccatatcaaggatacttctagaattttatttatttactccccataacattgctcctcttttcctaagaatggacatttaaaaatctgtccttagtgacttctttttttatttgatcctacctgtacttgatctagcaaaaacaccttaaaatttgtgttgtatagttggcattgtttccaatttcagaactatttttgatattctcttgttctgtttttcttcagttgttttggacaatttctggctagagacgcttgggtatcttagttacctgaatgctggcatcttgactctgtgaccctgggagagggctcttggctgtatgtagcaggcttctctgtattctctctggcataatttatggttggccagttgatttagagactcagggatgggataaagagagcatcagagatcatggagcctgagacagacctgcccaaggttcacaggacaagtgagggtcagaactaatagcagatctacacctatagctcaccagatgtcttgttctggaaaacctgtggtatccagaccagaaggtagcaggtaggggactctacttgtcacactaccttagatgcatttacctttgctctttctctgtcgtatgtcactctttcaccatcccattcttctattccatgtctttttatcctttttctctgagatatgttaggtcttccagaagagcctaccaatgtcactcgtccttgctgttggcacaaatggctgagtagattgatgactagtatattggaagaggaactaagttggtgtctcatgggagaacattggtgttaaagggtaaggagattcagtgtttgtttattgtacaaggaagcatgatagtgccgtagtctaaataatactaattggtgtttcccttggcttggcctgaatcacactgttttccttaaattttccattagagagcagatgtcatctaatgactttcctacaaatgtttgctttcttagaagtgagctatgtttatttcttcagttacaaaaatgtgttgtttataactcgtaaagaaatgtgactctattctgatttgcctcccattaacttttctccctgggtgattacccagcctattgtctggtggactaaactgcctagtggtgagaaagacatcccaggcaggccatcaaagcttgcctgatgtttttcagaggtttaagagtacaaggaaattcacttggaaatatttggactttggccacaaattcaatttaaggcattggctcaacaaaactggtcattcctttgagccaagatgaaaccagcattagtggggagaatgaaagatggttgatacttgctcagaccttctgtgtgcagccatgaagataggtattactgagtttttactttacccttgcatgtggcttgttgtttcctccaaatagtgtggccaattgtgtattcaggctgtagtcaaactgaacttgcactgctccatgctttcctcttcttattttcccctcctctcagtccttcctccctgctcctctattgttaatcctagctatccttcaacactcaagacatccacaaagtctttcccaatcctcccactggcatacatctccccgtttttgtatcccatcatgtaattatttctacacatgtcttttctccttcgttggacttcccatttgacttttcttccccattccttgaggtctatgtctattttacctttgggcccctcacacaatctagagcagatcctgggacataatgaagactcatttgagcatatggtatctgtctggaagaagtccacgtcaaattgaggaggtaagtaggcaacaggacctaagtagcagaaaacagttcctggcagccttgttgcatctggagtccctgtccatccagtactgtacccggcgcctccttcacaccctcagtctctaaggtcagtagcgctccattccatggccctttccacacttgtctcatactttcaacacctgagcttctcatataggagctgctattgttttctcatacagctgtgtttttccctaagacatcttaaagatctggcttaggctttgacagcctgacacttaatcattttgtttttgttttctcattctgcttttagtaaaaacatttatgttttctcccttgcataatagtattttaggccatacatatgtccccggctaaaaacttcacgttggtattccaaccttagagcttcatagtagatttgaaacctgaagcaaagattacttgtttacaacctatcaaggataacattaatttatcttgtcagcatccttgcttatgtctcatagatattataagtttttggagatttctgcttagtttgttaataattaaatggattaaataaataatacagacacacacatttaccacttcccagtttgcaaaataaaactttgtcaacacaaaaccctagccacattttccttttcctctcccttttgtcttcagaggaaatgaccattctgaattttaagtttataatttctttcctgttctttatacttttgctacatatttctaaacaaaatatacattgttattttgtacttttaaaactttatataaatggctaggacttgaagttccagccacttgggagtctgagggaggaggatcacttgaggccaggagtttgaggctgtagtgtgctatagttgtgcctgtgaatagccactgcactccagcctgggtaacatagcaagaccccatctctagggaaaaaaaacaaccaaaaaacccactttatataagacaattatactgtgagtattctgtaacgtgcttcaattactgggcattatgttagtgagattattcatgttgttaaatatagttttaattcatttattttcactgttgtgtagtatctcactgtatgaagacatcagaattctttatttattctcctgttgtacatttagttgttttcaattttgttttttacaaacaattctatatatcttctttatatatgttcatttttctaaggtctatacctaggagtggaattgctgggggaaatgatacacccatcttgaggtttactagcttttggaaaaattattaggtaaaatatggcaacaatgtatagtttaactgaacaattaagaatcctagttgtaccatattatcttcagtacttgatattgtcgggctttttcttttttgccagttcatggttataaaatggtatctcttcagtattataatttatattgccctgattactagtgaaatacccatcttttcatgtttactggcgtttgcctttctacttctgcgaattgcttattcttttgcccttaagggtttttttgtttttgttttttccttcttttagtttatttgtacacatcatttatgtattctggatacaaattctttgttggttatataccttttctcagtctttggcctgttttttttatctttaatggtgaacaaaaatgtttatttgtatttattgtagtttctctctagaaatataagctcttggacagcagggcttttggtctcttttgttcagtgatgtatcctaggtgcctggggcagtgtgtgacaactgtcagatgttcagaaatatttgttgaatcagtgaatggaaggatgattactgatcttgtctcttatagtttgcctttttgtgtgtctttttaaagaaatcccttcttactttgatgccacaaagatttcctcttatattttcttctaaatgtttaacttcatttgtttttcgcccaaaggaaaattattttatatcctgtatggctctgggaagaggaaatgaatgagttttccaatgggctgtgccacattctaactgttatattagacagctctctttacctccagaacctcatttctttccctctttctcaaacggagatgatactaacttccttgtgcagggttgatgtgagattaatttagataaactatgccaagcatctagtagatgcctggcatgtcatagtcatttaataaggtagctgtttcttctttctcttttatcttccctgaggacagcaaaatgaaagtgaggccccaggaatatgaaactgcctttccctgtgacttcccccggtacgtagagaaaccccgcaatgggctctttccagcctcttgctggcagctagctcgtcctccctcctccttctcctggtctggcctcttctccacagcctgggtttctgccctaagccaagtagcagacgcctctcttttacaacctgtcacagacctctgagtagatgcaggcaagcagctacaccatttttccttctgaacacttaaagacgcttttcatcaaaactgagctgtttttaaagaagggtatagaccggttttctcacaagcaactttgtgattcatttgcatttcacttactcctgaacacaaccaatcatatcggtcagtgttttactgtgggcagcgacttgctatgggaggggacaaacagatttgtggtaatgatgagatatcatccaagtgtcagaaatagatatagtcacactttgaattatgcttgagttgcagctgctaaaaatggaagaaatggaagaaacttcatgtcttggattatgcacaacattgcagttagaacatttgtgctgttttatggcttcctgctcaggaatcaaatgatttagttgttcagtttcattgtgggattcttctatgtggtgttcttgcagttaggtcttttcacagtggtttgaggttggtggcagagctaataattgatgtgtgggtgggaccccttcttaggtatggagtctgcaatgccacgaggtcttgattattcctttgtgaagcccctttaggtatcatctccttagtcttgaaccaaagactgcatcttggtgagtaaaatgtattggaaacacttgcctgacttaaatcagtgcctttccttctcctcagaacttttagggaagtaagaactactccaggatcttatatagcagcactgttccataaaaatgtaatgcaagccacatatataactgtacattttctagtagctgtattaaaataagctaaaaggggtgggttcagtggctcacacctgtaattccagtgctttgaggggctgaggtaggaggactacttgagttgaggagttcgagatgagtctgggcaacacagcaggaccctgtctctacaaacaaacaaacaaacaaacaaacaaacagttagctggcatagtggaggtcctgttgtcctggctacttaggaggctgaggtgggggagtcccttgagcccaggagtttgaagttgcagtgagctatgattgtaccactgcacttcagcctgggccgcagagtgaaactctatctctaaaataaaataaaattaaattaagttgaaagtatcaagtgaaaattaattttagtaacatatttcatttaacttaatatatccaaatattatttcaacatgtaatcagtatgaaaatcctaaatgagatattttacattactttttgtcctactaagtcttttgaaatcaagtacttattttacattttcagcccatctcaattcagactagctgcatttagaatgtatgatagccacgtgtgtctactggctactctactgaacagtgcagctcttaggacttcctgggaaaaggtgggatcagtatatcttgccctatcttgttccttccatcactcagaccacagctagctgttacatcctctgtcctcttttgcttgcaaggagataaccaatgtagagtttaatctttacatagcctacagcttccccctccccgttaacatactgataagctacatatgatttcaaaatatccttcaatattacttcttagattgtgtatgtgaaagaatatgaaagcagcacacctagggggcctagcagccagaaggaggaataacaggccatatatccagaacagatggctcttattgaaacagtactgatggcggggatggaggaaaactggaacagccaccaactaagagtatgtaaggagattccactacagcccaacaccagttttttaaactaaaaatcaaatgagattttccaagcaaaaattcagtggatgagttgaaggaaagccaagtggaggaaataccatctaacacagtggaaaaccacaaagtgtaaagcatgagggaaaagctaagagacttggagaacagttttagaagccttaacgttcaaacaatagaagcagcaggaggaaaggaatggatggagaaggggcaataatgaaacaactgttagaaagtttccttgaatgaaggaagacttgtatctcaaagggtgcactctctggcttacagtcaggactgatgagaaaagacgcatactgagacatatacttaatctgtaaaatttctaacttctaaggaggaagatgaaaagatttctggagttgccacattatattatttaaactctctagttttcaaccaaacgttatgaggcacacaatgaaacagcaaagtgtggcccataacatgaaaagaaagccgttaataaaaactgtcttttaggaagccagatgttggacatattagacagatactttagatcagctgttacaaatatgttcaaaaactccagatgaaagaaaagtaactcataatgggaaaacaatctgattgataacagactcttttttttttgcaattcttaattctagaaaatagtgaaattatatttatttgtatatttttaacctttacgttcttttattcctatggaattgttttaggtgcattgagggaggatctgtgtttactcattttcctccttatttatctattgagctgaagaatttattaaataattcaccactttctcattgatacaaaaaaaactatctagtgttaagtatacacatgcatatatatacacacacacacacacacacacacacatacacacacacacatgcctgatttaaaacaaaattaattttttttgagacaaggtcttgctctgtcgccaggctagagtgtagtggcatgatcttggctcactgcagcttccacctcctgggctcaggtgatcctcccatctcagcctcccaggtagctgggactacaggtgtgtgccaccacagcaggctaatttttttgtttttgtttttgcattttttgtagagacggagtttcaccatgttgcccaggctggtctcgaactcctgggctcaagtgatccacccgtcttggcctcccaagatgttgggattacaggtgtgagccactgcacctggcctaaaacttattttattataaaatgtatatacaaaagaattcatataacgtgatatttaaaggaagatggccatataaatttgtgtagtgcccaactgcacaataatacgtaagatggctcagtaataatgacatagtgaacatgtaggtacctaccgtggagcttaggaaatggaacagtatcaatacctgtgaagcttcttgtatgacttttccttactctctcctactctctgctcagatgtatgcacagcaaaggtgaatttagtttttatacttccttatctttatagtttaccatttgagtatgtatccctaaataatatatcattttttgctgtcactgttttggattttatacaaatggaatcataccttgccttattctgctcagtattgtagttttaaatttcatctctgttgacctgtgaagctgagctcactcatttttactgctttattgtattccagtgtataaatacaccacgatttattgattcattctactgttgatggtttatttttgtaaaatgttagatttattttgtcttttatttagaaatctgccttcattttagagtgagactgatatgtgatttttttcttttattattcttatttggttttgttttcaagagcataataaactcataagatgaattattgggtgttcctttcttttactattctttgaaagagttttcttttttttaaagatgagaattatttatactttgaatgttgtgtagagcacacatgttttgtagggcacacctgtaaaaccttgtggttgtattgttttctttatggaaagaatgtaaaaaacggattccatttctttattggttaaaggactattgagattttcctcttctatttggagtcagttttggttaattacatagtttgtctgaaactttgccacttgtcccaatatttcaaatatattaggataattttttcttgagttctgagatatgttattttgttctggttcattttcctctcaatcctcattgccccatcatttgtctcctggaatgttacagcggcctcactagtttccctgccttctgtatcacttaccctcccatccattcttcataataataatttcacttctctacttaatatctctccagtgcttcctcaggatgaacacggacttcatggtctgccttccagagccccttcaggatccagcccatgcctacctctccaacttctcttctcccaacttcccccacattctgaaatccagctctgcagagctacacaccgttcatgcaacttggactgttgccccccgtctcctgtccttgcctgtgttgttcattatgcccctgttgttctagaagatctgttcctctgtcctctccatttttctggctaattcctacttgttctttacatctcagctttgtggtcattgcctctgtaatgccatgtgtgacacttacgctcctgtgcccccctagcactctgttcttccctgtcttggatagtccttgtcacatagcttcagaattgcctatttgcttgtctgtttctcattccacacccaatcccagacagtgagttccatgggagcatggagtgtcttgttccgtctctcatggctagcaccagacaagacgcatgcttgtacagtagtactaaggcttacattaaaaccttgcctttagaactttgtgattacaacaatcgtaatatcatacatttgtacagcttcttacagtttaaagaacactatcacatacattattttaggaaactgaagccttgggagcacaaatatgccttgtcaaaatatgcaagctgcctcctctcaccagtagcagtggggtgaagaaataagctagggttcaatgttgattcttttatcgtgaggttattctacattttccttttatcactgagctgagtgtggctctatctgagggctctttgagtcggtgaaggggcactgtgcagtttttctctcctgcgcctccttttgatttaagaaaatgcaatgattctcatgacaaaggataccagagttttattttttgactgctgggtatttttctcctcagggaactttttttctaaattcacatcaatggtattactttggtaattaagaaatatacagtagagagacaaaattactgcaccttcatcctcctgcctggctttccttccgctgtggagaattttggagttcatctaacacatgttgcccacctttagcagtgtggagagtaagacctggagacctgaaaggtcgtgtcaggagccatatggtcactttcttgcagaggtgggttgggcgcttgggctcccaactgcaagcctggctcccttttgaaatttgagcagccatcaccaatatattataacagatgtccagtgtctccaagtttgtctagtttgtgtgattttccaaatatctactactaatgagtccaatgtttattcaaacccaaaaccaagttacattttcttttcttcgtttatttatttattttgagatggagtttcattattgcctaggctggagtgcaatggtgcgatcttggctcattgcaacctccacctcccaggttcaagtgattctcctgcctcagcctcccgagtagctgggattacaggcgcctgccaccatgcccagctaatttttgtatttttagtagagacgggtttcaccacgttggtcatgctggtctcgaactcctgacctcaagtgatctgcccgctttggcctcccaaagtgctgggattacaggtgtgaaccacggcgcccagcgtccaagtgacattttaatgtcaaataaatatagaatggtatgatgatgttttaagcaaccaaaagaaaagtattcataattccatatattaagaaatttaaagtataccttaaaatatgccaacttaaagtcagaaacctgtattgcacccaacacactgcttggatcatagactgtagtttgccttcttcttttttttttcttttaacaaaagatagtatgtttgtaacagttttttttttcctgctgatttatgactccaatatggctttgttaccattgtattgcaggggttgatgttagcatcttaatattataaaaacatcaccttttgtttttaagaagtctttaatatgttctgctaacccccaaggattttttttttgtggtttatagaaatgagagtgatgccattttatatacattgaacaaagacaccctgactctaaatctctgtcttcctatcgtcttgcttgtttaagagttttgaggctgggcacggtggctcacacctataatcccagcactttgggaggccgaggtgggcggatcacgaggtcaggagatcgagaccatcctggctaacaccgtgaaaccctgtctctactgaaaaatacaaaaaattagctgggtgtggcggcgggcacctgtagccccagctactggggaggctgaggcaggagaatgtcatgaacctgagaggcagagtttgcagtgagctgagatcgcgccactgcactccagcctgggcgacagagcgagactccatctcaaaaaaaaaaaaaaaaaaaaaagaattttgaaagccatgagcatccaaacagcaaatctggcagctccactgatgtgttcacactgaacacttcctgccctgaaaagcttagaaaaacaaaccagcttaagatgaatataaacgtttttcggagtatgtgcaaaaagcacatttctgtctttttcttctcttggaaggctgcattttgaaagcctgcatgatttcagccacacagacgagctgtttcctgaaagaaataaagctgtaggggtgagaaagaccttgaataaacatgaatgtgtccccgacgtgtttctggactttgtcaggttgggaggtgtctcattgccaaattgggaagagctggtaatgctttttttttctttctttcttcttttttattttttttgctactgaattaacacaaatgcatgcgtgagaatatacacagatttgtctgatactcagtaatggtctctgaggttggcaacaagaacgtcatgtctgcataattaatcagttgttgacatggatgttttctgcatatgtcggttgcactggtgttataaggtgtgagcattgttgggctatgtctcactgggcagaagcatggccaggagaacagccagggacagcaggatggcagaggcccccactggtccaggaggcaggaggtgcttggggagcagccatgctcgggcctggccaggctggagctggagggctgtggaggcagagtacttggaccaaggaggaaagggtcactctactgccttgggtagaggcagatggactccagcgtcctgcaggtcccagccaggttcctagagagtatagaccctttgaaatctccaaggaagatggcaagatccaacttgtcagtttagataatcagaaaaaaaaagtgattctttaaggaacctagacctactctggtctgccctgaacactctatttaaagctgcaatttataccccatctcccagcactttggatttccttttcccatatgacatagtatacaatttacttctctattatgtttatttctgcttccccaagttagaatatgagctccttgggaaaagtgattcttgtctgttttgttgactgttgaactctcagtagcaaaaatagtacttggcacatagtaggtgcttaataaacatatgctgagtgattgaatgggtcctgtgaaccccaagaattaacctaacactccattcttttgagattctccccccgcaaccatttgggtaaaataaaatatttatttgtacttaatttaaaagacaaagatgccttttctctgccagagagataatgatgagtgttagtggtgaagaggctgtgggaaaatacatgcttcactggaggatcaaagtgcagattccactgcctagatggggccctgagagcatgttcttcttcaacacggaattcctgtcagggcgtggaagcgatttttgggaaagaccaagatccaccagaaaacacctcccttctgcaccgcactttttctggtagctctcacaaacagcacttactctcaccaacagtgactcatgcccctcggataacaaataaccagcattctctctctcctgggtgctttggtgggaacggaacggtgtcacccctcaccgagtggctagaccaggaggagggggaggctggcggagagtgaggtagggagtttacaatttatcaagatttgagacaaacacctcgtttttttctctagcaatggagccctgttcatagaatactattttcagtttttttcctggggaactttaaagtagacttatttccatgtgacattttgctaattgaggctgtttccaataggtcagcttacttcaaggtcttgaaaaatggactcttaagtaaaatttttggggggcgggctctagggaaagaggatctgcattgtgtatattggcagggcaaggctttctttccgctccccattcggaggaatagttgagtttttaaataaccccttgtgaaatgccagcatgctactcagccagagcctttgggccttctgtggtgcagagaatattcagacagcaggcatgcaggctctgcggggagagggtcaacctgggctggctttcctacaaaagatgttagttactgaaggtcttccatgtataaagcccagtgctgagcactaaagaacgttcagatatgtagagaagtcatacaactccatgtttaggttttctccttttggggaactgaaaggtgaaatgtgttctagcaagatcttttcactgattaatctgggccctgcttgccaatgctaactagggatgtgggagtcagtgtgtgtgctatgtggtgtatatgtatttggagtatttgtggcgtgtgcatgtatgtagtgtgtggggtgtgtgtgtggtatgtgtgcatgtgtggtgtgtgtgtgtgggggtatatttgtggtgtaggtatgtgtgtgtgtatgtatgtagcatgtgatgtgcatgatatgtgcatgatacgtttgtggtgtgtgtgtgtgtgtgtaatgtgtgtgtgtgtgtgtgtgtgtgtgtgtgtgtggtggtggggtctttgagaaggggagggaaggagagagagggagagagaaaattccagagaaaatgcatgttttgtggcagaaggaggagtggtgctatgaaaattccagtttgctaaagagattcttcctgtgatagatttaaactccgggaaggagcctgtccatgtaaacagctcattctgagtaagggaagcactcgcaaggccctgcccacctcactgacctaggaggggaggagaagggcccggggctcatatttcttttgaaaatgtgacccagagtgaagctgaagttcaaaactacatggtattttggctgaggtgtatccagactttattcaaatgttaggtcttttaaatgaacaatattagaagaacatataattaattgatggtaaatagagaaaaagaatcttaaatccctggaaataattttttttatcttggaaaaaaatgtgaaaagtccttttcttttaaaccctcccttccaatcctgccaaagtaaatgtattttatatttcatcaggaaggttttggacacttaagactgaaaagtctcataatgaccgcattctacttgaaaaaccaaaatgatctggaaggtttattttttaacttttgtttcaggttcaaggaaccaaatgtacatcatggtttttttttgaagaaaaatgtgttgggtgcactgagtttaagtactgctggttaacttgactttccctcatgggccttggaagctacaaactgtaaagtcccatgtgccatccaggccagggggaatagcccctgaggccccagaggaatacagagaatgtatcccttgcagactgtggctggcgttgagcctggggattctgcctgatttgcctggaagatacgcttcctgactcatggaatattgacatttaaagggacctttcacttgtaggagtgatcctaacttcccattcaaatactaaagtcttcctggccgatcttggtttgtcacccaggctggagtgtggtgacatgatcaccgctcactgcagtgcggccttgacctcctggactcaagtgatcctcctgcctcggcttccctaagtgctgggattacaggcatgagtcaccacgccctgctttggttgctgttaatagagataggcctacctatgcattaatattcctgacagtgaccttacatggtgtctggctaagcgctggtgtcatgggaagagtccagcaataatggctcagggctttgccttcttggcatttagcctttgcccaacctgttaaaatctgttggaatctcagttcttccatctagcatcttaccttcttgtgtcgtctgtcagtgtagatttgaagcgtctgagagtgtattccttgaatccttagtggccaagatgacgacatgtcaaatgaggaactataattgggcaaatttgccatcagcctggataggtagagggctcaggcctcagccctattcctgttcagtgtttgtagcagtgacaaggaggcagattgtgagcatgccccacaaatttgggctgacgtgaagcagggggagagtgctgcatatcctgataaatggagtccagatctaaaacagtcttgagatgccaaatctaaagagaaagtgaatggcaggaaagcgtgcagttgggttctcaatccagagtgcagtgacatggcttagcaatggcatgtgggagaaaggctaggtcccttcactgaccgaggttctgtagacgttagcggtgtgatatttggctgtgtttgtgctctggagagagatgggtgtgagagctcacaccaggttaggagaagtgttcagactggcttgtttaattgcaatgggaatcacattgtgtttgttttaactggtgactgcttaacttttgaggcacactggattctgctcttgaatctaggaataccctcttctcccctgcttctctctcttcccattacatcaatctgagaaataggaaaaaacaaaacactaaagtgctttttcatactgtccattttccactcaacacagcacttgtgtggaggtatttctgcacacagcaagctattcactggacaccactgggtatcctctatttcaattcaattctgagactatctacctagagatagtatcagaccccacaggttaagggctccatcccacaagactgcccttcacacgccaatctcaagcagtaggttgagtataggttatcacttatacttctgacaaacaggctataaattgagcctctccttggctttgactaatttgccagagcagcttggagagctaaatgaaacactttacttacatcttctagcttataaagggatagaataaaggataaagatgaatgcccagatgaagagatacgtagggtgaggtctggaaggaggtcccaagtgcaggagttggggtgtgccacctccaggcacacagatatgttcaccaactcagaaactccctgaacccaatccttctgagttttcatggaggcttcattacccaggcatggttgatgacctcattggccattagtatcagctcaactttcagcacctctcccttcaccagaggttgggggtgaggactgaaagttccaaccctctaatcacttgattggttcccctggcaaccagcccccatcctgaggctatccaggggtccaccaagagtaacctcattagaacaaaagatgcttctagcacccaggaaattccaaggaatttaggggctgagtcagatgcccctgtcactcaggaaatcacaaagccttaggagctctgtgtcaggaactgcagtcaaagaccaaatagtagaacaaaagattctcctatggcccctattgctcacaaaattacaaggattttaggagctctatgtcaagaaccttagtcagaggccacatatatatttctattatatcataatatcacaatcaagcagaactttcacccagctttcatagttattcttgaccctttacaatgtgtagatcaaggtctagaatgctcaactcttgtccttgactagccatcccatatacacttcctcctgctcaagtcaaatccttcagctggatggggatgtggagacacagctgtatccccacgtctcatattcatagtccctggaggtgctgtctggattcctcctgaccttgtccctggtgactcagcagctgtggacagtggctggtggagatgatgcattttggcagcttctctcctaggcctggctcagtgccctgggaagatcgcacacttcctgatccaggcttgttcctcctgctttccctccaacttttgctacttaagggccctgacccctttggtcaccccatcctgtgagggccacatgccactgagtcttcctgacatttaggaagtcaacttccatctggctggaaatgtccaacgcatgtttggtatgatgcttgctttctgaagccgtgtgtgaactcagccatttctcctaagggaaggcccaatttttctaagaaaaactgcaccataactacccttgtcaaagtcaacgttgacttccctgttgctagatccaagggatacttctctggcctcatcttcctcagtttcttagcagcattcaagacacttgactattctgtttgacgctaaatcttcccatgacctaatatagggtgttttcctttttattctactctaattgatgttcatttttagtctcttctgcttgctcctcctcttctacttaatttcaaatattagaattgagggtgtcaggcaaagccctcttgcctgccaaactctttctctagggagtggcttttctggtataatggttgtaaatatatgtaaatatacatacatacatacatacattatgaaaatgttaagtgatgacttccaaatccctatctccagcgtcagatttcctttctgagctctggacttgcatattgaatggcaaactcaagctcttcacatggatgttttatggacacctccaacttaacatgactcaaacagaactgttgactctatcctcaccaacaaatcagtttctgcctcagggctatccatccattacaattcctttacagccattgctcaagccaaaaacccagaagtcacccttgattcctcccttttcctccctcatcggaaagctttgttggttctacttctaatccatgcacctctccccttctctactgccatcatcccagtccaaggaaccatcccttttcacctgggttagtaccaacagccttccaactagtctttgtgattccactttaccttcttctagctcagtctccacaaagcagtcagtgttgtttaaatactcttctattgttctccgtctccttaccataaggctttaaatgtcttgggtggcttttcccttccttctttatccatttcgtgccactgttacttgtccgcactgaattcagccacactctagttcttccaattcactgacttcctttccactttggagcttttgtacttgctcttcttttgccggtaatactcatccttagctttttccataactggctcctcctgtttgaggtatcatctgaaatcttatcttcccatggatgccttttttgaccatcttatctaaaattgaacagtcctctcccaacattattctcatatcaccttgtttatttcctttagaacttagaatgttagttttcttatttatgtatttgtttacttattttactatgtatctccacctctaggatgtaacctccatgaaaataggaacctgatcttttttgttcctcattgtatctatcgcactgagaactgtgccaggcatatattaggtgctcaataaatatgtgttgaatgcatggtcaactgaatataagcatcacactggaaggtccactatatgcgggaagctgttttaaggtggcgatctttgactgcttccactctggtaaatggatctgtccaggtattggcacatggctgctaacaggttccagccctggctgtaagcctgcgtctgttcctcaaactcactgacctcctttctattttagggcttttgcacttgttctttttttgtgtgccaggaatagtcactgtcagatttggtgattggttagtctcctaactctcagagctatagtttactcatttttaaaataaggagtttgacctagatgacttctaaggtctctttaggtatttaaaatgatgattctggctgggcgcggtggctcatgcctgtaatcccagcactttgggaggccaaggcgggcaggtcgcctgagattaggtgttcgagaccagcctggccaacatggtgaaaccccgtctctactaaaaatacaaaaattatccaggcatggtggtgggcacttgtaatcccagctactaggaaggctgaggcaggagaattgcttgaacctgtgaggcggagagtgcagtgagctgaaatcacgtcactcaattccagcctgggtgacagagcaagactccgtctaaaaaaaattaaagtaaaaaaaataaagtgatgattgaagccagtaagagcaattagcaatagtggtgctaaatctctcacataaatgaaatttaataagaaagtcttcaaattattttaacagtctagtgctatctaagccatctagtctagtggagttatctcttctatattccttgacagaatgatgttgatttccctttctaaaacacagtattcagagggacgttttagcgtaaactatagttcctgctgcagtttgagaatgagtccattggagcagcagaggtgtcagaggaatatgtttactccctgcttctcctgtttgcagagagcaattttcttagagtaacacctgtggcctcttaatttatttctgactcatttcttcccaagcagggggagtgaggtatccagtcgggggtatagtcacagatccatgtatttttgactggatggggctaagctctgcagattctatctcctttattactttcctccttgaagcaatcaaggcagtgatcctggtaaaccctctacctcctcagtcttcccttggacaggctctcccaggaggtgggtgatagtgtgatggtagcaagtccattgggtcatcatatcccagccatattcccctaaagagggtgtcctttctgaccccctcagactccaaccattgtgatttatgtccagtgattcagatgccaggtaatatggtttgattctgtgtccccacccaaatctcatcttcaattgtgctctcataattcccacatgctgtgggagagacccggtgggagataatttgaatcatgggggaggtatcccccatactgttctcatggcagtgaataagtctcacaagatctgatggctttatcaatggtttccactttgcatcccttcattttctcttgccaccatcatgtaagaagtgccttttgcctcctgccatgattctgaggcctccccagccatgtcgaactgtaagtccaattaaacctctttttcttcccagtctcgagtatgtcattaccagcagcatgaaattggactaattcagtaaattggcaccagtggaatcgggtgctgctgaaaagatacctgaaaatgtagaagcaactttggaactgggtaacaagcagaggttggaacagtttggagggctcagaagaagacaggaaaatgtgggaaagtttggaactccggagagacttgttgattgcctttaccaaaatgctgataatgatatgaatgaaaaggtccaggctgaggtggtctcagatagagatgaggaacttcttgggaactggagcaaaggtgactcttgttatgttttggcaaagagactggtggcattttgcccctgccctagagatttgtggaactttgaacttgagagagaagatttagggtacccggtggaagaaatttctaagcagcaaagcattcaagagatgacttggatactgttaaaggcattcagtttaaaaagggaaacagaacataaaagttcagaaaatttgcagcctgactatgcaatagaaaagaaaaacccattttctggggaaaaattcaagctggctgcagaaatttccataagtagtaaggagcctaatgctaattcccagaactatggggaaaatgtctccagggcatgtcagagaccttcatggcagcccctcccattacaggcctggaggcccaagaggaaaaagtggttttgcgggctgggccctgggtcccttggctgtgtgcatcctagggacctggtgccctgtgtcccagctgctccagctatggctgaaaggggccaatgtagagctcgggctgtggcttcagagggtggaagccccaagtcttggcatcttccttgtgatgttgagcctgcaacagaagtcaagaattgaggtttgggaacctctgcccagatttcagaggttgtatggaaacacctggatgcccaggcaaaagtttgctgcaggggcggggccctcatgaagaacctgtgcaatagcagtacggaagggaaatgtggggtcggagcccccatacagagttcctactggggcactgcctagtggagctgtgagaagagggctactgtcctccagaccccagaatggtagatccactgacagcttggaccatgttcctcgaagagccacagacattcaacgcctgcctgtgaaaacagctgggagagaggccataccctgaaaagccacaagggtggagttgcccaagaccatgagaacccacctcttgcctcagcgtgacctggacatgagacctggagtgaaaggagatcattttggagctttaaaatttgaccgccccactagattttggacttgcatgtgccctgtaactcctttgttttggccaatttctcccatttggaatggctgtgtttatccaatacctataccctcattgtatctaggaagtaactagcttgcttttgaatttacaggcttataggcagaagtgacttgccttgtctcaaatgagactttggactgtggactttttggttaatgctgaaattagttaagactttgggggactgttgggaaggcatgattggttttgaaatgtgaggacatgagatttggaggggccaggggtggagtgatatggtttggctctgtgtccccactcaaatctcatcttgaattgtactcctataattcccatgtgttgtgggagggacccggtgggagataatttgaatcatagggacagtttcccccatactgttctcgtgatagtgaataagtctcacgagatctgatggttttatcaggggtttccgcttttgcatccctctcactttctcttgtggccgtcatgtcggaagtgcctttcacctcctgccatgatactgaggcctccccagccacgtggaactctaagtccaattaaacctctttttcttcccagtctcgggtatgtagttatcagcagcatgaaaacggactggggtatgagctttccatgaactaaacacagtctacaatatgcatgtttatttaagcttggatttttaaacaaagcattatgaagaaaaagtctcaaaggaaatacaccaaaacaattaacagtggttattacaggttgaaaagattatgggtgattttattttcttctgtgctcatttatatgttctaaagtttctacaatgaagtgcatttttgttgtagtatgggagaaaatttttgtttctcactcctttgccaaaaaaaaaaaaaaacacaaaaggaagaagaaaagaaaatcctaaaaacaatagatttgcaacaacaagacaaagttaactactctgtgactgaattgctggaagatggggagcagaggtagcggggagggggagagaggcaggtgtcagagaataaatgccatggctgccagtttgattcgggccactgtgatatcctggcctaacagtgccctgacacacctggtgtgcctcaccctggtctttgccaagagaggtcacttccctttttgtttcttggtacagctattaatggtggattctcctggaatggccttcttggactttacctgtcagggggtccttactggagccttatttgtgaccaaatgatcttgtttttcagaccacagctgagaaatctcctggagcctatttccttcccgagtttgcactttctcctcagggaagttttctggaagacacaacaggggagcagttcctcacttatcgctatgatgaccaggtaagaacattggacaaggatctacctttggctttgctgtttgccagtggtcaggaaactgtctctaaaagaccttcaaagtaattatattttcctctttgcaatacaagtacaacagacccttgacacccttgaaggatcccagaatatgtggattgcccatgtttgcatgtaatttcctatataatgtgcagttctttctctgcatttgcataaaagtcactttttcttattttcatcagaaatatatgatggatttgttcatctcagctatcaccacattgatgattcaattctgaaattatccaaaattctgttttctgcttatgtgttacttctttgccctcagcttttacttcatttcttttaccagcaccaatgttgcatgcttttttccccaagattacttttcagaaaggaacacagtgtgaatgcctgtgtgtgcatatgtctgtgagtgtgtgtgtgtgtgtgtgtgtgtgtgtgtgtgttgaaatcattttaggaaggctaactagagaagaaggccttgcttggctgacatgtgtaagctgagcactggaagttgtgattcccttccatcctcaattcaccttgatgccataatagcatttaagattatccatctttgaaatcactcacaacttggtgaaacagagagtttcaactttgcctaatgcaaagctggtaaagcctgaatttatggggcagttgagcaaaccagggtggactttaagatgatgtagggcctgggtggatctggcagacctcagcacctgtagggcccaagtgaaggtgaggagctggggcaagatcaccttcccatggtacgtgatagagtggagggagatggcccagtgactgaggccagctgtgctctcctcagctgtatagccaaaggccagtgcatcctggtttgatttaggtaaagcctagtcagagtgcaaaagacagtactcaaaaggaacagctctgagaaattcagtctgccaacatgggtagatccaagatgtgaccacagggagtaggaccctgttctgagggctggctggagctaggcagagtgctggaggtgggctgggagaaggatgaaagtcttgcagagcatcagtggctgatgcaggacggagattagagcatagagggcaggtagaggagtctgttgctcagtcctctatctcccagctcaggggaagacactgcacactctccatccttgaggctgctgctcagtgacctacccttggtgggcttcattccagagctgggactggggtgaaggtcagggctgtgaccctccagaccgctgtgggcagggagccacactggtcattggggcaagagtgggatgagaccaatttcttactcaaaatgtcaacattcaatcatattttcaagttactttaaaagtgagtgagtgcattactagtcattgtggggagcaggggtgggctggggaataattctatatttgcattgtagagcccaaacatttgggcctggttgctaataggggctaaaacatcattaagtcactttctgccttcccccttcccttgatggattttgagagggtctataatttatagctccttttaatccagaaatcaataatccaacaggttttcatatgagaacttcagaggaactaattgagagggccgtaaaggataaaagcgggtgtctggaaaataccaagctatgcattttataattaaagagtggttaatgtcttctccaggttccacagatactttatatttaacataataacaatataaaagctgggaaaaggggaaaacaagccccttcagtcttttcaaaaggtctaaagcagatctgaaaagtgtgtggcatgctgtggaaatttcatcctaggacatagtgttccagaaagcctcagtgactagcatatgaaaacactctgtgttgcccccactgtgtatttcttttaggagaaaggaataatttgagactataacaagccaataatagcacccactttcctctactaaaggcacagaaaataggcgcttggactaaactaggtttatctattgaatgaacctcaggaatttaatcagctagagactgttaacccaccaaccaaatcctgattctctttcctcttttttcttttctttttttttgagattgggtcttgttctgtcacccaggctgaagtgcagtggcatgatcacagctcactgcagcctcaacctccccacccacacttaggtgatcctcctgcctcagcccccgccccccaccccaggtagctgggattataggcattaggcatgtaccaccacccctggataattttttttgtctgtattttgtagaaatgaggttttgctatgttgaccaggttggcctcaaactcctgggctcaagcgatctgctctcctcggcctcccaaagcgttgggattacaggtgtgagccactgcgcctggccaatcctcttttttcttaatgctgaacatgcttctcaggcactggggaaaggataaaaccaatcaaatactatcaaacttttaaaaaatcccctgatccttcagcatatgacaaaacattaagatcaattaagaacaaagtctctggagtcagactgctttgggtttgaatttgatttgtcagttctgccatttgatttgctgttttactttggacaagttactttacttccctgtcccttaattttctcatctatgaaatggagatttggatggtatctaccttatgtaggcgttaattcatgtctccctgcatagggcctggtacatataagcatttaatttagctattgttattactaagaatgttgtttgcaaacactcaattcaaagaatctcagatatgcttatgctaaaagaaaggaagaagttaattcttactttaggagatctcatgcaatattttcaattaattttttattgagctataacatatgtaagtaaaacgcatacatatctgaagtatagagcttgatgaatttttaagtatttttacacctgtgtagttgctacctagatcaagaaaatgaacatttctagcaccctaggaggctccttgaacctctttccgatcaatatcccacattcaagaagtaaccaccattcagacttttatcagtattacagattcattttgcctgcttttaattttatttttgattttatataaatggaatcatacaccacatactcgtttgtgtctggcttctttcacacatcattatgtctgagagattcaacccagttgctggatccaacataatatagggtttaatgtctagcagccagttgtactctttggaacaaattgtctcatgttggaacaaattgcagcatactgggtggcatgcagcattactcttgcacagaaattcccaggttgtccctaaaaggttttcagagcagtctctccaaagatttcatacctggggaaatggtggggacagttttccagtgtagcctttgttatatgccagcagccaccggcattccacagccagaagtaggtacagggtctgtgtgagtggctgccagggcagaacctgtgtcaggtggcatgggtacctacctgtggaatctccatatatatatgccaggggtgctgtcctgctgtcacagtggcttgaagccagagtgacaaagtacttatgcaattgaggctgcagcctagtttctaatgctgttgggtcagatgtgggttcactaggatcttcctacctatagagtactcatttgataaaatgggatgcaaatggatggtgtgtagatatttgctgtcttggatgaacctcacaggactttttaaagtgttttatcctgggcgcatttcatgaagaccttcaggtcattcttcaaatgtctcctgggttagatgcctggaaaactaataaccctgaggccagtaacacatagctgtgatgtaggctgcatttaatgggaggcgtaaaagccacattatggatcatacggagggccgcggcagcttctagtgaagaaagtggtctgaagccaactgagtaacaatgtggtttagtgcaaacaggactagtcaggcagcctggtcttgcttctaccactaatcagcttataatctaacagaactatttaacgttttggactttggattctttatttcttttaaaaaacaaagtgactggatttcatgatctgaactctttccactctaaaatagtctgaaactacaaatagaatattccacgttgcagagtgttaattggatcattctgattattgaggcagtcttgccagcaattcggtaaactattacttagagaattatacagttttacagctggtggagactttggcccaagtgcctcattctacaagtcaagaaaacagagacgccaaatgtgcaaatgacttactcaaggacacccgtggttatttgaaaaactaagaccattacactccaaacccaaggctctcctgctctgagatatatccaggagcttctctcagaagaaccacctagaaaattatctcctatcctaaaaatcctgattccactgtttacagttagtagagctttggggatcttaatagaccccagagattaagattaagattaatggatgccttatcagctcattctcatctccttcaggaatttggaattagctatgtggagaacattcataagcatatttattcctttccagtttttaatagaagccacaatttttttttgaagcttgagtgaaacattaactgaaattaaaatggcactgactttctattggatgggcacattcttagaataaaggtgttctagcacttggttgcatcaggtacatgaagtagctagaatgtattagtttgggacgactggctaagaaggctgtggtttcagttactagccagcctgtctctggggtagattctttggtcattcctcatagtggttttggagttttgtcccatagaggacctgttcataggcaaacagctggatattggtcactgcacatggttcttttcatcgctgagtaagtcagtttttggagatctgctctgtctttctctgcctagatcaccttctgggaaagggggatggtgtggttgttttccatccttaccttgcttcaactcactgaagatttaaacttggagctttattatggtcactgaaagcctgtgacaagcacagtgtttctcagttagaggtcatttattttttaaggagttaggaaaagttgttttttgcataaatattcttttatttctctttatttttagcatttgttaggcatgggggaaggtggaaggtgtgtcctcccagacttggtggatttgctgtaatgtgcttcctcctcactggcagccatcgtaggataaaggacattaagcacgagcagtaggtgacttagaaattgggcctcatgcacactttcctatgttttatgaattctttatgtgtgtacctgttaatattaatatagggtattaaaataatgctgaccttgccacttttagtctactaggcaccaaaaggcaggaaaaaaggttaataccttggattccaagcatgtaggacaagtagtgggttttgattttcctaaaattaaccaaggataatcccactaatgcaagctcgaagccatttagagaactaccttgatctcatgttggagaggtccttttatacctattcataccaggccatcccttctccctggtaaacttcctgctcctctgcccttgactaatttagcgtttgctgtgtctcttcctgaccacatttaagaggatttgagatttttttccagacttaaaaatgcttttgcctgtactctcatctaccattgctttcagtgaccacttggttttcaaattcttactgtctcttgctgctttctgctactcattctgctactcatttttaacctttaaaatctaacttcttctatgtcctccaacctccctccccccaccaccttcaacaggcatcctttttaagaatttcagttactttcttcaagtcacacctatattctggtatgaatcagcctatatttgtaaaagtctgtgttggtacaattccatgtttgtaaagtcctaaggccttaatgacatcataggtgaagtcatagttgactcttctctttccttcctgggatgtcattggctgcctatttgtatgattccttgtttcaatatgcctctctaaattgtattttctttactgtttccatcccaaaggaggcagagggctggatgtgcagccttggtagcatctggaattgtattaatagcatgtcagagttgaaagaaagtataggattctggcttttcaggtgaggaatctgagccccggagaggaacagtgtcttgtccaagatcacacagccaggcagtagcaaagccaagtgcccgttctttgcccttaagctcagttaagacatttttacatctaatctgtgggcaggaaaagtatgagagaaatgtttgaatgaatttttaatactaataataacaataatatattaataatgaagtctgtgtagtcttatttctaaacttcttttaaatgccttttttcttatactattatgataaacataattttccttttcctcgtttaactattgatttatgcattctttctaaagaggagaaatctatttgctgtgagtacatctctctcaaagtaacttcttccgaacttttcatgaatatcttggccaggagtttcaatgtggttaaactattggcagccctcagaaatatcacttgacgtttccaagttatttatgtaatcgtttttagttggaaagtatataccaacttctgaaatttctggtgaaagaagacggacatagcccatgggtctactgggtattttcatcttcttcactgaccaaaatgagcaacttatatgttctccacataggagagtttctgtgttgtttctggcctgtgtgtataatatttttaagcagcaagccatttgagtttgaatagttcattcctttgttagtaagtaatctcggtcaaatgtagttatgctgcttaaatattccaagatttagcgatctaacaagaaagcaagctcatggtctgttaagagaagacaagaacaaattagttggaataacttgtactgtgttcacagttcatgcgtgtagcaaatgcatgaatactgcacatgcaactgtacatgctgttctgattgactgtgtcacacatgaactctgaatttcattatcattgagctttttcacaaatcatgaaagcataaaagaattgtgtgggtagagatttaatatctagcttttgaaggatgcagacattttcctctttcagtgtcatcttcctaaactcatatttggggtactgggtgatttttatcacttacaccctatgggttaaggggtgggtatagggtggggatgttcaagacagacccaaatggatctttccttaaaagtccctcactacccttaagaacactgagagataagttctgttctgacagggcccttgctgcttaccgtcagatcatcctttctctttgagatcagatcagtccctactcacatatcctcacagccttcaagtgctttgagatgaggttgttttgagcaactcagttctgtcacaatccctggatgaaagaaagcaagtagactttcctctccaccatctcctctcttcagtggccttttatgacttgcttttctgttcttcctcctgttttatcctttgtttattgatttccccttcccagtgctttccatcgtcccctcatggtcaacaggaccccatgtcctgaattccaactttctgctgcaactgaaaactggccttggccaggctcactgcctctcttgcaggcctcaccagtggaggctgctcatacctcacaacccaagtgctacacggctaaggtggggggttgaccttcttggagtccctactgctacttcctggctagtcctcttctctcatctcagtgctcctcttttttggaggctcatgtcatctgtctaaaccactgatcagagcattcaccaaaacctttatgacctgatcatgacttccttccttccaaggtcatgccatgatccggggagtgttcaagaattaacacttggagcaatttctgttgagcctcctgtccctggggtcagcagtgatagctcagggcagtgactgatggcccttaaaattgcctgttccaagaaaccatttcaattgcatttgtcattctgcaagcttcagtctaaccctgtcatttctgcatctctctggctccagtgaccttcacagaccttccacttcagtcacccattccaagtgtccaaactggaccatatcattcttcaaactactctgccttagaagtattaaatcctgcagcctctctctaatctcagacccttctccttcacctcctcctatgcatgcttctactacatgcattccttttaatctctaagagacaactaattctcttatctctctacttctcccaggtgatcagccacctttcagcatctctaggtttcctacccacgtggcctcttctatcagtgtcatccctcaccttctatgcatgattttcctggcccactagcctagtggaactttctatcaggttctctacaacttggtgtctttctctgtcttagatggccttctgagctctgctaaagaagatcgatcagccatgaaatacagcctcatgtagtgggggaaccctcaatgtcacctttgatcatctctaattctttattttgaccgcattcatcaacccccttctactaaacatctctgcgactgaatgtgtgtttttcttaaacgagtgccagatttctgttctgttgtggcctgtcctcctcaggcatagtgaagggagtagattttattagtgtttgtgatcttgagaaaatgcaggaaactggacttgcaggtttgctataagaatggggagtaatggcaggtggaggactggatgggaacatcttttttttttctcttattacagcataaaacaaatgcatgaataatgcacatgcaactgtacatgctgttctgattgactatgtcacatatgaactctgaatttcaaaacaaaggtaagttaatttgctggccagcaaagaagggccatgccaggcaagaaaagacttcgccgattctctgcaagctgaattttgaaggaccagatgtagaagcagtaatggaatttattccctatcacaagggatttgaggcattatgttttgattggcttattcagaaatgtttccttttgtttggccaattctagcctacgtcaaaaaagtgtaggcacagtttgcaaagagattcctggtgggtaaaggctccatggggcttgagtctctcagtggacacctttgcctgctcatgcttggagttttaacactctggagtgtatttcttggttctggactttggggagctgagacgtgttgagggctcttccagatggttgggaaaatggcactgacatatggatacctgaggccaggcagataaatatcttgaaagtatctgttgtgttattctctgtgtttagttacctttggtagtactcttaatctgctttttgtgtaaacctttttagggtggccaactgtcctggctttcctggcactgagacagtcccaatttccaccctatcttctagcttggactttaatgtccactcttgggctggagttcttcaatgaaactggtagcctgagatcaggatcctgctagctgttgtgcttggtgggacatcccaagggcaagtgggggcacaggtgtgtagctgttagggatgcccactggaacactgtctgcattgctgtccagcacatttctaggccaggtgttattgatgaagcttgtatgtttcctttcccttcaagtagctcttcaactgcagcctttgcataaattgtcctgtttgcttggaacatcccctctgctttgtacacactgttcctccccctgccatcctcgtctaacccttgtatatccttcagctcagttgttacttcctcaaagaagtaaggccaccttcacttacacgcgcaggtgagattaggtccacctgcttgcttcctaggcctcctgctttcctttctttctctctctcccttcctccctccctccctccctcccttcctcccttccttccttccctccttccctctttctttctttttctctccttctccttttccttccttcccttttctctttctttctttctttctttctttttctttctctctctttctttcttctttctttctttccttctctctctctttctttctctctctttccctccctccctccctccctccctcccttccttccttccttccttccttccttccttccttccttccttccttccttccttccttccatccttctttcctttctcatcttggaattttttttcttatagcattttgacctcctgacccactgtaaccttcatgggttgtagtgggagggagtgaggagggaagagaaggtgggtgtggtcaaacagtgcactcagtttggatttctcatgctagtctgggtgacttacttatccaaacaacaaaccctgtggggatgctgcatcatgaactgtttcaagaaaacacaatgcaggatgtgaggcttggagcaatttctgctgagcctcatgtccctggggtcagcagtgatagctcaggacagtgactgatggcccttaatattgcctcttccaggaaaccatttcaattacattcatcattctgcacatgcacacatgcatgattattttggacaggtttctgtttctaaaagttaataatacatggctacatacatgaatacatttggattatgtggaaattaacatatataacatacacctcccttcccagagctggattgaactgattgggtactttctccaagtcttctctcatcccctttgagattctcttattaagtccttctcctctgcacccagcactgcacatttcctcctttgtcttttccaccaggctttgagcccctaggggcagggactatgtcttctcatcactatagctccagattgtactctgcagcctggcacacagtaaatgcacaacgagcatatatttgttgaagattataccccttgtcaaaaaccttacatgggtccttgtttcctcctctgaaataggccaactgctgaccggtattaaagcccctgcacagcttggccccaggttacctgtcttcccttatcccccatttctctctgtgtgccctgtgctctggccagactggactccatgcctttcctgttctgatattttcctgtgccaagggtgtgcaaagctctttattgaatgtctgtgttttctgcgatgtccagcttagtgccatctcttccaggtagttttcagtgaagtcctcagcctaacagcgtttcttcctgctctttgaaatagtcactcatgtttgcttatggccctaaggattcatctgggtttgtaattattgacatggatgtcttatcctgttggagtcagaacaatctagagtgagtctgcatgacttttctgcaattcccatggacatggaatagctagatctacttccaggagtgacaagacttgaagaaattctaattaaatttttatttctgagtttgctttaagaaataaaataaattcttaggccgggcacggtagctcatgccagtaatctcagcactttgggaggccaaggtgggaggttcacctgaggtcaggagtttgagaccagcctggccaacatagtgaaaccctgtctctactaaaaacacacacacacacacacacaaattagctaggcatggcggcaggcgcctgtaatcgcagctactcaggaggttgaggtagaattgcttgaacatgggaggcggaggtttgcagtgagccgagagcgtgccattgcattccagcctgggcaacaagagcaaaactccgtctcaaaaaaaaaaaaaaaggaaaagaaagaaagaaaataaattcttaaaaaagttaattattctttgtgataataaagagcctatctttatttctttgtgtgtgtgtgtgtgttgtgtgtgtgtgtgtttgtaattatttctatttttcactcttttcctacaactatgaggaagtaatagtctcttttccaaatactgttagtccaaaggcttgtttgtagaatcagactgttctttgttttggaccctggctgcttgcttccaattctcaacgctttccacgtggcagaccaccaacaaggaatagtattcctagtccatttggatgaatccttctcttaatcccttccctctgggatttaatgctaacagggtttttaaaatttacatttcaaaatgattgagtaaatttttctttataattgggaaaaggcaagatttttaactaagaattttgcttttgcgttaggtttacactgcattaagacatatatttatcaaatagagctatgatatattgtaaatatacattaaataaagctatgctctatttaaaaacctaattctgaacacatggttctcatgaaaaattataataccttgagtggagactgacatctgagctgataatagcagtagtttaaaggagtagtcattcattccatcaatccctcaacaaatgttgattgaatctctgtaatgtggcatcatgctgggtgtatgatactgtgatgtgagatagaattgtatccaaagtaattcctgcaatttcaatcttgaaactagagaagaggagctttttctttttgaaggctaagattacagttgccctttattaagcaacctgcatgtataagaactgtatgagatatgccctgtgccttataattacagtttactcttctgctcctctgtgtttgcttcagcagcacatatattaaaatgaacaatacagagaagattagcatggcctctgtacaaggatgatatgaaatttgtgatgagttttaaaaaagaccagttagttgtaagggaagggagaaaagaaggtgcgggagaagcgacagaagctaagcttctctgtatatacctatcttacacatttggctttgggatcatgcaaatattttatatatttgtaaagtaaaattagattttaaaagaacaatccctaagaataaaaaataaaataataaaagcaaaaaaacctatgattcccattggtggtggtaaccacatagagaagaattattctaattgactttaatacacatgaatttcactgaaggtcagtatatccaaggataaaagaactaaaaatgagatttaaaactttttgcagtgacgttattgttgatggtagcattggacttgctgttatgagactgctgtgtgggtgatgtgagacaaagcaaatgaacaatacaaatgtgatcatttggttttttattctggtaatcttgaaaatccgtattcttgatatgggaaaaaggagacagggaaaaaagatagaagaaattaagtgaaaactctatagtcctagaattgaattgtaagtatctgtaaaaactcctgaggtcttttatcttaaacaaaaccaaaccaggacatattttgcagatcccttcactgaaaaggcataataacaatgagcaaatggccaacttaatagcagtgatctagtgcccaggtcatggtctctcaacaccatatcccatttaaaaggaaccaggattccatggcaaaattacttattctgggtctggaggtaaaacaatgcaaaattagcctggaacattatgtaattaacaggtagcaaggaagctgtcaagactactagagtctcatcagaaggactcaggaatcagcttgtcaacacttttataagcagaaattgggacaatttgaagccaggcgcagtggctcacacctgcaatcccagaattttgagatgctgaggcgggcagatcacttgaggtcaggagtttgagaccagcctggccaaaatggtgaaacctcattcctactaaaaatacaaaaattagccaggcgtggtggtgcatggctatataatcccagctacacaagaactgcttgaacccgggaggcagaggttgccgcgagctgagatcctgccactgcattctagcctgggtgacagagtgagactccgtctcaaaaaaaaaaaaaaaaaattgggacaaaatttgagcatcaataaaagcaaaaattgcaaaggacttaagcatgtcaactatgtttatatcactaagttaataataatactaaaatgcattagtcactgttggcgggtgctcaggaatcaactcattacattgaaaacaaatagaaggaaaaaacccaaatattcattctgccttttctatatgaacaatatcactggataaccaaacagtagatgaggaaaatttgtctttacagaaatatttcagtcaataaataaggaagggatgatagaatgagaatgtcatcattttgcaactctaatgaactgatatatgcattgaatatcaaagccaataaagtcgcaaaaagggagacagccaaacagtgtacatctcttgatggaagaacccagtactacccatgtaggattcttgccttctatggtgcttctcgacctcccgaaaattgaggctgcagatctaactacctatttatgagaattacagtgtacaaggaaacacattaaactaaatcatgggtttgcaaccaccaaaatccagacagtgggaaactttacaggacaaacaattcaatttcttcaacaaataaattgcaaaagaaaaagaaaactagatacagaaccaaaaagattaagtgagacttaaaagatgtatccaccaactgcaatgcatggcccttatttggatctttatgtaaatgaacaaataaacagacaaaaaacctacgacaacactctttatgacatttataagaaaattggaaaattactattttgttgtcaactcctaatttctgaggcatgaaaatggtattgtgaatatgctaaaaagtatattttatgaatacacataaaaatatttactgattaaatgatgttttgtatagtgggagtgggtgagtagtagaataagcttggacttgggttgctgattgtggggctgggctatgggtacttggggttcattagacttttctgtctacctttatgtatgtttgaaatcttgcatagtaaaaggtaaaagataaaagtaacaacaacaaaacagcatcaacaaaacaaaaatgaaactcaactttgctgtgaattggatagtgtcattccatattattaataaggaagttgtggcttggaggagttaacagcctcaccaggacacaatcagtcaatggcaaagccaatttcatacctaggtctttttcaagagaaaaaatatttggcctggtgaggtggctcatacctgtaatcccagtactttgggaggccgaggtgggcagatcacttgaggctaggagcttgagaccagactgaccaacatggcaaaaccccatctctactaaaaatacaaaaattgctgggcgtggtggcttatgcctgtaatcccagctactcaggaggcttaggcaggagaatcacttgagtctgggaggcagaggttgcagtgagcagaaatcataccactgcactccagcctgggtgtcagagagagactctgtctcattttaaaaaataaataaataaagagagaaaacatgttcacttttttgccatactacattgcatacctaaaatcaaataatgcaacttcaaaaatatcaaattcactagaaaaaattaattagcagaaaagcattttacaattaaacatttcttccatagatatttcttaaatgtttggtccctgacctcattgccacattaaaataagatatataatcatattcaattaagttcaaacttatgtgtgcagtaatttaaagtttaatttatgagtattccatgaggctttgtaaaagcatccccgtgatacttcacacattctgacaccagaacatgtttgagaaatattgatttagcggttggtgacaaaaggtttttagaattttcagcacacacaaaggttagaatgtgtcagtgggcattacactctgaatagccatgttaagtactaaactattttaatgacagtaagtatgccctgctgttggcagtgaaactgtgttaccattagcatattttacaagttgagtctattttgtgttctaacttgaagcagctttatttcctgccccattacaggatagtacttttataatataaaataaatgtccccaattcaactcattttaagacatggatttataatgccatgaacttggggcaaacctttaaaatgttttaaagcatattttttcttagttttaaaccttgaattattccactcatggtttttatgttaaaaaatatttcattaaacttgccaaattttattgtaaaatacttgaataagaagtctaaaaaataaatgcacaagacattttgttcttccccaggttcagatgatgagtatgggaaatcttttttctgtccagcttagttagcaattttttatgtttttattttttgttatattttatttagaagcagcatatgtactttttaagttagcaaaattggccctacctggaattggaacagtttggcagaactataggaagttaccctgaagttccattttctctgccagatgtgattttgccatgacttgatatctgtctgttaggcctaactcttgccacatggcacaggaaaccttattttaaacaaccagagttcatcagcaatcttattaaatatctggcatgtcttatcattcatgagcattgattagtgttggacctcacagtcacattgtcccatctgcacacagggagaactctgacgcttcagactcagaagcctcttagtaaaggatttgggtgaacaaagtatctttcctggagggtctctgagagccccttgtttaactcctactcagttataatccagttctacatagattaacatctttaaggaagtataagcagtatatcacggagcctagtacatgttccgtagtttgagagaaggggacctccaattctctaaacactcttagatgttgccttcttctgaagtagatttacaacaagaaacctaggaaacacaagacactagcatatttatgtgttttgtttgtttgtttgtttttgggatggagtcttgccctgttgcccaagctggagtgcagtggctcgatcttggctcactgcaacctctgcctcctgggttcaagcgattctcctacttcagcctcctgagtagctgggactacaggtgtgcaccaccatgcccagctaatttttttatttttagtagagatggggtttcaccatgttggccaggctggtctcgaactcctgacctcatgatccgtctgccttggcctctcaaagtgctgggattacaggcatgagccactgcacctggccacagatttatgtttttaagaggacattgcctttatgaaactgccttaaactcatgaggcaggacagactgagatgagcaaagatgaaaacagatgaaaggcatagtttccaaatgaaatcaagaggcgggagatgctggattcagcagagaatcagattagtgaaaacaaattcagaaaagttcagttacaggggataaggacagggaaataaaatcaacgaggagactgtagctatgttggacagatctcagacatccaatgtaagtactcacaaaagagagaagacatcaaacggaagagaggaaattcagtcagtgctataagacagctttgatttactaaaagcttttgtgaaaaaaattcaaagctgtcattaaatatgtgtcagttgtaagatgtattgcattttgatttcaaaaaatggaaaaagataggaaggagcaagttagaatttaggaaatgtagaaacagaaaaaattatgatacagaaattgttataggccttatcctctgagcctaagtaattcaaataaacattaagtgaagaggtttgaatcaaaacctataaacattacaaattttaaaacactcttctgaagaaattattcatgcaagaggaaatgaaaaatataattacacattatgtagaagataacaaaaacaagagtattcgtttcagaaattatcatgtaactacagtctatactgagaggacctcacattctttcaaaaatgtaaacatttaatatattcagtaagtgatattggaacagttggttaatttagaaaaagttaatttaaattgttaacatatgtaatagtaaattccagatggattgaagagttaaataaaaaatttaaccataaaaacataaaaataccatgaaagtaaatacttccaaatttctgatggagaagcttcaaatgaatggaaagtaaaatgtattgatggatttaactacatagaagccttaaaatgaatacttgtcgaaaaacattcaaatgagaagttaaagtaagataacatgtaatacaaattttgtaaaataccatgtaaaagacttttcaaatggacaaaaaagagatagtagatgaataggtaaaggaaaatactttacagttgtaatagaaaagcaagtgactggttaataatcatatggaaagattcaactttatttctaatcaataaaatataaacccaagcaatgactaaaaagcactcccccacctccagcaattactttcaaaaaaagaagtttgcaaacccagtgctagtgatggtgatgggcagagatcaagtttatattgtgctgttgaatactgctaagtgcagtgcttttgataagcagttttgcaacatgtattaagaacctcagaaatatctttagtttttgactcagcaaatgttgtttcagggaatttcctgagggaatagtctaagtaaaaagaatgcttcctgcaaaaatacattgatattattatttataatacttgacaaccagaaacaatctaaatgttaaaccgtaggggaatggccaagtaaattatgggatttctgagatggaatattactaatttttattatgcttatacttttgaaataacaggaaatgctaacatgatatccttaagttaaaagatcaggtcacagaatcacataggaaatctataattttatttatatgtgaacagaaagagaaacctcatgaaaaagcaaaaataacagtggttatcactgggttgtggaattaagagtgttttaaattttcttttaaatgtattctccaggcttactacaaatgagcatataatactttgatcattaaaatatgattaaaatattccttctaaatactgatgaagaagcacttgggaagggattaacagtagttaattaacaattaagatattttgaaggttggtggcaattttaatacaaagaaaggattgggggaatggacatccaaggctcaatacttgtttaatagtgtccacttttttctactcctggttctgatttcccttcttgtttttttttaatttttaaattttatttattcatttatttttattttattttttattttttgagacagagtctctgttgccaggctggagtgcagtgatgcaatctcggctcactgcaatctctgcctcttgggttcaagtgattctcccgtctcagcctcccgagtagctgggattacaggcacacaccaccacacacagctaatttttgtatttttagtagagacacgggtttcaccatgttgcccaggatggtctcgatctcctgacctcttgatctgcctgcctcagccttccaaagtgctggggttacaggtgtgagccaccgcacctggcctattcatttatttttaacatttgtgggtacctagtaagtgtatatatttatggggtatgtgagatattttgaatcaggcatgcaatacacaataatcacatcagggtaaatggggtatccgtcacctcaggcatttatcctttctttgtgttcagtcaaattatactctcagttattttaaaatctatagtaaattattgttgactgtagtcaccctgttgtgctaccagatactagatcttattcattttatctaactatatttttgtacccattagccatccccacttcccccaccgccactatccttcctagccactggtgaccaccattctactgtgtatccccatgagttcaaatgttttaattttttttagcttccacaaataactgagaacatgtgaagtttgtctttctgtacctggtttatttcacttagcataaagacctccagtttcatccatgtcattgcaaatgacagaatctctttctttttttatggctgaagagtactccattgtgtatatgcatcacattttttttttatccattcatctgttcatggacccttatgttgcttccaattcttagcaattgtgaatagtgctgcaaaaaacatgggagggcagatatctcttcgatatactgatttcctttcttttgggtatatacctaggagtgggattgctggaacatgatagttctatttttagttttttgaggaacctccatactgttctccatagtggttgtgctaatttacattcccaccaacagtgtatgagggttcctctttctccacattcttgccatcattcattattgcttgtcatttggataaaagtcattttaactggagtgagatgatatctcattgtagttttgatttacatttctctgaagatcaataatgctgagtactttttcatatgcctgtttggactcaagtgatcctctcatctcagcctcttgagtaggtgggaccacaggctttttaacttgatgtgatcccacttgtcttcttttgctttggttgcctgcacttgtcgggtattactcaagaaatctttgcccagtccaatgtcctggagaatttccccagtgttttcttttagtagtttcacagtttgaggtcttagacttaagaatttaatccattttgatttgatttttgtgtatggcaagagatgggtatctagttttattcttctgcatatggacatccaatattcccagcatcatttgttgaagagactctcctttccccagtgtacgttcttggcacctttgttgaaaatgagttcactgtagaagtatgcatttatatctgggttctctattcctttggtctatatgtctgttttttatggcagtaccatgatgttttggttactacagctctgtagtataatttgaagtcaggtaatgtgattcctccagttttcttatttttggtcaggatagctttggctattctgggtcttttgtggttccacagaaattttagtattattttttctctttctgtgaagaatgtcattgatattttgatatggattgcatttaatctgtagatgacttttggtattatggacattttaacgatattgattcttccaacccatgaatatggaatatcttttcctttttttggtgtgtcctcttcaatttcttgcatcaacgtttcgtcgttttcattgtagaaatctttcatttctttggttaagtttatttctaggtattttattttatttgtaggtattgtgaatgggaccgctttcttgatttctttttcagatagtttgctattggcatatggaaatgctactgatttttgtatgctgactttgtgtcctgcaactttactggatttgtcagttctaatagtttttttgtgtgttatctttagttttttccaaatataagatcatatcatctgaaaacatggataattttacttcttcctttccaatttggatgccgtttatttatttctctgtctgattgctctagctagtaattccagtactacgttgaatgacagtggtgaaactgagcatccttgtcttgttgctgatcttagaggaaaggcttgcaattttcccttatgcagtatgataccagctctgggtctgttatatatggctttcattatgttgatgtatgttccttctatatctagttttttagttttatttttatcatgaaggaatgttgaattttattaaatgcttttccagcatcaattgaaatcatcatatggtttttgtccttcattctgttgatatgatgtgtcacattgatttgcatatgttaaaccatccttgcatccctggaataaatcctactaggtcatgatgaataatctttctaatttattgttgatttcagtttgctagtattttgttgaggatttttgcatcagtgttaatcaggggtattggcctgtagttttcttttttcttttttttttgtgtctttggttttagtatcagggtaatactggcctcagagaatgagtctggaagtattctctcctcgatttttgagaatagtttgagtagggttagtattagttcttgtttaaatgtttggtagaattcagtagtgaagccattgggtcttgggcttttccttgttaggagccttttaattatggcttcaatcacattacttgttattggtctgttcaggtcttgaatttcttcctggttcaatcttggtaggttgtatgtgtctaggaatttatccatttttttttctagatttttcaatgtattggcatatagttgctcgtaataaccactaattatccttcagatttctttggtgtctcttataatgtctcctttttcatctctgatttcatttgagtcttttcttttttcttcttagtctggctaagggtttgttgattttgtttatcttttcaaaaatcaactttttgtttcattgattttttttgtattttttgtgttaatttcatttatttgtgctctgatgtttattattccatttcttctgctaattttggattttgttttctgttgtttttctagttctttaagatgcatcattaggttgtttatttacaacttttccagtttttgttttggtgtttattgctataaatttcttagtactacttttgctgtattacatcagttttggtatgttgtgtttccattttcatttttaatttccttcttaatttcttcattgacccactggtcattcagaagcatattgtttaatttccatgtgtttgcatagtttccaaaattcctcttgttattgatttctagttccattccattgtggtcagagaagatacttgatatgatttcaatttaaatttttttttaaagacctgtttttggcctaacatgtggtctatccttgagaacgagccatgtgttgaggagaagaaagtgtattctgcaaccattggatgaaatgttctgtaaatatctattaggttcatttggtctatagtgcagattaagtccagtgtttctttgcttattttcttgtggatgatctatccagtgctggaagtggggtgctgaagtctccagctattattgttattggaatctatgtctgtctttagctgtaatactatttgttttatttatctgtgtgatccagtgttgggtgcatacatatttataattgttatatcctcttggtgttttgacctctttatcattatataatgactttgtctcttttttctaggttttgtcttgaaatatattttgtttacgtacagctacccctgctctttcttggtttccattgacatggaatatcttttttcatccctttttttcagtctatgtgtgtctttataggcgaagtgtgtttttgtaggcaacacatcattgagtcttttttttttattcatttagccactctatgtcttttgattggagagtttagtccatttacattcaatgttattatttgtaagtatggacttttgccattttgttatttgttttctggtcttctcctcgttccccccgcccccttcctattttctttttagtgagggtgattttctctggtggtataatttcttgtttttaatttttatatatctgttgtatgctttttgatttgaggttaccatgaggcttacaaatactatctggtaacccattattttaaactgatgacaacttaacactgattgcataaacaaactgacaagcaaagagaaaaccaacataaattctgcacttaaactacatcctcctgcttttaaactttttgtttctatttacatcttattatactgtctatgtcctgaaaagttgtagttattatttttgataggttcatcttttaatctttctactcaagatttgagtagtttatgtgccacaattacagtgtcataatattctgtgtttttctgtgtagctactattactggtgagttttgtaccttcagatgatttcttatttctcattaaagtctttttctttccagttaaagaatgccctttagcgtttcttgcagagcaagtctggtgttgatgaaatctctcagtttttgtttgtctgggaaagtccttatttctccttcatgtttaaagggtgtttttgctggatatactattctaggataaagggtttttcttctctttcagcagtttacatatgtgatgttactctctcctggcctgtaaattttccactgaggaggctgctgccagatatattggggctccattgtatgctgtttctttctcttgctgcctttaggatcctttctttattcttaacccttgggagtttgattattaaatactttgtggtagtcttctttgggttaaatctgcttggtgttctataagcttcttgtacttgaatattggtattttttctgtaggtttgggaaattctctgttattatccttttgagtaaaattcctaccctaatctttctctctaccttctctttaacaccaataactcttagatgtcccctgttgaggctattttttgatcccataggcatatgtcgttattttttattttttttctttgtcttctctgtgtattttcaaatagcctgtcttcaagctcactaattctttcctctgcttgatcatttctgctgttaagggattctgatgcattcttctatttgtcaattgcatttttcagctccagaacttctgcttgattattttaaaatatgtcaatctctttgttagttttatctgatagaattctgaattccttctctgtattattttggatttcattgagcttctcaaaacagctattttgaattctctgtttgaaaggtcacatatctctgtcactccagaattggtcactggtgccttatatactttgtttggtaaggtcctgttttcctggatgggcttgatgcttgtggatgtttgtcagtatctgggcattgaagagttggatatttattgtcgtcttctcagtttgggcttgtttgtacccatccttattgggaaggctttctaagtatttgatgggacttgggtattgtgatctaagtctttggtcactgcagccatacttgctttaatgggcaccccaagcccaataaccctgtggctctagcagacttgtagaagtactaccttggcaaaatccactgggtataaaaaccatacctctatggatctcagtttgaaaaagaccactcagcgtgatgattcagggacagaagtgtcagagaacaggcaacgaagtggagttctatgtgagctgaagggcctatttttatctttaagagatggataacatctaaaaactgaaattaaaaacctgatgcttaagaagaaacatggaacattatagaaggcactggatcactcaagaatattgattgcccagagaaggtgctagtggatgaggccaggggcactgacttcctacggcacaccaaaccaatggattttacaggtggaggaactacaggaataaactctgcaagtctgaatctgaaacaaaattccaaacctgggatggtgaaccagtaagggctaaagctagaggatcctcctcggagtggtgctcaggttgctctccatggaaagaggtaaaaaacggaggtcagatgctggaatggagaatagtgtaaaagaagccaagcacagtttcataccaaagcaaaaccagcctcaagaacccaaaaagtataatggttaggagcatttagaatcataatttttttttttgcttttcagttgtgtgaatttcttatatattttggatattaatcctttctcagatatatggtttgcaaatattttgtcctaatatgtaggtttccttttcattctgttgattgttttctttgccatgcagaagctttttagtttaatgcagtctcacttattttcacttttgttgcctgaggttttggtgtcatatttgaaaaattcttgccaaggctaatatcaaaaagctttcccatctgttttcttctaagagttttatggtggttttaggtcttacatttaagtcttcaaggcattttgagttgatttttgggtatggtgtaagataagggttcaatttcattctttcaaatatggcttttcagttttccaaacactatttattgaagagactatccttttcccattgtatattcttggccccttgttgaaaattagttgaccatatatgtgtgggtttatttatggactcactctttggtttcattggtttatgtgtttgtttttatgccggtaccatactgttttgattactgtatgtttgtaatacaatttgaaatcgggaagtatagtaggaagtgtgatgcttccaactaactggattaaaaaatgggcaaatggcatttctcaaaagaagacatacaagtggccaacaggtatataaaaaggtgctcagaatcactaatcatcaggaaaatgcaaataaaaaccacaatgacaaaacatctcatatctattaggatgtctgttatcaaatagacaagagataataagtgttggtgagagtgtgaagaaaaggaactcttatatgctgttggtgggaatgtaaattagtgcagctattttagaaaacagtatggaggttcttcaaaagtttaaaaatagaattaccatataatctagcactcatgattctaggtatgtatccaaaggaaataaaatcattgtcttgaagagatatctgcactcccgtgttcattgcagtgttatactcaatagccaagatatggcaataacttaagtgtccattgatagatgaatggataaagaaaatgtgatgtacatacatatatataactatattattctttatgaattattatgaatattattgagccttaaaaaagaaggaaatcttgccttttgcaacaacatgaatggacctggagaacattatgctaagtggaataagccagacacagaaataaaaatactgcatgatctcacttatacgtgaaatctaaagattatatagcaacagagagtagaactatggttaccagggcctggaatggagaggagatgttggttaaagggtacaagttgcagttatgtaggataagtgactatagttaataatgctgtattatatactggaaatttgctatgagagtaaatttcaccacacatacacaaaagtaaccatgtgaggagatggatatgttaatttgcttgactatagtaatcatttcactatgtatatgtatatcaaaacatgttgtacctcttacatatgtacagcttttactaaaagagaatcacaacaaacccattgctttgatagtaattggtgttcccaaaaatgattctgagtactcagaaggggttaaattattttctaggtaccttatttccagactgtaatgtgtgttttccatttaaaaagttaagctaaaaataatacactaaagggcatcctttattacctagaaaataactaagtgtcctaattctgtcagataagtgagtcaacactgtatatttatctgcctaacagatgcttcctttgtcagttcaaaacatacacgagtaaaagtgggatttaaaggaacagcttggaatgaatggtattccttaaaattttgattttcccagaaaattcaattctggtcaaataatgatgggcaataatatataccagggctattgctttgacatttattaatgaatttggattacaagaaatactctagaaatctattagaaactatataaacaatattcagctccgtcttaactagttgattacattccataaaaccattatttttattctgttaacatttcatggaaatggaatttattgaatttgcctcatttgtgctagattatctttctacctcatacacagagttgaattttcatcagaaagtcacacatacctgtttatcttttttttgtgttaaaggggtatgtttctttagaaaccaccagcttaggatatggtgtcattccgaatgtgattcctgtcagactacagtgagcacaggtaatggatattgtcataaatgacatttggttcattagaatctgtcaaaatgggctgggtaaattatggctgttggaaagagcacaatactgcattgtattggggaaacacacttgtaaggaattcctgagctggtatttattacaacctgccacatcatttccattttctgcgtttcattaaatttaccgtctgggtgtaatcacaagagtgaaatggaaaatgtaatgtaaaatatctccttaaaccctccgaaacaaaaatgaactgaatcatccattcaatcaagacaagttgaacacctactatacaccaaccctctgcaataaagtgaggaacaagacagtttctgttttcaactaggccagagcccagcaggggaaatgaatggacaaaactaatcctaatgtgatactatcgtagaggtgttgacagagactatagaagtggagaggaaggttctcttcctgggggtgagagacttagtcatgggtgtctacaaattaggtactgaccctgttgggtagagactgtgagtcacagcttctcaatgtgattggaattctggggctggtgctaggttcattgtcctttggcatttttgtgggctgtgtgcattacatgggtggaatttaatgtcattttaactcaccagagaaagtttgtgggtctagaggtttggaaaacaactcgctctgtaatatgctgcattttagtgcaaatctttcaaatgatcgcaccgtacttgctaatctttgaaggaagctctctcattgtctgaagaaaatggtgctgattaaatttacagggaaatgactttatttaaaaatctcctctagtttgttgacagcactcatgtttcataaaataggggacatgatcctgaatttcttatgaataaaaaattattaattttgacatctactttgaatgacttagataatttatttggcgtagtgcccagtaaaagcatggaagtgacttggacatcaaccacaaaatggcccagggaccccttcccactggatagacatctggagtggcgtataaggaatagacaatgcaggcggacatttaattaaagattggtattcagacaggagggaagcgtggtgagtctctcagcgtaaaaggaatagtgagtctctgagacaaaagtaattttttgtgttttataatgatgctttgcagcttgaaacattttagctataaaatatagactatgaactcataatggcattaagtccagatagtaatttttatggtaacaatttatgatgtatttttgtgggttttttaaaggggaaaagtctttagcatttaacattttgcaatttaaaagatccctctcttgagccttcagaaccagagtgaacacaaaaattgtaagattttattgagttacctattatgtgaatctggatttgtagacattattttgatagttaatgacactggcaagaatcatgatctaaaacaaaaccatgttaacttttttgttttaaattttcatccacgagttgtcactgtgttgctattggcgttaccaggacacagctaggaaagccagggttggaagtgcaggttccctgtgtttgcagatgttcatgtaggagttccttgaccaaatagctgtagctattcagcatcccagcacttgtgtgcctgctttgtgatgagctgccctgctgactcacacctgccggttcaggtatgggtgtagccatttctgggagggttgatgctcagcaaatagtcttaaaggcacaaaggaatgagaacatttctctccaaaccataaaccatcgtggagcctaaggagactgaatttcctttttagaccccagaggacattatgcccagattgcccccaggggtcactctcaacttggggatgatttttgccgatggtggaagcatatattctctggattctcctctgctagtggggagggctagtggggagggctggggttctcatgtttgatatggcatcttgagatggtcatccagcctctctttgaacaccgacagaaagtagggaacccgaacctccaatactagttttcagatatgattatactattgtctgagcaccacctgtagttataatagttcatctaatggatagtaaaactctatcaggcagcctcactatgcaaatcttgtagaataagagtattttttaaaattaaatcaactattaaacaaagcagtctatcagaagaaagaaaatttaaccagaaataaaataaaccagaagtaggtgacaaagagaagaataaaggtatctgataaagccaggaataagactaaaataaaaatacacaccatagagctctccatacttactacaggggcacagatttgatctgagctttctagcagccaactgggagagagaaacacaatcagttgcagaagtcacagattcataagataataaactaacagtgtttctcaggagtaacacaactgttccttattttaacaaggaaaaagttactgatttcagtaagaaagtagccttagcccacaaagatgaggaacttgactttgaaaggaaatatttcaatgttgggtctctttaatcttctttccagattcatagcctgaataattattttccagaagcttctcccatgaagaatttcgttttaagtatttataaggtcatcttgggggatcagtgggtgatttttaatacactaaagcatacaatttttttgcttgtgttggtaatctcactaacttcaaggtttttttttttgttttgctttttgtttttgccactgagcagtttttgtcaagtcagctaccatcaggatcaaacacttagtacagtaaattggatttggatatccattaactgctggtgacaaaagaggaagccccacgtttaacacacgtaaaataaaattttaaggagtttctggctagaaagaggctaccaataaagtctgaaaatgccccagtctctgctacttgaatctaattacatgacagaagagatttgggaaagataagcctgcagtgaaaacaagggagaaataatcctgtttgctctgcagtaaccattctaaggacaggagaaaaaaaaagaagttgactaaacttattatactcaatattgccaagataccaattagcaacataagtacaaattttcctcagattcatccaacataccaccctgtgtaataagctagtgttcataaacaggggaaagtggttcttctattcctcagcagtcctggtgggattacactggatttttctgttaattctggcctttggcccctttccaatattaactgtgccatggagtatagaatattcaatgattaaataattataatttaaaaattagaccatgtcaaagaaaataaaatattaggcatttttaagaatttaagacaagacacggactttggatcaagatgacagctaataattctgcatctacttcatcgcatatggcaaatctcatgaaatgacctcaaagttgtataaagaacaatatctctgtgatagccctggaaaagaagacaaagttgtaccaacaaactaaaaaatctgggaaattcttaatggttaaaaagtgggcagtttatatacatggataaataggattataggaaactagcccaaaatacattcaggaggaattctgtggtggaagccattctgagaagtcccaaggactgaatcagcaattaaaaaggaggtgagaggagagaaattggcatgtggccctgttggagctgagcagtgcatgacaattgtattctttcctaggtaggtagcgggtaagtggaaaacaagggccagagaataattcatgctccaggtagccagagacctctaggagagatgggaagcccccaatctagaagatacattaccaacatattcttccagaccatagtcctcccacttctccacgaccactacaggctatagtaaacagttttgtcaaacaaacggatacttaagtacaaagagaagaagacaaccaagacacaatacccaccctggaagaggaggaccaaacacaacagaagagttaacacccagagaaacagagctaccaaaggaaacagaagaatattttaaagtatagctaattactatccttatgtaatgttaaggaaactattacattatggaaaagaaacaattagatattttgtacactaaaaatttgatcatgaaatcatagattggctgataagcagcatggaaataggtataggtcatgttagtgaattggaaaattcagcacagtgtaaaaaggcttagaaatgggaagtgtgggggaaaatagagaaaattctaagatatatctaggagtagaaagatgagacaagggaatggaaggaagactataattgatatggttaggttttgtgtctcctcccaaatctcatcttgaattgtaatccccagctgtcgaaggaggaatctggtgggaggtgattggatcgggggcagtttcccccatgctggtctcatgacagtgagttctcacgagatctgatggttttataagtgtttggcaagttcctcctttgttcactcttctctcttgcctgccaccacgtatgacatgcctgcttctccttctgccatgcttataagtttcctgagacctcctcagccatgcagaactatgagtcaattaaaactcttttctttataagttgcccagtctcgggcagttctttatagcagtgtgagaatggactaatacaataaccaaacaattgaagaaaacctcgcagacctggagaaatacacaaatcttcagatgaaaagagtccagagagtatcaattgggatgaaaacacaaacatatacataccccgatacatcgtgttaaaatttaagaatgttaagaattaggagaaatatccagaaaacactcatattacaaaaagcaaattatcctcttttgtttatgacaatagaattggtgtcagactttctgctagtaatactttgtattagaagacagagacactattaagccctgagaaaaacgaattttaatttataatactgaactcacctacactggctgtgtttcaactatgagagtaaaataaaaatatctgttcaagtactacaagatgattacccaagactgtctccgaaataattaatccagagtatacctagcaaagcaataataacaacaaaaacaagaatctaacaagaggaaaacatgaggtgcaagaaagatggatgaacaaagaaactggtaaagcttggagttaagttcaattttaaatttagaaaaaaatggaccaggtagtatgtcagatagttcaaaattcagaatgtataaaggagtatttataaatctttctcacccactttccccaatcagtaggtttctcctcagaggaagccaatgttattaattcttgggtctccttttagagatattttatgtgtatataagcaatttagcatctatatgtatgtatgtcacttacactttttaaattagatggcagtataccatattttgaaccttctaaaattctgtgaagatttgtcaaggctctgtttcttttgtttgtttgtggcaaggatatagatacttattaccctagacacagagaagaaatttgtttaatttatttaattataaagttgttaaattttattaaatatgtatgttagaagaatgaaataagaggccaggcatggtggctcatacctttaatcccagcactttgggaggctgaggtgggtggatcacttgaggtcaggtgtttgagaccagcctggccaacatggtgaaaccctatctctattaaaaatacaaaaaaattagccaggcatggtggcaggcacttgtaatcccagctacttgggaggccgaggcaagagaatctcttgaacccaggaggtggaggttgcattgagccgagattctgccactgcattccagcctgggtgatggagcaagactccatatcaaaaaccaaaaaaaatgaagaatgaaattagttattatttccagtccacaagaaaaaaaataaaataaaataaaataaagaaaatatgatcatttcaacaaaatgcaggattaaaaaaacaagaaaccagacaaaaaatgtggtcaaaggaaaacaaaataaaatagcagaaaaatctaaataccccaaattacagtaaatgtatatgagttaaatgtcttcataaacatgtagactctgagatatgtttaaaaacaatagctaaatgctttttataaggggatacataaaatcatgcagaaggatggaaaataaatggatggtaaaacatggatcatgcaagtgtaaactaaaataaagattatatagcaatattagtattagaaaaatagaatttagggccaaagatattaatctggataaaagattcttgcatttcatacaggttgagcaccctgaaactttttgtacattgacatgatgccacaatggaaaattccatacctgatgtcatgtgaacggtcacagttaaaacacagtcaaaactttgttttattcacaaaataatttaaaatagtgtaaaaaattacattcagcctatgtttataagatatacatgaaacataaatgaatttcatgtttagaattgggtgccatccccaagatatctttttacgtatatgaaactatttcaaaatccaaaaaaaaatctgaaatccaaaatagttctggtcccaagcattctggataagggatactcaacctgtactattaaaaaatagtcatggattgcgtctcccctgcacttcttggtagtctgttagtgggagatccttgtcaccagcccttcacctcctccagtgccaaggagccctagaagtccccatcatgcatgagtacatctccatccacatttgctgggctggtgtccagattggcaatgcctgctgggagttctactgcctggaacacagcatcctgcctgacgaccagatgccagtgacaagaccagtgggagagaagacgcatccttcaacaccttcttcagtgagatgggtactggcaagcatgtgaccagggcagtgtttgtagacctggaacccatggctgttgacagagttcacactgacacctattgtcagctcttgaaccctgagcattgcatcacaggtaaggaatacctatgccagtaactgtgccggtggccacttacaccattggcaaggagatcattgacctcgtcttggactaaatttgcaagctggctgaccagtgcacagggctttagggtttcttgattttccacagataatacatgctcattttagacactcatggaacacttacaaatattgattgggtattagtacacaaaaaactcagtaaatctcaaaaagcagaaatcatatggtttattttctccaaccttagtgcaataaaattatacatttaccaccaaaaagtactcaaatcacaccaaatctatccatttggaatttaaaaatacctttttatgggttgatgaagaatccaaattaaaattactaattatttggaaatgaaagatgtaagagaactgcatatcaaaactcattggattttgctaaagcagtattaagagaaaactttatgaccttaaagacagggaaaattgaaaataaaaataaccacattcaactaaaaagtataaaagacagcaaaataacacaaacggacataaagataagaataaaaaagatgcaatagagtaacggccacaaaaccacagtatacctcatcagtatagcaaaaagctcttcctttgagaagaccaatacagtataacatcttttgacaagtctgacacaaataataaaaagacacaaataaatatcagacaaattctatagattcacatgatatagaaaggattataaattatgagcagttactttgtatgaatttataacaattgaatatttagatagaatgaatactttaaaatccaaattcctaaaaaatacagaaaaactgggtaaaccaatatatgtagaaaaaattgaaaaggcagccagctgtttattccttagaaagacaccaggccaacatatttttctatgtgaattgtaacaagcattcaagaggacatgtatttcctatgtaatattagcttttctggaatgtagaaagagatagaaagctttccagaagactggtataatacagatactgaaacatcaaagatagcacagaaaaataaaattatactccaatctcatggaccaaatactaaaactctaaatatatattaatagatagcaattagttaatattatattaattataatacactaaatattatattaataaatattaatagatggaatcccacagggtgttttttctttttaggttactgcatcttcaccaagtgtggttttttcctaggaatgaaaggatggtttaaacttcagtcattaacattaaaaagtcagtcattaacagattgtggaattatctcaacagctgtcatgaaggcacgtgatgaaattcaacatagaacactactaaatttttttaatgcttgaggactataaggaaaaagtttcctaatgaatatcatccactagcaccatacttagtattgaaacatttcattgaaatgaggaaagacatgtgaaattataagaaataagtggtattaagactgtaaaggaggatacaaaactgtaattatttgaagaaattataatcaatctaaacatttaagaaaaccaactcaaaaaccattggaactataaggtgagatcagcaaggtggatatagatcagaatatatttggctgggtatggtggctcatccctgtaatcccagcactttgggaggctgaagcgagaggatcacttccatctaggagtttgagaccagcataggcaacatagctagaccccttatctacaaacaaaatcaaaaattagctagactacttgggaggctgacgtgggaggatcgcttgagtttgaggctgcagtgagccatgatcatgccactgcattcagcttggatgacagggtgagaccctgtctcaaaatatgtatatattcaatagagttactataataaatgtatatcgaaccttctgctttctaagtagaaaatatgtcttcttttaaaaaacccttgggaaagttcgaaaaaaattactatatattaattcacaaggaaaagtcagtaaatttctcatataagagatatatacaattttatcttaatgcaaaaattagaaatatgtaaccaaagtagcaattaaataaatctagccacttgtaaattgaaataaacctctctcctaagccagcagtattgaatcaaaggaaaaataaaatgtgtgattctaagttattcagaaaaccatgaaaatgaaaaattttcaaacagccttatgttaaccttaggcttacagcctaagctttaattagagaaaacttcctattaaagaatgaatagaaataaactaaacttccaacttatgacagtagaaaaacaaaatatacctaaaggaattcagaagaaaaaaattaatataaacaaaagcagaaattcagttaattagaagagttaaagctttcaaaaggctaaatttaaacctagtcatttgggaacaacagtaacaaaatggatagacttctaattagttctaccaagaaagaaatgaggaaatacaggttcacaaaattaggaataaccaagtggaataaaagataaaaataataaagtaatttttggacagcatgattttgtagtttgtaatcatttgtgcttttcttgtctggaagctagtaagattagttctaaatctttctgtttcagaaattttgactggctgtgtttatgggagagttcctttccaatgattttgcctaaaatggggtcaccttcttcggtctgtgtttgtagatctgacttcagcttggaaaagtttctcactattacaattggaaacactgtctatatattataatgaaaactgttctttgatctccacatctgttattttctctctcattgttttaatttcattatactttccatcagcatttgcagagaagctttaatatttgcctgtttctgtgtgattcagatttttgaattttctgttctgttattgcttatatctagtacttacattcctgtgttattgtaactgcgcttacctcctaactttactacactagctccctcttagcaagagtctgtgacctcatcatcccatttttatcccttctatcattctgtccatttgccttgcatttaaaagagcaaaatcaggaacctgtctaacatttactttttctgatttgaataaatgctttaaaaagtgtgctttccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggagacagagcgagactccgtctcaaaaaaaaaaaaaaaaaaaaaaagtgtgctttcccttgccttttgaggagtataccattttgttttccctgcacaaaagcatcaaggtttgttacaagtttgacatttttgactgtctgatttctctgtcagccgtggctggggaggggaggcaagtagccacagggtagaagagtaaccagagtctaacactgtgcccgaagatatgagaatagacagcagttgtatgaggagattggatgaagatatttaaagggctgtatttcaatctagtgtaataatggatgtttataccaataatggagtcaacaagaaaagatttccttaactcatatatctttttaatttttttttttgatatggcgtctgttgcccaggcggagtgcagtggtgtgatctcggttcactgcaagctctgcctctcaggttcacaccattctcctgcctcagcctcctgagtagctgggactacaggtgcgtgccaccactcccggctaattttttgtatttttagtagagacggggtttcaccgtgctagccaggctggtctcgatctcctgacctcgtgatctgcctgcctcggcctctcaaagtgctgggattataggcgtgagccactgcgcccggccatatcttttttattttaaaaaaaggcaaattttcttcatgtgggaagttcatttatatagcatacttaattctaatagttccagaaaaagcagggctttgctatatagaggaagataaaaccacacacgtgacttaatatttgccaaagacaccaaaaaatatttttttctaatttacatacttcagattccatgattttctcattctcactctgtgtaaagtagaattttctatctccattagctaaaatgagcaagaattgccatatggacactcaagtacatgttgtctctgagcattaattttcttttaaaaaattaattaattttaattggcaaaaattgtatatattcatgatgtacaacatgatgttttgaaatatgcatacattgtggactggcaaagctaattaacatgtattacttcacatacttatcattgtttttatggtgggaacacttaaaatctcttatcaattttcaagaatccaatacatcattattaagtatagtcacctgtgttgtaccgtagagctcttgaatttattttacctatctaacttaaattttgtatcctttggccaaatctccctactaccctccccacaaatgagcattaattttcagtcagtggtttgtcagcaggactgtcgtgtttggggtgtcttacatatgccttcctagagaagccatttgtgtaatgtcaaaagagtgtgtttgtttattatatcgatggggacaggaagcagggaaactctgggcataagagggcgggtccctggcaaaggccccaccctcaagcctggaaccccagcccaaagtgagaacatgcattcctgttttcctcctcgaatgtttgccttttccaaaaccacccatggcctgccctgccccacatcctggacccctaaaaaccccaggctcagctggcagagagcagagaagaggagaagcaactggacatcagagagaagcggcttgacttcggctgggcggcttgacaacgttgcttcagagaggagtccacatggggagtatcaccttcctggtccatcccctttccagctccctttcctgatgagagacactttcgtcggcaataaaatcctccactcttcaattcattcatgcaacctgatttttcctggacgctggacaagagcttgggtgccatttgtgtggatgctaaaggctgtcatgctgaccctctgtcctcattagcggagagcaaccacctcacatgaaaaggcagagagcccactgagtggcataacacttaagctggcaaagctaaaagagcactgactgtaacagtccttctggggcttcaggggtcataggtacttcctcctagacactgctgtggagtctgaatggagttttgctcctgccagcacccaaaagcacttgccccggctcctgcacctgctcacctgtgtgcttccttccatgaggggttgagtgcaataggttccagagagtgcagtccacccctgccagcacccaagcgactggctagttctagcacccatgcactccagttcccagtcgagaagggggtcaaggaaacattttctgtttcaagatgaagctatctacattaattcaatgaagtgaaaagtacatagagtgacacttggtttatctggtgccattgggcaaaatgtgttatgaataaatgcaatctcataagtgcctgttgtcatggaaagaggctgtctttggaaccagacaaagctgtgtcaggtacattatcaaatgactttcacataatctcttctttaattccacaacaaccctctatcagttattagtgttgtcagctgcagggaacataatgccatgccaaaggctgttctaacaaataggcctgggacagtggctcagtgatgctctcaaaatccaggctcctttccctctgttctttgtactcagtgggttggccgttcctcttatggttgcaaaatggcactgcagcttcaagcaccacattgaattccaaggaagaaaggagagaagaggtatagaattgcctatgtccctttgtcttattaatcaagaatgtgatgtttgcccagaagcaccgacagaaaatgaccagttttcccatcctcccttgcagtctgagtggccatgtgaaccagttctggtcaatgacacgtaactggttcacatggccactcagagtgcaagggaggctgggaaagtgtgaacactatagtcttgttgacttatgattcaccacctggggttctgttagcaaaaaagaaaggagggtgtggatattgggtgttaactatcagtgtctgtcacaaatcctctgtttgctttacccatgaaaatgttcgtatttaaatacataactggatcaaaatcaccagctcttgaatgacagagttaatacatcaactgcggtctattgctcatgttcctgtttgcagttaactgggaaccttttgggtaatgtgaatgatatttacaatgatagttacatgatgaagctagtctcttgtgaaaacagtatacttcgggttggaagtagtttctgattttttaaaaagtgaagtcagccaggcattgtggctcacacctgtaatcccagtgctttaggaggctgaagtgagaggattgcttgagcccaggagttgaggctgcagtgagccatgattgtaccactgcactccagcctgagtgacaaagtgtgaccttgcctcttaaaaaaaatgaaattttcttacttattaaactgatggaataaatacttttcagtttgtactaatgtaaggcaataatgtaatatatggcaataatataaggcaaagctttgctatggattttctatggggagtgcgaataaaaggattagaacttagaactttcatatactttacctctgtgtggacatcgagaaaaatgccaagactaatagaagtgatgggttagatggggtttaagagaaggctgcccagatgatatggtgttaggtgtcacttggaagttaggttagataaggaagtgttgggctgccctcttgctgcaagtgtctgaaatcctagttagctgagagccagttctggccatttctgaggtttgctgcctccctaatcccacacttgcatcctgttcctgttttgctttcctctgctgctcgtctttcactttctctttcctcacttgggaagagtgttgaaacaacatttcattatttggcactgcaaggcagtagtagtgtccccactttggtcagtttctgctctggcaggagaaatggtttcagtaagtttttccatttcctatttgttagacttcctctcaggtacccatccagatctgtccacaagtgtgagagaaggcttggacgctgttcctctcaccatttcagagcagtagtggaagtgaccctgtgccctggctgaaggacattctccaaggtcagcttttaagtgttcccctggaggacgagaggatttatctttccttttcagaccatgttcacatgtcatgaaattcaaaatttggccctaactgttcatcataggtccttgtttactttttgtctacttcgtaagaatggctgtggtgcagttttgttttaattaagacaaaccgatgtctcccaaacatccattgctctctgtgagaaagaaacaaaaggaacagttttgcttggctgtttaaggatggagaagcggatcttatttcagaacatgggtcatcctagatggacgagggcagctcagggtggagcagccatgagatctggcaggtccagactccctggcaccagaatggcagctctcagcaagtgtctgcttggcgtctcctggagtcttgttggcatggaagagagaccttgtacaacattcctcatatgtcattccccttaaagaaaacatttcttctcctttctgtcttcacctccaatcccatgtttgagaatacaaatcaaacttattctcgttcattctaaagggagtagcacatcaaaagtacactgctcctttcttcagtgcctcttacaaggagcctgtggggatagcagcactctgcccttagggaactatagtctagcagggaaagaagaatgacatattagttgaagtggatcgtcagttcaagattggttacatcttcattatcaagattgtcatccttcattgatcactcactgtgtagcaatgtcatgatgctagttcttagggatacagagtaggcaggctgggcatggtggctcatgcctgtaatccctatactctgggaggccaaggtgggaggattccttgagctcaggagtttgagactagcctgggcaacatggcgaaaccctgtctttacaaaaaaatacacaaaaagtagccaggcatggtggtatgcacttgtagtcccagccagttggaggctgaagtgggagaatcactttactctgggtggtcagggctgcaatgaactgagattgtgccaatgcacaacagcctgggtgacagagcaagaccctgtctcaaaaaaaaaaaaaaaaaaaaaaataccacacacacaaagaagcaaggaaggaaagaaaagaaagaagaaagaaacacagcatgcatttgtgacttcacatacctaagaaggaattattggtatgaggtggttcatattaatgtaaaataagtgaactgatctatatttgctacaggacttgtaaagaggagtggcctggggagtagaccttgaaagacagtgggagccggtatttgggggctgggagtgttgcatgctgggttttccagggagcagaccctgagaggagtttaacatgcaagatggttacttgggagtttcttgggattgacactcatggaaggaagagaatgaagcaggatgagcagtgggaggtgtcaaactgaaatgcagccccaaagaaagccttggcacagcccacaagaaactctggaacaagaatagcatttagagttgtcctaagttggactgagctgtcctaagttagacccctgctttgctgagtcactgaatgtgtccacaggtgtgagagaagggctggatgctgtgcctctctcacagttgcagggcagtagtggaaatgactctggctgaaggacattctccaaggttagcttttaattttcccctggccagggatgtgaccctcagagagatgccttcctgcaactaagtcaaccaccgaaaagactgatggctaaaggctgtttgatagtacactcttgcagctaaggcaacgagagctttattgatggggattctgggcagctgtcaacatgtcaccataggaagaatggcataagcaaatgcatgcagaacagttctgatgagctgtgatggacagaacaattggactgcagtggctgttacatttggaagtgcagtaggaggtgatgttagagtgttagtaggacgcaggtggaaggttctaactgcccagctaaggactctgaactttgtcctgtggacattaagaaaacactagatggtctgagcagtggggaggtgttactaaggtgtgaaattgtgttttaaagggatacatctggcctagatgtagaggatgaatagtagtggcaggaggtccaaggcaggaagatggccatagactagtaattcatgaaagcgaatagggtgggtctcgaaaagagtcctgggttgcaaggtgaaataactgagttctcattcaagctctttgtcattgacttgactgtgtaggtcttcctcttggacctcaattttgccatctgtaaaaatgataagctcagaagtccctttccagatgtaacactttgtggttctaccttaaagtgatctgttcgtttgtgttccttcaactgcgtgctcattgaaagatgttgaagactagtgtagtgtgaaaccagacttctggaaactttattttggatatttgtttattaactgattcctccactctatggccttgcaaatctttgtatttacacacaaaatttgaagccaatgaattatggattcaagctgaaccagagtcacgtatcagctattacaagcctaagggttttgtttcttaatcaattacagtatatctggtaactcaacacagctacctggaatacagaattagctttccgtattgcacagggatggattgtcttcacctaagtttctacttaaataataatgaaaacgggattaaccctggcagtaaagaaatgaaccagtttgagcccatacttgttgaggacttaagtaaattatatttctttttcccttgtaagttttgcatcatagcttggtgtcatgcccataatcagcagataatttagggaaaaacaaaagataacaaatgacaaagataaattcactgatcagaactctggtccccttctttttcaaaatggttcacagacagatttttgcatgggggagacttttttttgagacagagtgttgctctgtcgccaggctagaatgcagtggcatgatctcggctcactgcaacctccgcctcctgggttcaagtgattctcctgcctcagcctcccgaatagctgggactacaggcacgtgccaccacacccagctaatttttgtatttttagtagagacggggtttcaccatgttggctaggatggtctcgatctcttgacctcgtgatctgcctgcttcagcctcccaaagtgctgggattacaggcatgagccactgcgcccggctgggggagacattttaattcgttgattcattgactcaaaacatgacttttccttcatttattactgaaagtattaactctatgcatttgttcgtccattaactaaattattaattcatgcattaatttagtatatattattaagtccctcttgtatgtcaggtacaatgctaattgccagagacacactggtaggtaaaacaagatcaaatcccaaattttatggagcttgtagtctagttcgagatggacattaatccattagtcacatggtttgttctgtaattacagactgaagtcaggtaaggcttctttgaggaaaattgagctgaaatttgaagaatgaaaactcagtggactaagttaacaatgtgaggatgaattgtagctttgagtcaatgatgaatataatttcaacgttattaaaattttggcattttatattattatggacaaaaagaaaaaccaatatactgacttaaccaagtgttggaggtcattttctaggttagaagcagagcccaaattaatagtgacctggaaattaagtctcaaatgatagggggatggacataattcttcctagagccttgttggctgctctgggtcaataatatttggaagcttgtggtccaagtaagtcaagcgtaagaggtgcaacaccaaatataaatctgtgggtgttggtgctttttttctgatgtaaattttttccagtgtgtttgtgtcctttccaagaaggtgggcagctgtgccaggaaattcgatgtatatggtatggagatgtggtgactggaatgaacagaaaactgtatatagaagccttaaccctttgatgcagcatctttaataaatgcagaggagatactgcagaggtgacatcctctttatggagttactttcatcttgattcactacttgctcctcattcatcccctaaccccaggtgtgaaaaaatttcccacagtgttcaagtgaggagtaaaaagttttccacccaacgagaatccaccaacaatagtttgggggcaaataccagcctagaatagattgctgtttgacaaggagtaaaaatcatcaatagtagcgtgagaaatgtgaaaagattctgcatcataacaacaacctatgccctaaagaggtaaagagagaatttacagaatgcaatttattatgagaaacaatacattttaaataccatttgctttggctactgatgcaattgaagaaaatattaagtgttatgaaaacaacaaaatgaaaagagaatgaagagcaaaattggctttgtggaaaatcaaatcagtggtatagaagacaaaagtgctaaaaagagaagatgctctgtttggtttatattccttcttctgttatttttagtttattcctttatcgttttcacattttttggtatagccttagcattttctttacttttgatactttgctgtaatagaccaaaattgcttaaatttattctctatggtgattttgaaagtttgaattctatttaaaaaaatcccatactggatattactaaaatttataaaatatatgattaaatctaataaatgattaatttaatgtgtagttctattttacatccatatgtgaagtgaatgttcatgtatgcttatgcatacacacacacacacatacatacacgcacaaattttctttcccaagaaagtctttggctttactttcaactttgtgaccttatttccaaattacttatatctttctaatgtctattataactttctgtaattatggaaatttcctatatttgcaatatctaatatagtagccagtagtcacatgtgcataacaagtgcttgaaatgtggctagtgtaaatttaaggtcatgttaagaaaacagataacaatataacttagatgacacagctctgtagaagttactatatttctttgataactctatttacaacccactgaagtttacacaaacatttcttctcttttcctctgccaaaattatagagaccgtttgctcatatgctcgcctttaggtttgttcaactctctcatccatcaagattcagctcaattgacaccttccctgagaattatgccctgacttcacaggctgaggagtcattgtccttccttgttctttcagtgtgtattgcctgcttgcaatcatgagttttcgtttatcttccagtgagattaacctttttgagggcagctactaaatggggcttggtgaatgctgttgagtcagtaagtgacttctaactttgcttgacctgcaaaaccctggctacctttctgaagacttgatggtctgaatggttagggttctgaaccatgcagcagtcatctacatgaggccattattaacctaaccagggacactcacctaccatttttagtcaaggaattgggattttgctctcagcttttcaatttttttgtgctactgatctcaggtgtgcagaattctctgtcccagttttctcttttcacctagggcagcacaacccctgcaggtggtccagagcatgcagaccaccaaccaatcccagaaggagaggtatgagatagaaacaatgcactggcttctttcattacttactttggtagctgtcaaataatatttcttgtgggagtttatttaaagcctgtgcccctaaaatgtggtctgggtaatattcttgatgagtcgttggcacaaccctgtgtttttctatgtgaaatggctaaccatggatggaagtaaatcactaagaaaagtcgaaaaagaatttttttgaaaacttgatatcattaaacttgaaaaactgtgctttttttttttcttggaaagagaagcctactgtagattgtcaaatataaatgctttgattatggtttggggtatgttgaaattaagagctttctatggttatcttgtggttgtaaatggagagcaagaaaatatataaagtgatctataggaacctgcttggaagggatgaaaaacattacatccatgtagagtactattttgctctaatgtgataaacgaaagtgaagcagtttgcgttgttataactttatctgaaggttgaagattttaataacatgtggttgtcataatgatttagaaaggatttttatcttcataagtcatcatgagagtaaagaggtttggttgtgtggacacacatcctctagaaagaacaggtttctccacctcaccactgttgacattttaggtcagataattctttgtggtggggactgtcctgggcactgtatgtcaggcctccacccattaatgccagtagcacctccctctcctcagttgcaacaaccataaatgtctccaggcatctcaaaatgttccctggggggcaaaactgtgtgacagaaaagcaccattctagaatgtttgttgaaatatgtgaggctggaagttaataatctgtagcatctgactgcaggccttgttcgatctgccttgggatgtcctgaggcagtttccataaatattgctcgcaggaatgccagccaccaagacaggcttcttggcaagcgttcaccggagagagctgaatttgggccttaggttttgaaggcacagtgagatgacttctttacacccaggttggattgatttatttgtcagaataattaacattttaaaaatgttagatgttgttttaaaaatccagcagtttggaagaggtacaaagaaaactacaaagcaccctacatcctactttctagaaataactagtgttcatatgtggtaaatagcattctaagcattttcatacacatacacaaacagggttttggataaggtaaatacatagacatagggctatagaaatgccattacatgatgcatgccattttaaattaaaaatatttaattttatgtgaatttaatagatgataaggaaatgaaataaaactgaaggatttgctaaattgagatgaatgtttgatcacagcagaataaattatttccttaaagatacctctaagtgtatcacaaaaggtgaggagattggcgttactatgttttaaaatttcatatttaaattttagtcaatggtacttaatttccctacaactttcttccattcaccttccagatttatattggttatgttattatatatgctaatttaatatcgtatatgttccacaccctaattttcctgttatttattcaaagtttaatgtttaaatggattaaatgctcaccaccattccttttatatgacttttataatcctgttgtaaaaattttgaatcatttcctagctggttggatttcatcatcaacttttgaaagaaaggctgtatttactgagtttttccatttttttttaacatttgaacaccttggtgttgcctgtactcttttaaaaaattattgtggtaaaatatatattgtttaacatttaccattgtaaccatttttaagtgtacagtttagtggcatcatgtacattcacattgttgtgcaaccatcaccaccatccatctttagaactttatttcctcttgcaaaactgaacctactgtacccattaaataataaccccctattctctcctcccccagtccctgacaaccaccattctactttctgtctctgtgaatttgactaccctaggcacttcataagtggaatcatacaatatttatccttttgtgtctggcttatttcacttagcataatgtctttaaagttcatccatgttgtagcctgtgcccgaatttcattcttttctgaagctaaataatattccactgcatgtgtacactatattttgcttctctacttatttgtcagtggacatttgggttgtcttctcctttagggttttatgaatactgctgttataacagagtggtacaaacatttgtttgagtccctgctttcaattttttttttttttgagacattcttactctgtcgcccaggctggagtgcagtggcatgatctcagctcactacaacttccaccttccgccttccaggttcaagtgattcttgtgcctcagcctcctgagtagctgggactacaggcgcctgccaccacatctggctaatttttgtatttctagtggagacagggttttgccatgttggccaggctgctctcgaactcctgacctgaggtgattcacctgccttggcctcccaaagtgctgggattacaggcatgagccactgcatctggccccctgctttcaatacttttgggtatatacacagcagtggaattgctggatcatatgataatacatcagactttttgaggaactaccgtaatgttttccacagtggctgtaccattttacattcccaccagcaatgaacacatgttctaatttcttcacatcctcactgtattagtctgttttcacactgctgaaaaagacatacccaaaactgggtaatttataaaggaaagaggtgtaattggctcacagttccacatgtctggggaggcctcatactcatggcagaagacaaaggaagagcaaagggacatcttaatatggtggctggcaaagagattatttgtgcaggggtactcccttttataaaaccatcagatgttgtgagacttattcgctataatgagaacagcaaaagaaagactcgccctcatgattaaattacctccacggggtccctccaatgacagatgggaattatgggagctgcaatttgagatttgggtggggacacagccaaaccatatcatttcacccctgccccccccccaaatctcatgtcctaacatttcaaaatcaatcgtgccttcccaacagtcccccaagtcttaactcatttcagcattaactcaaaagtctacagtctaaagtcttatctgagacaaggcaagtcacttctgcctatgagcctgtaaaatcaaaagcaagttagttactctcaagatacaatgggggaacaggaattgggtaaatacaccattccaaataggaggaattggcccaaacaaaggggctacagggcccatacaagtctgaaatccagtggggcagtcaaatcttaaagctccaaaatgatctcctttgactccatctctcacatccaggtcacgctgatgcaagaggtgggctcccatggcctcgggcagctctgtccctgtggctttgcagggtatagcccctctcctggctgctttcacaggctggtattgagtgtttgcagcttttccaggcacacggtgcaggcggtcagtggatctaccattctggggtctggaagaaggtggccctcttctcacagctctactaggcagtgccccagtggtgactctgtgtggggcccgcaccccaaatttcccttcttcactgccctagcagaggttctccatgagggcttgcccctgctgcaaacttttgcatggacatccaggtatttccatacatcctctgaaatctaggtggaggttcccaaagctcaattcttgacttctctgcacccacaggctcaacaccacatggtagttgccaaggcttggggctttcactctctgaagccatggcctgagttgtaccttggccccttttagctgagtggctgagtggctgagtggctgagatgcagggcaccaagtccctaggctgcacacagcaggggggccctgggccctggcccatgaaaccatttgttcctcctacgcctctgggcctgtgatgggaggtgctgctgcaaaggtctctgacatgccctgaagacattttctccattgtcttggtgattaacatttggctccttgttacttatgcaaatttctgcagctggcttgaatttttcctcagaaaatgggtttttcttttctatcacatctcaggttgcaaattttctgaacttttatgctctgttttcatttcattatgaatgcttttaacagcacccaagtaacctcttgaatgctttgctgcttagaaatttcttccaccagataccctgaatcatctccctcaagttcaaagttccacatatctctagggcaggtacaaaatgatgccagtctctttgctaaagcatagcaaaagtcactttgctctagttcccaacaagttcctcatctctatctgagaccacatcagcctagatttcattgtccatatcattatcggcattttggtcaaagccattcaacaagtctctaggaagttccaaactttcctgtcttcttctgagccctccaaactgttccatcctctgcccattacccagttccaaagttgcatccacattttcaggtatctttacagcagcaccccactctaccagtaccaatttactgtattagtccgttttcatgctgctgataaagacatacctgagactgggtaatttataagtaaaaaaggtttaattgactcacagttctacatggctgaggaggccttacaatcctggtggaagaggaaggaagagcaaagggacatcttacatggtggcaggcaaagagagaatgtgtgcggggaaaatcccctttataaaactgtcggatgttgtgagacttattcactgtcatgagaacagcccaagaaagacctgccctcatgattaaattaccttccaccagttccctcccacaacacatgggaattatgggagctacaattcaagatttggatggggacacagccaaaccatatcactcactaacagttaacttttttcctgtttgtttgttttataatagtcatcctaatgggtatgaagtggtatctcctttacatttccctaatgggtataaagtggtatttcatttgcatttccctaatgattagtgatattgaacaccttttcatctgcttattgaccatttatatatcttctttggataaatatctattcatgtcttttgcccaatttttaactgggctatttcttttttttgttgctgaattgtaagaattcattatatattctggatattaaccccttgtcagatatattattttcaaatatttttcccattctgtggattaccttttcactctgttaatagtgtcctcttatgcacaaaggttttaatattgatgaggtgcttttattcttgaatagggcttaggcagttgtaatattcttgggtgatttttttcttgtgggattttgtaggcactgcttccttgtgttctggcattagatgttgctgtggagaaggcagacctttccccttgcaggtcacttgctttcactgctcgaacatctcagaaattcttctgatccacatctttcctttttttgttttaattagaaaaatagagaaatagaaaagttaagagactagtataataaactcatgtgtacccatacccagaagtaactcatgttaatactttatcatttttgaatgacattttttttttttttgagatggagtctcgctctgtcgcccaggctggagtgcagtgactcgacctccgctcactgcaagctctgcttcccgggttcacgccattctcctgcctcagcctcccgagtagctgggactacaggtgcccgccaccatgcccagctaattttttgtatttttagtagagacggggtttcaccatgttagccgggatggtcttgatctcctgacctcatgatccgcctgccttggcctcccaaagtgctggaattacaggcgtgagccactgggcctggccagcagtatttttttaaatcaatgttttgacatgcacatagtttaataagtttcttgggttgggttctaagaagaagacctgagatgaagattcgtatccaagtgatttattccagtggaacccaaaaaggaagtgagagaagtggaagacaggaaggagcacagcaaagatgggatttagggtgaatctcagccattgcctatcctgtggcagctctggagggtaaattactcagaagagtttgtcctgccttagggcagcttggcctacatctaaattttgaaatatattaacataaagaaacataatatatttcataatatgaaatatattaacataaagatgtttttcatcctcttaccattttagggcctacagaatctgcagtgatattccacatttcattcctaaaattgatttttagtgacttttctctcttattctttcatagtcttgccaaggaatttaattttattagtcttttttaatttgttgatcctcttgcttatatttttgttttccatttcataattgctgttgtcatccttattattctactttctttgggttgtatgtgttgtcatttttctgtcttgaaatagtttaagatcattgattttttcatctttcttcttttcaaatatgtgcatttaaaactacagatccccttccaagcatagctttagctgctttactcacgttttggtatgtaatatattcatcttcattcattaagagtattttctaattttcattgtgattaatttttaacctatggaatgtgtttggacattttctagttttaaacttgcttttttgctttgttgtcagagaaaaaacttgtattatttcaatctttgaatttttgagacttttctatatggctcagatcatgataaatgtttataaacatttcataaatacaaaaaatatatattctgagatggttagttgtagctttctatacagttacatagtttcaatttgtaatttaattgtttccatattctgtatcgttacttatttttttcacctgcttgataagttaatgatagttgtgttaaaacctcccaccatcattatggatttttctatttcttcttacagttctgtcagtttttgctttatatattttgtggttatgttgttaggtactttcacttttagaatttgttccatcctagtgaaatcaaacttccaacagtatgtagcatctctctgtcttaaagtctactttgtctaattagtgtgactaagccagatttattttggttagtaggcttatggtaagtatttttttcaatcttttatttttaatctttctggccattatatttaaggaatgtctcttttaaacagaatataactgaatttttaaattttatcctgacaatctgtcttttaattggtgatttattctatttgggtttaatgtaattgatatatgtgcatttaaatcttccattttactctgagcttttaaaatttatccatctgcctacattcctttttctctccatttttgccttcttttggattgattaaatgtgttttcttattatatcttttcccatatacattaatttggaagtcatacactcttttctgttttttttagtggtaactctagagcttaaaacatctatccttgacttatcaaagtcgaatattaattggttcttttatcttcttcatggatgatacaaggaccttaggatactttaaggccatttatctctcttctgactcataggctgtcattgtcaggtatgttaattccatataaatatttaaaactccacaatccattataattgctgttttacacagttgcttttcttttaatttacctacgtttaccattcttatttttgctcttcatttctttcatcatctccaagcttcctttaatcttaaaaacaccatttaatattttctttaagactggtctgctgaagatgaattctcttttgtctgacaatctctttcttttactttaatttcctggaggacatttttgcttttgtagttgtcctcaatggcatggttgatctgtattatctagcccaccattcctctccatcagacttttaaatttggcaacctgcagttctctctttttaatcttacctgatgttgtgttatatatgcttcatgatgactaacccaagagcatagataatatcctattaaatcttccctcatgtaaagtatctttatgtttaagaatttatttttaacaaaaataaagtcagtatgaaacaaagctgtcattgtatttgaatgttgtctcttgctacaatctgagaggacctggttatgattcttagaaaagaacaagctacttgtctagtaggtataaacactgattgcattaatagggaaaaataacctagatattgtcaggcatgatattggtttgtatggggattgtcactggagatgtggcacatgtgattcctcagatggtctcctgcagggcccgtggtttcttttgtgttagtgcttgcataggtacatcccagaatatgatttttttttttttgagatggagtctcgctctatcaccaggctggagtgcggtggcgtgatctcagctcactgcaacctccacctcctgggttcaagtgattctcctgcctcagcctcctgagcagctggggctactggtgtgagccactgcgcttagccagaatatgattcctaaatacactaatatcttatgtctgaaatactgcaaagttcacatgtggaaagggagtagagtttagacactgggcctcatggaatgacatatattctgcttctgtggacacactctgatcttagcgtgcagtaaagacaactatcttagtcaatttgtgctgctataatgaaatacctgagactgggtaatttgtaaagaacaaaaatgtattctctcatgttctggaggctgggaagtctgagttcaaggcaccggcaggtttggtgtctggtgagggctcttctctctgcttccaagatggtgccttgttgccatgtcctctagagggcacgaacgctatgtcctcacgcggtgggagggcagaagagagggaactaactctctcaagctccttataagggccctaaaggctccaccctcataacttaattacctcctaaaggccacacttcttaatactatcacattggtgatcaacttgcaacatataaatttccagggacacattcagaccatagcaaaaaccaaatgccctttgttttatttttcagctacatgttgtatgtatgcttcttacttctggaaaataatgccgttctatagcaatactgtgaagaatcttatatcagttataaatatacatgtcttttgatttacttctttttttttttttgagatagagtctcactctgtcacccaggctggagtgcagtgatgcagtctcggctcactgcagcctctgtctcccaggttcaagcaattctcgtgcctcagcctcctgagtaactgggactacaagtgcacaccattacacttgactaatttttgtatttttttagtagagacggggtttcaccgtgttggccaggctggtctcgaactcttgaacctcaagtgattccccccacctcagccccctgaagtgttgggattacaggcatgagccaccacacctggacttgatttactttcaagctgacagtcatttgtcaccaacaagctcccagtttgatctacagaggccaggaaaataatacgaatcctcacagtggctggatggggactgggcatattagaggtcacatgccctttaaaaatcggatggccacactcagttttaattattgccatgctgtgatgtgaattttattttattttcctgagaagtcagaaatctagattttttttttttttgagacagggtctcactctaggcctcagaaatctatatttttatgtgaaatcttcgtatatttaaaccttaacaaataattcttttttttttttttttgagacagagtctcgctctgtcacccaggcaggagtgcaatggcacgatctcggctcactgcaagctctgcctcccgggttcacgccattctccggcctcagcctcctgagtagctgggactacaggcgcccaccaccatgcctggctaatttttttgtatatttagtagagacgaggtttcaccctgttagccaggatgatctcaatctcctgacctcgtgatccgcccgccttggcctcccaaagtgctgggattacaggcgtgagccaccgcacccggcctaagaaataattctttttaggggctcgtttggcagaatatacaatcattgttaaataactcagacctgcaggccagattcctcccagagaccaacagcttgccccctttatcttaaccattatcaggtaaactgctctcattctgtacacacaggtgctgagaatcctacctcaagggtgggcttgaggatgcttgggaagcctgaatgatattggcatttgccacaaatcatttaatacagaagcctgggagtcatcctaacatctcctttcttcctgcatctggtcagctgccagctcctattgattccagcacctttgaactttgcatctatgctctcctcctccagacactggtaaatctagtctaggctcttgtctcttgcatgtcagtggccttctagctatgctctctgatgtgaggctttgctccctcagtccttacccacactcctgccagagtaagttttccaaaatacagtctgcctaagtcactcctctgcttaaaaatagtccagtgagtcaataaattactgtgctggaaagcttctctttgccctccagatccactctccacccttccctgccccgcgctccacccaatgggaagctgacctgcatggacagcatcaatggtctcccttgccctctggcttctggttgggtttggcaaataacgagcactgcagggcgactggagagagggaggacagaagtgtgtttgtttacttccccagctctctctttgtgggttgctgtgggctctgattctcaaccgaaggccttagttcctctcaggcagccctgtatacacagcccctgcctgcccttgccccatctagcgtgcagggccaaggcagataatgagaatcgtcaaatccacagaatctggctggcaccagccccagggtgctgcaccaggcttcatggtttccctgtaccctgtccactaccttggtaaatagcgtgttttaaaaatgcttcccaagcaggatggcaagtgtgttagtgtctgaaataatgaaaaatgttgtgtgctcagcatatgggatatgtggtgctagcaggagccaccagagatgaagctgaacaaagggtaggatagggcacaaacagcctagaggagcagaatgtgtgtcctgaggaattagtgaagggctttaaaggtggtaaaataattaggagcacattgactaggaaagtgtcaaccaaatcctagaggccatcaactgtcagggtaatgagttttggagcagcagagggtagaatggactgaagaagagagaagtaaaacacagaggtacggagcatttctcaacagtacctagcacacagctttagatatatgggtgttgaatatatcctggtcagactgaattgttgagtctgtgtgacagcttgagtgacatttttatgccgttcacccaattcatattttaaaatttcttttgttaaagaccttaaggtagtattaacctgaaagaatgtatttactgttaactaaatctgggtcgtttgagatccccttaaataacctttgtggtaacattggaatgaacatttatttgatgtctgggaagtaatatcccagtggaactcattttattttgggttgtttttaatatggagctgttaatatagcatttccaataagtgaccttatatgtgaaatctgtgtttaattactaatgttttagcaagactagtagaactgtactattcattataagtcacagatttaagaacttgtcaggaaaatattttatgatttgatttatgcctggggatccaagaaaggcaagcagtacttgagtctttatgagatggtgaacatacttattcctacaatatttttggcttttaccaaccctattatataatgagtaaacaatatcttttttggaatttttcatccaaaatattccctagctagagctttacttaggaaaatatgatttcctaagagatccttaagcctgataatttgaaccaaacaacacaaagtgcatactgcttctttggaagtgttttcatagctttccttttagtgttttccttttccctttaaaaaaaaagaacttttattgggtgttttattgtgcaaactatacatgtttgtcatataacattagaaattatagatgatcataaaagaagaaagtaaaaagtgtttgtaattccatcacaattagaaaacagaggtgagcacaaaataaggactcacatgtaacctatcatacggaagaaggtgatagggatacatgaggtgcttccagcttccagcagggttggtatgttcagtggaaagtctatcccagctctcctaaccaaggtacaaattgctcctgtttcagggtctccttcccctgggccccttgtgtctgttgctcttgacaaccaaaggttgccattgcctcaccacagcccttgtccctctcacctgatgctcattgatttgtgagctacttgagggccagatccacattgtattcacagggcactgagcacagagccttgaacttagcaagctcttggtatagtttgtgtgagaaaatgaacgaatgcatgtgagttcatgaacatcagtcagaaatgcgaattcctcatgaaagaagctagataaaatgaaatacttttgaaaagcagaagtgtagctctacttgcaatatagagggggaaaaaagtaaaagacttcatagagatatcgaaagaatgttgtggtcaagcagatcacagcagcagatgtatttgatccaagaggcgaaatgctaactgtgagtgatgatagctgggctgctgtatttgactggattcctggtcgtgaaaggaagtggagcatcagtggggaaaacacacagatgtccataaagaaaatgcaggctttgtctggggtaagacagaaagcgcttctgcctaggccccttctttaagaagaaaataacttttattggatgttttattgtaaaattatacacgttcattgtatgacattagaaattatagatgatggctgggcgtagtggttcatgcctgtaatcgcagcactttgggaggcctaggcgggcggatcacctgaggtcaggagttcaagaccagcatggccaacatggtgaaaccctgtctctacgaaaatacaaaaacaggccggacgtggtggcgagtgcctgtaatcccagctacttgagaggctgaggtgggagaatcgcttgaaccggggaggcagaggttgcagtgagccaagattgtgccaccgcactccagcctgggtgacagagtaagacttcgtctcaaaaagaaaaataaaagaaattatcgatgagccttggacacacatggttctcaaagccacagttgttcacctgcaaaatggggatggtgatatctatcttaaagggcttgctgagaaggttagagagaaggtgggaaaagtactggcaggcagtactcacgctgtgcattaataatggttaacagtgcttgcgttatgtaggacaagcttgttcaggtcttcttccatgctctgcctcagattctggccccagacagggtcacagagtgacatgatattgattgaagcacacttggattgggtccaaataacaacttaccatataaaataataacaacatggaatttaaataattacttgagacaacctaaagagatgtttgaacagggggaattgggagcagctatactcaactgacaaacacagacattcacctgggttacaatcaggccaaagagccagctgatatcagtcagctgtattttattgtcattaaccttcagagctggggctaaccaatgtggagctgctacataccgcttctctcaggaggtttaccaccaccatgcagcccaagaatacaggttccaccctgccggatccagttccttctgatggctgatttcttccctccccacaaacctttctgcctcctgacatttgatgacggtaattggtattatttcatatttttattgtaacattaaactgtgttcacagactccaagtctgattagttggctgcttacttggcattatggtcggcttactagtttaaaaagcagaaatatgcattaatggaatgctgtaagattagagagctatgtcccacacatttatcagggacttgagtgaagacacggaagctgcagagctgagcacagtggctcgtagatagggtgacaggatcagggttcaaacagatctcaacaggctggtattctgggccaaaaccaacaagaggaaattcagtagtgatgaatgttaagtcttgcataagtacaaatgggagagagctggttctcccatcattgttttgaaaaagacacattatttttgaagaggaaaaacaattgcttacccttattgagatactcaccaactgcatgcgtggagatgctgcctgtactttatatgtgttattttatttaaatcttgtttgggtaaagattatcatctccatttcatagatgagttttagaaagtttaagaaactcagagtcaaacagcttttaactattatgtgatgctgtctccagagcagattccaacaaatgggctggctgaaaaacgaaggaatggagggagggagagaagaaggaaacttaggttttatctgaagaaacctggatcataggtgcaatgtatagtctgtgttcttagattcagtgttgtattctggaccctacattttaagacttaaaatgtgcaaatttcgatgtgcgccaagagagagcatagttgcaaaggatctgggaacgtagaaggaactaggaggccttcagaaagcttgagaaggactcttctgtagaagaggatcaaggctctgtccactgctctagaggcatggaagctccagggaagcaggttctgtttcactgcaaggaagacgacgcaaacatacattttcagcaatggcccaagtggcgcttcattctgcttcagtggagttatttctgaatgtctgtgttatcattatgctgctaggatgaaagggaagagagcagaactgggtggaaatctgggatattattgctattactctccagagaaataatacattaaaaaggcagaagggctggctgctggagacggcattggggtttcaaaacaaaatccaagcgtcttcctggctgaggagaggagaaacactcaaggacccctcttgaggtgccattcgtgctctactttcttagagggaaaatatcttacctatccaatcagagaagccaaatgcttgcacttataacatgcctattttagttattttagaatcaagattcttttttttttttgtaagttaaggtagagaagttatggaaagaaacctgattctaactatgaactgaacagatggaatagtgggaataaaaacaaattaaaacagtattgcaaaaactctcaactttcatttaaaaatatatatgatgatgtttttcaacttttcacattcaaccttttggtatatcgagtgacaaaatgaaaaatcaatttcagctgtgtatattttaaacatttacctaaatgatttggacttacccaacctaaaagtccagatgaatgtattaaactgcttattgtatcttttgtgaattaaaactttattttttattatgttatagacagggcacagttatgtttggtgacgtttactatagaaaattgaactgaacagtggtctaattagaacagtaaatagtatgggtttaattagcccctattcctgatgacagatttgatcagtcaccagatatttatcctttcctttcacttgactgttactgaaatattgcctctagcaggactgcttactgtgctataaataggtagcttggcaagaagccataaagcccattgaccagtgagacttgagtgaaaattattggaaaaccccctctttgcttccagtcattatttcttcatttcacttttgaaggtcctttccacaggtccctcttttaatttaatttttctttttttttttttttggttagatgaggtaacttgcctaagggcttaaggaaacctttgcagtatctagttcagtcacatgctgcagtttattagtatgtcacagtttctttcataaactttgctgttctccagcttagaacttacctattaaattctgtctgacttgaacttttctgtacaccaagaatatgtggtttttgtttgtttgcttccttgtttttaattaaggtatgatgtgttttattaagaaaagtctacaaaatgcagagaaacagcaacaacaacaaaaatacgttaaagtcacccaaatccctcacacatagaggtagcaatggtaatattttaattaacctctcactcctctccctatgcatgtacaaagtatacatgcatgaaaaatgatatggatttaatatgattatctaatgattgtctttttccccaccccaatatttttaaaatagaaatttcaaaaaccatgaaagttcaaatagtaataaaactggcatttaacaatttatcatattctgggtgggactagggaaaattaaacattcagttgaagttcatttcctgtcttttcccaacaacattcgttcctagtcctacttactccattcttagagctaatttggtatgtttccagcctatatacctccagcctacatacgcgttcttttactggtacattttgcgtatatacgcctatgcctatagctttatctgtagagaagagatagaaaatgatatatgtgtttttattttaatgtaattaaacctatcagtcttttcccttataatttctacttttattgctatatctaagatagtctttcctatacaactattggtgtaggtatatccaagattaatctattaatctataatatttctaatattttatggtttcagtattttaacatacatttctaatagatctggaatttattttggtatattctatgaagaagttatctatgatttttaaaaacacaaaacacgccgggcatggtggctcatgcctgtaatccgaggactttgggaggctgaggcgggcggattatgagatcaggttcgagactgtcctggctaacacggtgaaaccccatctctactaaaaatacaaaaaattagccgggtgtggtggcaggcacctgtagtcccagctactcaggaggctgggccaggagaactgcttgaacccacccaggaggtggaggtggtagtgagctgagatcacatcactgcactccagcctgggtgacaaagtgagcctctatgtcaaaaacaaaacaaaacaaacaaaaagcccacaaaacatttgtcacattgatttgtggtgctatactgtgtccttatacttgatctgtttctggactctttttttttttttttttattttaataggtccatttgtttattgctgtgccaattctctactcttaattgagacaattttcctctcattttacttcttttagagttcttttaattgtgtttaaaaaaacttgtaacatgagatctacccttttaataaatttagaagcgtatagtacagtattggtaattataagtacaatgttgaaaagcagatctctagaactttttaattttgcatggttgaaactttatacccattggacagtaactcttcatttccttatcaccccagtccctggcaaccactattgtactttctgcttcaatgagtcggtctatgttagatacctcatataaatggaaccatgcagtatttgtcttttgtgactggcttgtttcacataacctaatgtcctcaagattcatccatattgtggcatgtgataggctttccttctttttaatggctccatagcatttcgttgtgtgtataccacatgttgtttatccattcatctgttgatggacattgggttgcttccatgtcttggctattgcaaacaatgagtgtgcagatatctctttgagatcctgatttcagttcttttggataaataccaagaagttggattgctggatcatatagtaattctatagtaattctatcttccttcacaattttttagctttttttcttttttttttctgagacagaatctcgctctgtcacccagcctggagtgcagtggcacgatctcagctgtcacctctgcctcccgggttcaagcaatactggtgcctcagcctcccgagtacctgggaccacaggcatgtgacaccacgtccagctagtttttttgtattttagtagagatggggttttgccatgttgcccaggctggtcttgaactcctgagctcaggaaatctacccaccttggcctcccaaagtgctaggattatagacatgagccaccacgcccggcctcctttggctcttataggtatttatgccactagatgaactttagaaacatttgttatgtttcaaaaatttttctttggggattttgatgggacttgctgtaaacttatagataaacttggagagaagtagcattttacagtattgagtctactcattcaggactatggttgtttcttcatttattcaagtatattttagaccccttagtaaagttttgtaacttaataatgagctttatttcttttcaggtctatacctacatctatgtactttttacttgtaatttcccttcttctctgtagtattctgaattaagtcaatggtggaaagtctaggagaccaattaaaccaaactgtactcataattgactcttccctattttcttggattcaaaacctttataacttggccaactatgttcatatgactttgttttctaggaatggagattctctcaggaggttccacaaatccttatgcaaggtttcttgggagttaccgccagtctgcctgacacacaagcaagtcagaatttcactcatgagcacttctttttttttttttttctgagatagagtcttgctctgctgcccaggctggagtgcagtggcacaatcttggcttacttcaacctccgcctccctggttcaagtgattctcctgctttggcctcccgagtagctgggattacaggcacgcaccatcacactcagctgatttttgtatttttggtagacgtggtttaggctcaagcagggtccctgctatgtaagttagaaaacagaataatataattgatatttagccaatttatttaaatttagcaatgataaaatttcagatataatactgagcttaaaagctatctcgacaaaaccttaaggtggaaaggcatgcatgtgtcaactgcttttcatataaacctgtctttttttttcatgcagtcattccaaagctaagcatttttgggtaacattggtctttgtgaagagcttagaagatgactctggatttgggaggctgaggcgggcagatcacctgaggttaggagttcaagaccaacctggccaacatggcaaaaccctgtctctactaaaaatacaaaagttaggtgtggtggtgggcgcctgtaatcccagctactcaggaggctgaggcaggagaattgcttgaacccaggaggtggaggttgcagcgagccgagattgtgccattgcactcctgggcaataagatcgaagctctgtctcaattaaaaaaaaaaaggtgactctggaataactggggaagatttgggatatttctaccacatttgcctatactttattgtgtggttttttttttgtttgtttgctttttaacatctagacctcaagaaacactcgttcagatgaagacaaagatggcaactgggatgcttggggcgactggagtgactgctcccggacctgtgggggaggagcatcatattctctgcggagatgtttgactggaaggttagtggtggcttcacttgctcctgcatgtggaatgtgccagtgcctctggatgggtggagaggagagataactttatatggctttggaatgtactgtgatgatggtgtaacgtttgctttgtctaaatattagtcaacctaggttaacatatttaagcagccatggtcccgttttcgtgggtgtggccatgttgcgcacaggacccaggagcactggacactttgggctttgaggaaaggaaatcctggcactttaagtcactggtttaaagttgtcaagagttggagcaagaggtcaagtcttctgagttctgcccttgggttgctgcaacttagtccagttcttgttcatctattctgagcaacccgtcgattaggaacatgatgcaagttctgttttcacattttagatatgtttatgttaaataatgtttgcaaaaatgtaaaatcagcttatttttaaaaatctgtaaatttgtaataagcctgtgcttatcattgtttttgagacacttcaaggtaatgctttatgggacagtttaattcccagtcaaggattttgcatcagctcttaggtaagagagagccccagattgatggaatctgatgtgctagtcttgtacaaaagaagattccaagattatgtcagtcatcttcagatttgggatattgttaggcaaaagagtaaattggcctttgccgattagcttcaagatacagagtagaaatgcagggagagcatattttggctggagtttggattttgttgaggtcactgttctaccatacattaaacagtgaccaagtatgtcctccagtttccttgagacattgcagagcagggcagatgagagattgtacatgtggcctttgagaagaaagactcaccggtctgctccaggaaggcctgggaaggttgctggaggtactgtggtagcattcccccagggcgagttctaactcagagcatggaagcttcagtaaagcattggagaactaaatccagggattattcttgcaaagagaatgtgttatgcctgcttccccatatttccaccttggtgagcagatataggccctggtattctgtgtcatgctgtgtagaagaatgatggggtatcatgttgttttgggatatatttattctgccaaggaggctgcaataggagagctacaccctgtgggcaaggggaggaggcttttttttttttttggagatggagtctcactcttgcccagactggagtgcagtggtgggatctgggctcactgaaacctctgtctcccaggttcacacaattcttctgcctcagcctcccaagtagctgggattacaggtgcctgccaccatgcctggctaatttttgtatttttaatagagatggggtttcaccatattggccaggctggtcttgaactcctgacctgaatgatccatctgcctcggcctcccaaagtgctgggattacaggcttgagccaccatgcccagccagggggcttcttatgtcaagggtgagttctttcccactgctggccagccacatgggggagaagtttccagcctgggaatgagtggggaagggagaactttgacatctctttctaaacctcaagtctcagaagtctgaataatttgcaattagtggtagggttagagtgggaaaggtgtgggatttatttgcattggtcttttttttttttctagtacgtacttgcgtttgttaaagagaatttagaggaatatattaaggaccatgaataaccactttcatcctattgtcatacaactaaaatgttcgcatatttatttattatttggttcatttttaaaatttctttgattttgcttggaacataattttgccaagtgatatatctccagaaggctgaaggtagggaagggcagttgttcaacttcttccatcttttctactcgtactcagaaggggagacttgggcaaaaggagaggaaagggaggcaggagagttcttggctttattgttgagagcaggtattggtgttctctgtttggcaagtgtcttaagctgactgttgtgagcactttgatggattttctgagaaattgcctttgccctcccaaattccttgggatttcttgcgtccaattcccttgaaatgtgctattcacaacactttggcttggtaatattgctctttcctcagctctgagactgctagacatgcccccagcttctccctatttacatgtgctaacccctctgtggccatcttggtaagttcctaagacaaccacatgctggcactcatgcacgtgcccacatctggttcacaggaaaccctcacgtaaactttgctaaacaaactcttcaagtccagggagccagtgctgcaacacctactctgcttacatgggctgctgcagctgttctctcagcccttaaatttctcaggtgtgaattaaacaccaagcaactgttggtgacacatattgaactcttcaagtggtatccttaaaatttcttcctcttgatttggggttagcagactgaagccctcatcccttctccttgatggtgcagaatgagaggtaggctcacagcacacctttctcaatgaaatcctcagaagttcttcctgtaagtctctggctccagaaccttttaattcccttgatgtgggtaaggagtttaactccagtgaattaaactaacacatatcctgccttcaaggttcttatatctaaggagacaaacaataaacaaacaatcaaattatatataattaaaaattatgtcactggccaggcacagtggctcacgcctgtaatcccagcactttgggaggccgaggcgggtggatcacctgagatcaggagtttgagaccagcctgaccaacatggagaaagcccatctctactaaaaatacaaaattagctgggcatggtggcacatgcctgtaattccagctactgaggaggctaaggcaggagaattgcttgaactcgggaggtggaggtttcagtgagctgagattgcgccattgcactccagcctgggcaataagggcgaaactccgtctcaaaaaaaaaaaattgtgttaagaaaatccataaaatggtcagggaagccctctgtgctggggcatgtttatgctgagatattactgctaagaagaaatcagttatgtgatgggaagggttatgagaccaaaaaagttcagatagtgggagcagcatatgtaagtatcctgaagcaggaaatgaaaacagccttttatgcctgcagaacaattagatgagagtgagcagaatggcagtcccctgctgactgccactgcagacagagccttggtgggcacagagtcagccagcatcccaccctgggctaacactgtgcagagaacagtggatcctaccccaccctgagcaaccactcctacttgtggggcacacagaaggcactcagacctgcatctgccagtgccccgcccctgagccaacaccacctccagcatgactgaacacacagtcaccaacaggggcctcctgcccacccctagctgcactgcctctgccattgtggtgaatgcctacagagaggcaggacccccggcacctggtagcactccaccgtagctgccactaccactgctgctgatatgtgcaaatgagtatggatcccactgtcatcaagctgtgaaatgctttggctgacatcagccatcagagtgtaatgaccggcagtccaaaaacattttggcccctgcagtgcagtggattcctaacatcaaggagccagagaacaaagttggggcccaatacaagtaccccagaattagaacatccagtccaggtattgggagctgagtgttggccccctaaaatctttcataaatgaagccagttggctgaatccaccttatactagaatcaagccctcaaggtcattaaaaaaataggataaaagaaacaaaattatgcaaaaagtcagcaacctcgaggattaaaggaagataagcccacaaagatgagaaagaatcagcacaagaaccctaacaactcaaaaagccagagcaccttctttccaacagatgaccaccttgcctctccagcaagtgttctgaaccaggttgagatggatgaagtgacagaaacagagttcagaatatggacagaaatgaagatccttgagctatagcagtatgttgaaacccagtccaaggaagctaaaaaccattataaaacaatactggaactggcagaccaaataactagtataggagtgtgtaactgaactgagagagctgaaaaacaccatacaagaatttcgtaatgcaatcacaagtattaatagcagaatagaccaagtggaggaaagaatctaagagcttgaagactggctttctgaaataagacagtcagacaagaatagagaaaaaagaatgaaaggaatgaacaaaacctttgagaaatatgagattatgtaaagagaccaaatccatgacttactggtgtccctgaaaaagagggggataatggaaccaacttggaaaacatgtttcaggatatcatccatgagaacttcatggatgaacccaactagctagacaggccaacattcaaattcaggaaatgcagagaaccccagtaaaatacttcccaagaagatcatcccaagagacatagccattagatcctccaaggctgaaatgagaaaaaatgttaaagacagagagaaaggtcaggtcacctacaaagggaagtccattgactaacagcagacttctcagctgaaaccttacaagcaagaagagattctgggccagtattcaacattcttaaaataaattccaacccagaatttcatatccagccaaattaagcttcataagtgaatgatgaatatgatcctttttagacaagcaaatgctgagataatttattaccatcagatctgccttataagagctcctgaaggaagcactaaatatggaaaggaaagaccattaccagccactacaaaaacatactgaagaatacagaccagtgacactataaagcaaccacataaacaagtctgcaaaataaccagctaacatcataatgacaggatcaaatccgtacatatcaatactaaccttgaatgtaagtgggctaaatgccccaattaaaagacacagagtagcaagctggataaagaaccaagacccattggtatgcttgtcttcaagagacccatctcacatgcagtgacacacataggctcaaataaagggatggagaaaaatctaccaaaaaaatggaaaacagaaaaaaagcagaggttgcaatcctggtttcacacaaaacagactttaaaccagaaaaatttaaaaagacgaagggtattacttaatggtaaagggttcaattcacaagaagaccgaactatcctaaatatatatgcacccaacacagcagcacccaaattcataaagcaaattcttagagaccttcaaagagatttagactccctcacagtaataataaaagactttaacaccccactgacaatactagacagatcatcaagacagaaaattaacaaagatattcaggacctgaactcagcactggatcaaatgaacctgatagacatctacagaactctctaccccaaaacaacagaatatacattcttctcatcaccacatggcacttactctaaaattgatcacacaattgaaagtaaaacactcctcagcaaaggcaaaagaactgaaatcataaaaaacaatctcggctgggtgcagtggctcatgcctgtaatcccagcactttgggaggccgaggtgggaggatcacaaggtcaggagatcgagaccatcctggctaacacaatgaaaccccgtctctactaaaaatacaaaaaattagccgggcgtggtggcaggtgcctgtagtcccagctactctggaggctgaggcaggagaatggtgtgaacctgggaggcagagcttgcagtgagccgagatcgcaacactgcactccagcctgggcaacagagcaagactccatctcaaaaaaaaaaaaaaaaaaaaaggaaaaacaatctctcagaccacagcacaatcaaattagaaaacaagactaaaaaaatcacttaaaaccatacaatcacatggaaattgaataacttgcttctgaatgactttggggtaaataatgaatttagggcagaaatcaagaagttatttgaaactaatgagaacaaagatacaacatgccagaatttctgggacacagctaaggcaatgttaagagggaaatttgtagcactaaatgcccacatcaaaaagttagaaagatctcaatttaacaacataacatcacaactaaaagaactagagaaccaagagcaaaccaatcccaaagctagcagagacaagaaataaatcagagctgaactgaaggagattgagagacaaaaaaaccattcgaaagatcaatgagccgggtgtagtggctcacgcctgtaatcctagagctttgggaggctgaggcgggtggatcccctgaggtcaggaattcaagaccagcctgaccaacatggtgaaaccctgtctctattaaaaatacaaaaattagctgggcatggtggcgggcacctgtaatgccagctacttgggaggctgaggcaggagaatcacttgaatccaggaggcagaggttgcagtgagccaagatcctgccattgcactgcagcctgggcgacaagagtgaaactccattaaaaaaaaaaaaaaacaaacttctcaataaagtaggtattcaaggaatatacatcaaaataataagagccatctatgacaaacccacagtcaacatcataccaagtgggtgaaagctggaagcattccccttgaataccagcacaagacaaagatgccctctctcactactcctattcaacatagtgctggaaattttggatgaggcaatcagacaagagaaagaaataaagatcatttaaataggaagagaagaagttaaactatccctgttggcagatgacatatcctatatctggaaaaccccatagtctcaggccaaaggctccctaagctgataacttcagcaaagtctcaggatacaaaatcaatgtgcaaaaatcattaacattcttatacaccaacagtcaagccaggagccaaatcaggaacacaatcccattgacagttgtcatacacacaaaataaaatacctaggaatacagctaaccagggaggtagaatatttctacaaggataactacaaaacaccacttgaagaaatcagagatgacacaagcaaatggaacaacatcctatgctcatggatagaaagaatcaatattgttaaaatggccatactgcccaaagcaatttatagattcaatgctatttctattcaagtaacattgaaattatttacagaactagaaaaaaaaaactattttaacatccatatggaaccaaaaaacagcctgaatagccaaggcagtcctaaacaaaaagaacaaagctggaggcatcatgccgcctgacttacagctatacttcagggctacagtaatcaaaacatcatgatactggtgcaaagatggacacatagactaatggaacaaaatagaaaacctagaaataaggccacacacctacaacttctgatcttgacaaacctgacaaaaaaacaagcaatggagaaaggatttcctattcaataattggtgctgggataaatgggtagtcatatgcagaagattgaaactggatcaattctatacatcatatacaaaaattaactcaagatggattaaatacttaaatgtaaaacccaatactatacaaaccctggaagacgataccattatggacattggaatgggcaaagattacatgaggaagacaccaaaagcagttgcaataaaagcaaaaattgaaaaatgacatctaattaaactagtaagtttctgcatagcaaaggaaactatcaatagagtgaacagacagcctatagaatgggagaaaaattttgcaaactatgtatctgacaaaggaacttaaatttacaagaaaaaaacaaacaactccattaaaaagtgggcaaaggacatgaacagacatttttcaagagaagacgtggccaaaagtcatacgagaaaaaagctcataattgatcattagagaaataaaaatcaaaaccacaatgcgataacatgtcacaccattcagactggctgttactaaaaagtcaataagtaacagatgctggtgagattgtggagaaaagggaacatttatacgctgttggtgggagtgtaaattagttcaacctttgtggaagacagtgtagtgactgctcagagacctaaaaacagaaataaccgttagacccaaaaatcccattactgggtatatatgcaaagtaatataaatcatttaattataaagacacttgcatgtatgtgttcactgcagcactattcacaatagcaaagacatggaatcaacctaaattcccatcacttaaagactggggtcaggtgtgctggctcatgcctgtaatcccagcactttgggaggctgaggtgggtggatcacttgaggtcaggagttccagaccagcccggcaaacatggtgaaaccacatctctactaaaaatacaaaaattagccgggcatggtgacgggtgcctgtaattccagctactcaggaggctcaagcaggagaatctcttgaacatgggaggtggatgttgcagtgagtagagatcatgtcactgtattccagccttggtgacagagtgagactcctcctcctcaaaaaacaaattgtaaactggataaagaaaatgtggtacatatgccctggaatactatgcagccataaaaaaatgagatcatgtcttgtgcaggaacatggatgaagctggaggccattatctttagcaaaccaatgcaggaacagaaaaccaaataccacatgtcatcacttaaaagtggaagctaaactatgagaacacatggacacatacaggggaacaacattcactgggacatattggagggtggaaggtgagaggaggtagaggatcaggaaaaataactaatgagtactagacttaatacttgggtgacaaaataatctgtccaacaaacccccatgggaaaagtttacctatataacaagcctgcacatgtacctctgaacttaaaataaaggttaaattataaaagaaagagcaatggatagcgtatatatatatatatattatatgtatatatacacacatatatattatatatacatatattatatatatacatattatatatacacatatatattatatatacatatatacgtatatattatatatatatactgtttagcgcaatatgttttctggagtttaaatgtatgtagaactttaaaaacatagaaacaataatataaaattcagaagagagtaaaattaatttaaagtgttcaaatgtccttgaattgttcagaaaaatgtaaaatagacaatttaccttcaacttttaaaagtctgggatgcacgttcaatttctaaggttaccattaaaagcaaaataaaacaatgtataactattcagatatcacaagggcaaatagaatcatgctaaaatacttgattgatccaaaagggttcaagaaaggagagaaaaaagaacatagtgcaattgtgacaaattctaaaacagtagatttgaaccccagaatatatatattttacattagatgtaaatggactaattactttggttaaaagacaaaagattgttaggctataaaacaaaatttatgtggtttactagagtcaaaccttaaatacaaggataccgaaagactgaaaataaaagcatggaaaaaagctataatgtgaaccaaaatgaaaagaaaattggtatacctatactaatatcagacaaagtagaatttaaaggaagaagcattagcagaaatagaggaatcatgaaaatatattaaaacatggggatacatctaaattcacccatatacggaagtttaatagccctgaatacacatattagaaaagaaaaattggttgaaaaaaaaaagtggtgcaagctgccatttaagaagttaaaaaaaaaggaagagcaaattttaaaagtatctgcatatatactctgtgtgtgtgtgtgtgtgtgtgtgtgtgtctccacattcctttacttcaaatatcagggatctggattagagtcaaagtttgatcaagtcccttgcaaattcagttatggctgcctgtgggaaaaatacccttcttctgcctaaagagttgctgctttagacctattgcagctttatgttattatggggactgaataggaagctgcagttgaaggcattcacaagaaaaaacattgcctttgtgtcagtgaatctcgttttttattattttgtggctttccttcatttggagatagtttctggagtgtctgcattttatttcatctctccagaataccctgtcccacgtaggcactgagtgttttacagggaccctcattgagtgagaccttatgtgcccttacacttttgtcttagactaactgcccctatgccactgattggcaggaattggctatatcatctgccactctaatgtagtgggaatttgtggattctcctgtggatctcttctttacttcaaaggcagacttctcctttatgtacagtgaatagtttatgtactctcttttaattcagtcttgcttaccctatgtatagcaataatcacctaaagtttctgccttgtgtataacttctgtgaatttccaggtacgatacagagttattcacttattaacatactatcatttcaatgggaatttgtaagggggaagttcaatatatacgctcagattacaatctctatttaaaatctttcctcctctctccattttccttaaatttttccctgaaattttacctctgctaatttggaaattatacacatatcttgtttttattttactgatattaaatatatacttaaaaaccacattttaataattattttataactatctctgtcattagtaatttcttttgatttctccttatgtaaaatgatgattacttaggcttttttttctttattcccatttcttgagtttattattagaatttgggattttatcttcagtttattggcagtttttttctttatatcttttctttcatggtagtcaaagcatggttgaaacttaattgtgtgtgtgtatacattatttcaacactcattgtctatcttaattgtgtgtgtgtgcacacaagcagcattatttcaatgctgattgtcaattgctgctttgagtccccatttcttcctttgagcattcagttcttcaggttgaatgatagctttgttggcagagatacattttgagctgtgcttctggaattttagtgtgcatatgaatcacctaggcatcttgttaaaatacaaactttgattcagtagatctggaatgaggcccaagagctttcatttctaacagattcccaggtgatgtcagtgctgcctgtccatggaccacacttcaagcagcaaaattttatagactttttaatttcaggaaaaagttgtaggtcttatactttatgagttcttatatatctgaaaatgactttttcttgctttcacacataaacagtgaatggcttatttgagtataaaattcctaagatacaaccttttccttttaagacttggtagttcctttcccataaagcttggtgtacggtgttgcttatagacctcccaggccagctggtttttttgtagataacctattttttagataacctgtctgcccataggagtctttattttttcccttaagttcaagagttttacaaggccatgtctagctgtcagtgtcataatatttattttaccctggcacatggtgaccaactttttggtacagatttagatccttctctatggtaggaagatttttcttctattatattattcactgttggttcttacccatttgttttggctttttcttcatgaataccagtaatttctgtctgtctttcacatttatcatgttctctttaattactttcctcttttttttttctttttctgtgcacgtaggggtgattttcaagctgtcatatgaactttttttctttttttgagacagtctcactctgtcacccaggcttgagtacagtggtgcgatctcagctcactgcaacctctgcctcctagattcaagtgattcttctgcctcagcctcccacgtaactgcagttacagacgtgtgccaccacacctggctgatttttgtttttagtagagatggggtttcaccatgttggccaggttggtctcaaactcctgacctcaagtgatctgcccgcctcagcctcccagagtgctgggattacaggtgtgcaccaccacatccacctaatttttgtgtttttagcagagatggagtttcaccatgttgaccaggctggtctcaaattcctgacctcaagtgatccacagtcctcagacttccaaagtgttgggattacaagcgttagccaccacgcctggtttgaactttttttctgatctgttaacttctagtggagttctttgtttatttttatgggtacataggtgtatatatttatgtgagatattttgatgcagtaatacaatgcataataatcacagcaaagtaaatggggtattcgtccctttaaggatttatcatttctttgtgttatatacattctaattatactcttttaggtattttaaaatgtacaataaatggttgttgactgtaatcaccctattgtgcaatcaaatactagatcttattcattctattgaactatgtttttgtacccaacctagtgacgttttaaatactgctatggcattatttattacctaatattctttccttcgcttcaaacctgccgcttttatgtgtctgttgttttaaccacctgcgtcttatcctgtatttttttgtctatttttagtgtgatatctggctaattcttacttattcttcaaggtcatgctcttttaggaagcctatcttgactggttaaactttggtcttcctgtgttgtgcttccattatagtactaaatggaatatagtactaaatggaatatagtacttgcatccattatagtactaaaattgttggcaaattaggacctgtttttgagaagggataatgacttcatcattccgagatctgacatagtttcttacatgtgatgaggacccaaatagcatttattgaaggagtaaataaatgagtgtgtgctcactatcgccttgcatcttttgccaatgctcttctttccgcctaaatcatccttttctccttgttctggttgacacatggttgatcataaaaatgccttttgagtcctcatttcttccttttgcattcattggcaattctcactctttactaggacaggggcgactcttctagtgtttccgtaggatctcatgaataccgttgtgagagtgtttattccgctgtattgttttatttttctgtttccacaattgagacaaaattttaggtggcatagatggtgtaattcatctctttatgctgtgcccacatgattattgatgtatggtataaatttaatacattttattccataaattaatagagaaatgaagtaatgtatttctgggttgataaaaaaactccatgactatagtatgggtctgtgggataggtaaggatgggtaattctatgaagaatattgaaaactatgttggggagtatggacttttaacaaatatttaaaaacatcatttttttcaacaatgtacatgtatatagtttaaagagccaaatgactcatgtaggcttgaggtgaaaaacaacagcctcttgattcccttcctcccatttcctcacccaccaggggcaactactgttaacaattctatctgattctcttggtgttttatccacatttctaaataacatgtttatattgctgcttcttgatctttcagttgtaggcactacgcattagagtcatactatagatgaagatttaacaatttttcacacctcctgctcctttctcttcctttctctctccccctccccctcctctttctcctttctcaacctctccctccagtctgtcttccagtcccataccccagagttttatataactttgactgggccaatatgcagtttttaaattattatgaaggcatattattattaatgccttcattaaactattatgaaggtatattattattataaagacatgttattaaattatgcctctatactattcacagctatgtcatgtaatatacagcaattattttccctttcctgagttttttttccactagagtcaataattaccttgcttttttatttgcttgttttcttagtttttacatgcttatcactaattcagaaaaatgtcatcattctaattttcacttcactaatttcattcacttttctaattttcattcactttaattttcttttagacccttcttctggagaattcttaacctttagctgagctacttgctgtctaacaagaaattcaggaggcatcttggaatctcatttttctgtcatcctgggagggtcatttacttctttcctgtgttagatctcctgtttcctaatcaccttcctttttcctcctcatttttatggatacattctccagaagcttcctgcttatctgaaaagatctttattttcttctcaaacttgaatgatgatttttccatatatatagttatgtagaaatgattttccctcagaaatttgaaggctttgctccatattctaacatcaagtaatgttactgagaaatctaaaggcatctggattgcctgctcttttttcctcctctctggatgcatgtagaaacatacattttcccccagtgttctgaaatttcctaacgttatgccttggtgtgggtctatgttcatttgttgtattggacactcagagagtccttcactataaaaactcattctcttcagtcctgaaatatttccttgatgatttcttctattcattttcctctattttcttttctttttttctttttgtttttttgagacagagtcttgctcttgtcacccacgctggagtgcagtggcttgatcttggctcactgcagcctccgcctcctgggttgaagcaactctcctgcctcagccagccaagtagctgtgactacaggcacgtgccaccatgcctggctaatttttgtattttttagtagagatggggtttcaccatgttggccaggttggtctcaaactcctgacctcaggtgatctgccagcctcagcctcccaaagtgttgggattacaggcatgagccaccacacccagccgtgttcctctgttttcttgttgaaactcccattattcagatattagatcttccagttttctctttgttcatttgccctgccttccaggagatttatctaaatttattttttcactctctttactaagtattttatctctttctatacatatattttttcctgagttattttttgttccttgaatttttaggaatagaattctgtccctgattcccagatgcagtatcttctgtttcatctctgagagtatgaatagacatttgggaggaaaatttttttcaccttgcatagtctcagttcctcccaaattgctgttttcttttaaattttttttttgtcactgtatttaaggttagaggtctttctgagatttctggtgatccttgtttgtttattcaagtttaaggaaaggagctatgagcttaactggagggagatgtggccagtacatctcattgcctgatgatgtctttaggtgttctattttgaaatgctttgatttcccagtgaaggcccttctgagtccaatattttaggaaccaagtgaggcagaaagctgggatctcagcattaaatacattaatttgtatttaatccctgttttcagtatagtactcttgcccttagttgtacccagttatctcttggtccagaaaattactgttttaccctctttagataataacatacagtcatgccaaagtaagggaggtcagctggaaatttaatctctttttaaacagactttcaatcagtcatactgttttgaccccaactttatcctgctttcaaaagtatctgatttaccacttctgaagtcttttgtgagttctgcagagctaattgagttgcttctaggaattccccactgccatcttaggatttacctttttctggggctgagaaatcaaaagatatccttaatatgaaataagtaatttaaataacaccataattattacagaaaattgaatttatagtataaaaactctctctcctcaatcttaaggcctagatggtttcactggcaaattctaccaagcatttaaaggagaatttacaacaattccatataatttcttccagaaaacagaagagaaggaatactttccaattcattttatggatctagtatgactttgataccaaaccatacaaagactatataaagaagaaaacaacaaaccaatatatctcatgaatatagaagtaaaaattattaatacaatcctgtcaaaagtattaagaaagatataaaaggaattatagaccataaccaaatggggtttattagaggaatgtaaggctgtttcagtatttgaaagtcaatcaatgtaatctagctaattaatagactaaggaagaaaaaatgtataggatcttatcaattgatacagaaaaaatatttgacaaagtcaccaattcatgaagaactctcagaaaaatagaaacagatatcagcttgataaaaaatttaagaacctttaactaatattgtatattataattgatggtgaaagactgaacactttccccctaaggtatagaataaggtagggttgtctgtctcaccactcttaccataggagaagaaaaatacaactgtctttatttgcagatgacatttttgtctacgtagaaaatcccaagaaatctacaaggtaacttctaaaactaacaagtgagtctggcaaggtcctggatacaaaataaaaatacagaaatcaattgtatttctcttactagtgatgagcacatagataacaaaatttaaaaatacagtgccattaataatcattcagaaaagttaaatgctaaggtgtaaatctaacagaacatgtataggacttgtacgcctaatactgcaatgtgctaatgaaagaggaaccctaataaaatacctaggaatacatttagccaaggaggtgaaagatctctacaatgaaaactgtaaaacaccgatgaaagaaatggaagaagacacaaataaatggaacaatattccacattcatagattggaaaaaataatattaaaatgttgatactacccaaagtgatctacagattcagtgtaatctctgtcaaaatctgtcacattcttcacagaaatagaaaaaaacaatcttaaaatttgtatggaaccataaaagacctcaaataaattaagcaatcttgatcaaaaagaacaaatccggaggcgttatactacctgacttcaaaatgtgctacaaagctgtagtaagcaaaacacaatggcaatggcataaaaacagacaggttgtccgatggaacagtatacagagctctgaaataagtccacacatttacagccaactgattttttacaaaggtgtcaagaacacagggaaaagacaattgtctcttcaataaatggtgttgggaaaactagatatccacatgaagaagaatgaaattatttcataccatatagaaaaatcaactaacgccaggcgcagtggctcacgcctgtaatcccaacactttgggaggccgaggcgggcagatcacgaggtcaggagatcgagaccatcctggctaacatggtgaaaccccatctctgctaaaagaatacaaaaaaattgccgggcatggtagcgggcgcctgtagtcccagctactcgggaggctgaggcaggagaatggcgtgaacccaggaggctgagcttactatgagctgagatgcgccactgcactccagcctgggcgacagagtgagactctgtctcaaaaaaaaaaaagaaaaagaaaaatcaactaaaaatagattaaaaattaaaatgtaagaaatttagcatccggaagaaacagaagaaaagctctatgacatttgtctgggaaatgattattttacacatgaccccaaaagccagaaaaatatggacaaatgggattacatcaaaccaaaatgcttctgtacaacaaaggaaacaatcaacagagagaagagataacctacagaatgggagaaagtatttgcaagctatgcatctgccatggggttaatatccaaaatatatgacaaactcagtagcaagaaaaaaataacctgattaaaaaatgggcaaaggacccaaatagacatttcttaaaagatatacataggatgaacatggaagacagtatttaagtgatgtaagccaaaagatatatgaacaaatgctcaacatcagtaattatcagggaaatgcaacctaaaccacaatgaggtatcatctcacacctgttaggatggctattaaaaaaacaaaagacaacaagtattggcaaggatgcagagaaaagggaacccttgcaccctgttggcgagaatgtaaattggtacagctactatgaaaaacagtataagcgttcctcaagatattaaaactagagatatcagttgggcttatgcctgtaatcccagcactttgggaggctgaggcgggtggagcaactgaggtcaggagttagagaccagcctggccaacatggcaaaaccctgtctctactaaagatacaaaattagccaggcatggtggcacatgcctgtaatcccagctactcaggaggctgaggcaggagaatcgcttgaacctgggagacagaggttgcagtgagtcgagattgtgccactgcacaccatgcacaccagcctgggcaacagagtgagactctgtctcaaaaaaaaaaaaaaaatcatatgatccagcagtctcactattggatatatatccaaaggaaatgaaatcaagatatcaaagagatatctgcacttccatgtttgttgcagtgttttcaaaatagccaaggtgtggaaacaactaagtgtctatcagtgaatgaatggttaaagaaaatggtatatatacacaatataatactattcagccatgaaaaatgaaggaaatcctattatttgtgacaatgtggatgaacatggaagacagtatttaagtgacgtaagtcaggcacaggaaggcaaataccacataatctcactcatatgtagacgctaaaaaagttgatctcgtagaaaaagagagtaaaaaggcagttgctaggggttaagatggttgaggaggggagttgaggacatgttggtggaaggatacaaaatttcagttaggtaagaggaataagtttaacagaactattgtgcaacagtgtcattgtagttaatatattgtattattgaaaattgctgagaccggatgttaagtattatcaccacaaaaataactgtgagataatggatatgttagtttgatttagtcattccacagtgtatagatacttgaaaacatcacatattgtacacgataaatacatacaattttatctgttggtgtgttgttgttgttgttgttgttgttgttgttgtttgagatgaagtctcgctttgttgcccaggctggagtgcagtggtgcgatctctgctcactgcagcctccgcctcccaggttcaagcgattctccttcctctacctcccgagtagctgggattacaggcatgcgccactatgcctggctaatttttgtacttttggtagagatggggtttcaccatgttggagaggctagtcttgaattcctgacctcaagtgatctgcctgcctcagcctcccaaagtgctgggattatgggtatgtatctgttgatttttaaaagatattttaaaagaatagagtgggaggaatcagcttacttaatatcaagatttactatatggctgcagtaatgagagcagtggtattggcagaggaataaacaaatgagatcaacgggagaaaatatttgaaaatcacctaacaaaggactagtatctctattaagaactctcaaatatcaacaattaaaaatcaaacattctaattagaaaatgaacaaaggacacgaatggatattttacccaagagaatacatagatggcaaataagcacacaaaagtatgttcaacactactggctattaaggaaatgcaaattaaaactgcaataagatatcattacctacctatcagaatagctttcaaaaggttcacaacaagaaatactggcaaggatgcagaggaagagtgttactcatacattggttctgagaatgtaaaatgatacagccattctggaaaataggcagtttcttttaaaaaaataaacatgcaactaccatacaactcagcaattgcactcctgggcatttttctcagataaatgaagacttaggttcacaataaaacctgtacatgaatgtttatgccagttttactcacagtggccaaaaggtggaaacaatcccaatgccctttagtgggtgaatcattaaacaaatggtgttacatccataccagggagtgctacacagccgtaaatggaaatgaaccattgataaacacaacaatctggatgaatctccagaaaattacaatgaagttataaaaatccaatctctaaagcttacatactgtatttcacttatgtaatattcttgaaatgacagaaattatagaaatggagaacagtagttgctaggtgttaaggaagaggatagggtgggggggaggagatgcagctataaaaggcaacttgcaggattcttgtgatgatagaaatgttctgtacattacctgtattaatatcagtctcctagttgtattcttgtagcagagttttgcaagatgatacctttgagggatccatggggtctctttttattattttcctacaaatgcatgtgatttacaattattattattattatttgagatggagtctcactccgttgtccaggcttgagtacagcggcacaatctcggctcactgcaacctctgcctcctgtattcaagcaattctcccacctcagcctcccaagtagctgggattacaggtgcacgccaccatgcccggctaattttttgtatttttagtggagacagcgtgtcaccatgctggccaggctggtctcgaactcctgacctcaagtgatccacctgccttgtcctcccaaagtgctgggattacaggtgtgaaccaccgtgcccagccgatctacatttattttaaatagaagatttaatttaattttaaaaaactagaaatgccaggcaaaataggacacacatttaaaacaacaacaacaacaacaacagcagcagcaacaacaacaacaacaacaacaacagaactaaagttgaacctacaagaaattaagggaaatccatggggccaaaaagcaaagagtaaactgaatgccagactagtaagtgcataactgattctgtgcctgccctagtgatggagatgggatttgatcatctcaaaaactcaggctgttgagttttaattccttcataatcacagatcaagtcttgagtgtatgcgagttcacaccatgggaactgcaaccctaagataaaggcaagacccttgaggtccagacacttaacagaaggactagggggaaaatgtccacacaccagcatagggaatttaagtatcttagtcttaattccatatgaaaaaaaaattccacgttggaacagtggacctgttctctcaaaatttggaagtgcatgtatattggcctatacatattatatatattacattgaatacatatatcctatatgattgtggaaacatttacgtgggaaattaatatgaaaattgatcttgtagcctgtgatatccttaaggtatggcagcaatgaaagatttgagagtcaggccaccaaccggctgcataggattcctgtcgatagagccctgctaatgacaaacttgcaatcctaaaatatgtaacacacaaggaaatacttgcgaggagtaagcaccagcaggcacaacattgatgatataagagagaaaagccatacagttatctatattgatgcaaaagtagcagttaataaaatgaatacttactctcaattgaaaaatattagcaaactaggaataaaggtatactctcaatgtacagtagataatcttgatagtaaaaatgttaccacattcaccttaacattaggtgtgagataagaatgcccactgtcattgcttgtattcattattgtatttgaggtcctagtcagtgtagtaaggctagaaaaaaaatgaaatagaaggataactctcattattcagagactactaaattgtgcagatagaaaaatccaagagtacttgtacataaaataataaaactaataaaataattcagtaaagattgctggaagcaaattaatgcacaaatgactgtgctcttacacagtaccaaaaactaaatagaaagcaaaatttcaaaaggcagtactagtaaaatatatggtatgttgtaataagttcaataaaaaatgtgtaagacctttatggaagatttagatgcttacctaaataaaaggagagctataatatgttcatatataggaaatctcaacatcataaacataccaattttcccctatgttaatctataagcataatttcaattctaagtatcatataggagtgcaaagaaatgaaaataattttgaaaaagaacaaaataggggacttgcctggacaattaaaatgtttcttttaactatactagtggcataggcgggagtagcaagtgtggcaaaattgagagcccagaaacagatatatgcgtatgtggaagtttggtatatattgaaagtggccctgtaaatcagtgcaggaaagagggatagtcaatacatggtgctcagatatgattatcgatagtcagaggaaaacattagaacatatcaattcatgtaaagaataaattccaagtgcattaatctctacttgtaaaaaacaatgtctggaaacatttagaaagaaatatagaagaatatctttgtgatttctagagagtgaaatattcgctaactaagatacaaaaagtttgagttacaaaggaaaatacggataaattcaagcacaataaaaaatacacatctgtatcacaaaaatataaacctaaagaaaagccatagagtggaataaaatcttgacaatgaatataaccaataaaggactagtatttgaaatattaagtaacttttacttaccaataaaatagaagcaaaaagaggctagtagaaaagtgggcaaagaatatgaacaggaaattcatagaaggtgaatctgcatagtaaaaaacaaatgagaattataatttcactgacaaaaaactgaaaaagcatatgaaatgaggctgggtgtggtggcttacacctgtaatcccagcactttgggaggccacgatgcgcggatcacttgcggtcaggagtttgagaccagcaagacgaaaccccatttctaaaaatacaaaaattagcctggtgtggtagcacatgcctgtaatcccagctactcggaaggctgagacacaagaatcgcttgagcccaggaggcggaggttgcagtgagccaagattgcaccactgcactccagcctatgtgagagagcaaaactctgtctaccccaaaaagaaaaaaagaatatgaaatgacatatttcacattcttcatattgggaaaaaaaagttttaaaatgtcaaatattgacctagatgtataaaaataagaaccttcctgcactggtaatgagggtgaaaactggtatgtccatgttagagagcaatttgtcaatatctggtaatagtgatgctgtaaacacccagaagagaacaaccccgctcaggtatatatcccagagaaatgcgtaaatatgcctaacatggtggtttaagattgctcattgcagaactgtgggtgcagtttaaaatttgaaaccaactgccaaatgaagatttggaacaattttcatcaacatttaggaaaattgatcaatgaagaataaagagaattgatcaataaattttggtatatttataaatgggattcctacagatctctaaaagtgaatgaattagagttacatctgttaacgtggatattctcaaaaacagttttcagagaaaaaaaaactgcagaaggtttttggcacaatatgattccatgtactcagttacctctcctatttctgatgtagtatttgcttaactttttcatttcttaggactaatatagcattctttagtctatttctacacaaaccttagcctacattctgaaatttgcttgtaggcctgagaatctccaaatttgcctgctccctgagctcatctaatttaaacaggtatctgagggtagaaaacatcctaaatcaaatgtgtatatatgtatttgtgcatatatgtgcataaattgagagaataatagtttctgtggtgtttcagaagtaagacaagtgcatgtcattgcatgtgctctcccagcttggttcctggcatggggtcaggcctgtggcacacccactttttccatgtctaagaaacagggacaggctgggtgtggtggctcacgcctgtaatcccagcactttgggaggccgaggcgggcggatcacgaggtcaggagttcaagaccagcctgaccaacatggtgaaaccccgtctctactaaaaatacaaaaattagccaggcgtggtcagtgcatgcctgtaatcccagctactcaggaggctgaggcaggggaatcgcttgaaactgggaggcagaggttgcagggagctgagatcgcgccattgcactccagcctgagcgacagagtgggactccgtctcaaaaaaaaaaaaaaaaaacaaaaaaaaaggacaataacaccactttttggctataatgaaattagattaattcaaaagcatggtagcaggttctttaataagattatttcggaagcatggtagcaggttctttaataattcactcattcctgctccccacattttaggcagctgtaaaccttaatcattcctcacccattcccatattaagaactttcactgtcattttggaagtactctgagatttttaagaaggaaacctacttcccttggaatgcttatcaggtctctttatccttgaactgccttagagacttattaagtcttcataaatattgaatgcttgtggtcagtttttcttggaagaggaatatggaggtgattacatataaaaccaaactgaaagccatcccaaagctttagaaagcatttcagtgccttccctttttatcagtgtactccttcaaattcatgatttagggcattcatgatttaggaaaatagcaaatgtagctattttcctcatatatttcttgtggataaagttatttcagaatttgattactttaaatagtcagttcttttgcactgcaaaccatatgccagccagaatgtccctttctcttgcagaagtgtgtaacttgatattctagttaagtgccaatcatgggaaacacaggtttaagttaactactattttaaaaattaatatatttttattcttcaaaacacatacttctcaggctttatgacaccattatttgagtcaatatatcatcaaatgaatataataaattatagtgctatgaactccagggaaattttattaatgtttttaatatatcctcatgtggaatcaacatatgttttttatatattcataaatttatgacttcaaaactcttcaatacagggtgttacgaatgttgtaatggatagaaaatacataattgtgaaatgatgttcttgaattttcaaatactcctgataaccattagctcttgcatatactaattacactgaaattaaaaacttgtaagtaatatttctgcagcttagttgctttggcccaaaggaattattccagaataagctggcaggttcctgcttggggaattaggattccaatgtccttaactttaaaataacttgcatttcattttatgtctgtttcataaagtagtctttcattttcatactaaattgtaaccaaagcaagccacatcaatagaggccagtcactggatttactgtgtattaggttggacaaagtaaaatagaatgttaaaaatggtcgccaggtggttgggtttaaaaataaaaacgttgctactgacttataaaggaaactgagaagtaatctccctgaatctttatatccatatcctggtacatagtaggttcaccataagacattgttgaaggaagaatgagtccaaaatggtgcattatgttttgaaaattcgtgacataaaatgctctctttttcatatcaccatgctgcaattgtagtgggatttgtaggagagttgtacatactttttaggtttatattttcaggctcaacactcaagatgcaaatcagtgactcctggaaactcagcttacaattaggacacagcaggtggcaatggagtgtagaccattgctctacacatggtctacactgaaggcctgagacacagccataagatacctttgatatattcttttcttaccttttagttttaagtttctttttacaagaacagtttttaatataaatagctaaaattaagcaactactaaaaatgcatctgaaaaattatttctgaaaatgtttaaagaaaatgccatttttattaagtttcaacaagttttgtattccagtattgccatcaattcaaatattttttttaacctgtgactctctaatttgcttgttcccttgaaattagcatcaaaagctttttacagctgcaagtcagcatggtacaaaaagctttttggttatcacttccctaatctgttagcaacttccctcaactggggcttttccaaaataagagagtaatttcaattacttcttcacttttcctattatttattttcttcttttgttcatacgtaaaaagcaaaatgaagtaggccatgtaagtgaatgaccttttcaataggcatagctgttgtttcccagtagaatggagtcatttccccttgaccaagagaaagacttctccacaccagtacatttttttctaccatcctcccagtttggtgctgcttgaatgtttaaaatttgacgtactcttagcaagattttaataaatttaagaatcaaatacctataacaaaattttaaaaacagaaatatgcagtgttacaaaatattaagacatggccaacccattgtgataatctgggaagatgttctgaaccacaaatcaagaaagcgcatctacctaaatacgatttaactacaaattaggtaacgcttttggaggcagctataatgctgttcttttcactccaaaatgtccttctcccaaagccttctaaatctaattagggattgtaccacctcaaaaacacaagctgtgaggagacaaggggtacaagttgcagttggaacagaaagtttaaggtgaagatggcatgaaatggaaatggaggagggagagtttgagaaaaactgcaaaggaaaaagagtggaagttaatattaaaaatgtactggacacaataaaatgcaaaataaccactacagaaaactaaaatctgtagtgtggaggaatatctgtagaatatttctcataagcacaagaaaaggtcaatgaaattttatatatataaatatataaatataaatatatatatatatatatatatatatatatatatatatatatatgtatgtatgaggaaatcatagatggaccaatgaagaactaatagatgcagagagagggagctccagcctcagaattataggcatttatggcacaagagcagtaatcaaaatcataatctgaaaataatcagcagcattgtaaataaagaccttgagtattccattcaaaaaggctcaccattttcagtaaagactgatgaaacacacgactggatacatcctgattataacttaacttttatatcaagtactaacacaacaaaacaaaagtactataagctttcaggaagaaacataaaacacacaagcaaaggaataatcagatttctcctctgcaagtctcaatatcaagggtcaatgaagtgtgtttacagctttgaggaaaaagaagtaacatcatatcatgcagcattgcctttcctgtatgaaatgcaaagatttaatcataagccagccatgcatccaactaattaaataatacttaaccagccaagagttaaaaactcatacgtgaaaaattcatattatgaaaggactgggatttgttttaaaatacttctaaatatgtattgtaagtatggacaaaaatgaaaacctaaagatgtttaccgaataatttttatattatataaaaataatggactcagaaatcccacttctaggtatttacccaagagaaatgaaaaactttgttaccataaaacctgcatgtgaatgtttatagcattttttcatacttacccaaaactaaaaacaaatatctagctggtgaatgaataaacaaacagttgtacatatgtgcaatagaatgccagccggcaattaaaaaggtgcaaactatagatacctgcaaccacaagaatgattttcaagtatattatgctaaaaagagtcagtctcaaaaagctacatatgctgggattccatttatataacattttggaaatggcaaattgtagggacaaaaccaaccagtggttgccaggagctgagggtgggggaagaggttgactatacaggggcaacctgagagcatttttggggtgatggaactgttccaaatattggttgtggtagtggttgcacaattgtatgggtttgtcaaaactcttaaaattgtatacatcccaaatagaattttaatatatgtcagtttttaagtagggaaaaggagaagcaacataatcaggaaaggtaatatcggcatagcaatgtgaacatacttaaacactgaaccacacactaaaaagtggttaggatggtaaattttatgttatgtgtattttgtcacaatttttaaaattttaaatttaaagctaccaaaataatgcttgtataatggactatgatgtaatcattaaaataatttttccaaagaattatcattgaaatgagaaaatgcttatcatattagattaggatgaattaacagtatgattttcaatcctataaatggcagaaacagtggaggattaaatgacaaaagaataaagttattggtgataggattttgagtgactacctctatacttcttggcacattactggtttccacttactccttttgtaatcaagaaaaatggaagcatcagaaagcatatgcaatgagttttacattgctgactctatcagtcatttcatataggctcatatttaaatcatactggcaaaaaaatgacctcctatccactttaaaattatttttattcccatagaaataaatattttaataacaattgaaatagtatctgttgacttttaattcaaaatgattatttaagcctgtgtttagctttcctggctccaaatttgccattgaattcaccaggaaaacataaagggaaaaaatatgtaactccattgaaaaattaggaaaagtgccatgaagagatcagatatttttaaggagtttatgtaaaatatagacagacaagcactggactgaggagagtacccgttggatggaattccagtctcccaaaggaaaactctgcctggaaaatgagtggcagggtcgcagagctagtggctgtagaggaagataggttatgtggtggtcatccctggaaaattctcaaacttaccagtattagcatcccaaaaatactgttccaacatgacttggtagaatcccatttggtaaggtcagtggttgaaacaaaatagaccggctgcagtagctcacgcctgtaatcccagcactttgggaggctggggcaggtggactgcttgaggccaggagtgtgaaaccagcctagccaacatggtgtaaccccgtctctaataaaaatacaaaaattagccaggcacgggggtgtgcgcctgcaatcctagctactctggaggctgaggctggagaattgcttgaacctgggagatggagattgcagtgagccgagatcaagccattgcactccagcctgggcgacagagtgagactctgtctcaaaaaaaaaaggaagcattacttcaagcaaatttctaacaaagactgttgtactaattaaaggaagacagtgagtgccctgctaacttgagttgcttcagtaagggaagagaaatgtcctagtggagacgtgctacacaaattcttctacatgtagcatttcccttttcattatagaaaagaatacacatatgcacacatgagacacacacatattgtacattaattgtagtggttatatggacccttgggtaagaattgcatgtgagtactactattaactaaagaattcattctttatttaatgtgacacttccacaagactttttggctcccgatccttgaaaattagtttcttagaattaaactttgaatctttggggtaatgtgcactagtaaaagttttacagggaaccaatgccttgtatttgctttttttttttttttttaatgcttgcctcttctatgaaatcattatttcttctttcttctttcttttttcctttaggaattgtgaagggcagaacattcggtacaagacatgcagcaatcatgtaagtcataaaataaaattattttatccaatacaatatgtgcttgttttaagttacaatattccaatgtgtactctaaaactgatggtctcttaataccctttgtggaaaacttaagtatttctttaattgacaacagattttgtatatcaaatatcttccatttatactaccttttaaggccatatcacattcatgatctaatttggtaagtatttaataatttctgaagtcatagaaacaatataatatctgcaagctccttcaaagttcagaatgcttttatgttcattatcttacctgaccttcacactgtctctgggcaggtgaggtgcagctatttctcttttgcgagtgagaggactgaggctgaccgaggtaaaattattttttgaaggtcacataggaagagtagacttacttgaactggtctgttgttatttctacctcagtgtcatggaatgctataggtgacccatcagcaaatcacacagaaatatacaaaaccctacccttattttacatcagtcaacactaaaaataaaaattcaaatatcttgctttagaaatttgaaaataaggccaggcgcattggctcatgcctgtaatcctagcactttgggaggccaaggcaggcagatcactttaggttaaaagttcgagaccaacctggccaatgtggtgaaatcccatctctactaaaaatacaaacttagctgggcttggtgatgtgtgcctgtagtcccagctactttagaggctgaggaaggagaattgcttgaacccaggaggtgaagcttgcagtgagccaagatcgcgccactgcactccagcctgggcaacagagtgagactctgtctcaaaaaaaaaaaaataaataaataaattgaaaataaaaaataaacaccagaaggaatccattctattttccattcaaaacatttcctggttatcagtaagaggctaactagaggtacttgacacttgcctcttcatacacaaaaagaccaaaacaacaaataaacaactacaattagactagagtgtctgagggagagcactggaatatagcaagggaatagcagaatgcctgtggcacacagtaactcaagatggcagcatagggaggagggcgaagtactctgcctctactactccatctcccctgtaaggtaagcagggagcccctagtagcccctattaccactgcagacacatgtagtccttgctacaggagaacgcggcagtcctcacaggccctgagcccagtttgggggagctgcctggagttcccacagctgcattgcttcacagtaggagctcacattgtgcactgcccacctcccatgacccaggctgttatggcacagtgccaccttgaaactggagccactgctagagtgtgctgtactctaggggacagtaaccactgatctttccatcccacagatgactgcagcaccacaaccctagctatttagaccctaggcctggtgaaatggtggtgactcttgcatccaagtccacatggcacccttccctgcaaggaacaggtcctgcacagttgtgcatgtacctccagcttaagaaccagcctggtggccctttctctggcaaaggtgcaccactactgccctaaactcctgcagcctaggctattgaagcactcacagatattactacatggattacagctgatgaaactgtgtgtagacccaactactgtgtccacccagaaccaatgtgaattcacactactcaactgacaccctaggacacatctttagggaaaagtctttccttataaaagctactctgtaaaattggaagcaaaaacgaattcagcagatgcacagatatcaaagtagatacacaaggctgggtgtggtggctcatgtctgtaatcccagcactttgggaggctggggtgggcaggtaacttgaagtcaggagtttaagacaagcctggccaacatggtgaaactctgtctctacgaaaaatacaaaaatcagccaggtgtggtggcactcacctgtaatcccagctacttgggaggtgaggcaggagaattgcttgaacctgagaggtggaggttgcagtgagctgagatcacaccactgcactccagcctgggtgacagaaccagattccatctcaaacaagcaagcaaaaaacaaaacaaagtagatacacaagaaactttagaaagcaaagaaacatgacaccttcaaaggaatataattcttgagtaacaaactccaaagaaaaggaaacttacaaaatgccagaaaaagaattcaaagtagtgatcttagggaaacttgtgagatacagaagaacacagataaaaaatttaatgaaatcatttgaatttacaatagctatatttacaagagctacaaaaaagtaagatattcaggaataaatttaaccaagaaggtaaaagatctttgcattaaaaattataaagcattaatggccgggcatggtggctcacgcctgtaatcccagcactttgggaggctgaggcaggtggatcacgaggtcaggaattcaaaaactagcctggccaacatagtgaaactccatctctactaaaaatacaaaaaattagctgggtgtggtggtgggcaatcgtaatcccagctacttgggaggctgaggcaggagaatcactcgaacccgggaggtgggagttgcagtgagctgaggttgtgccattgcactccagcctaggtgacagtgcgagactgtctcaataaataaataaatcaaaacagtaatgaaataaagagggtgcaaaaagaggtgttcatggattggaaaaattcatattgttaaaatgtccttactatccaaagtgatatacagatttaatacaatccctgttaaaattccagtgacattcttcacagaaaaaaagaaatcctaaaacttgtatagaatcacaaaaagactctgaacacccaaagcaatcttgattaaaaacaaacaaacacacaaaaaacaaaactggaggcatcacactacctgacttcaaaatatatgacaaagtgatagtaactaaaacagcatgacattggtgaaaaaatacacatagatcagtggcacagattagagagtccagaaataagtccacatacctacagccaactgattttcacaagggtgccaagaatacacactggggaaaggacagtgtcttcaataaactgtgctgggaaaattggatatctatatgcagaagaataaaactggacccctatctctcaccgtgtacaaaatccactaaaaatgaagtaaagacttaaatgtaagacttgaaaataagaaactgatagaagaaaacagagaaaatgcttcatgacgttggactgggtaaggatttttaaaatatgacctcaaaagcacagacaataaaagcaaaaatagacaaatgggattatattaaactacaaagcttacgtacatcgaaggaaacaagagtaaagagataacctgaagaatgggagaaaatatttgcaaactagacagctggacacggaaatatttagaatatataaggaattcaaacaactcaatagcaaagaaacccaaaacaaataatttgatttaaaaatgggcaaaaggccttaatggacatttctcaatagaaaacataaataccaacccaggtgtatgaaaaaatgcttaacatcactaatcatcagagaaatacaaatcaaaaccactatatcacctcattccacttaaaatgattattatcacaaagacaaaagacacaagtgttcctgaggatgtggagaaaagggaacccttattgctattagtgggaatgtaaattagttcagtgtttgtggaaaatagtatggagttcctcaaaatttaaaaaatagaactacaatatgatccagcaatcccattactgattatatattcagaggaaatgaaatcagtatatcacagagacatcctcactcacgtgtttattgtagcactattcacaatagccaaggtatggaatcaacttaaatgtccaacagtgaatgaatggttaaagaaaatgtggtatatatacacaatgaaatactatgcagccgtaaaaagaaggaaatgctgtcatttgtgacatggatgaatctagaggatattatgttaagtgaaataatccaggcacagaaagacaaataccacataatctcattcatacgtggaatccaaaaaaaaaaaaaaaacaacttgatatcttaaaagtaggcaataaaccagtggttaccagagactggggaggacagggggcaggtagagattgggagaggttagtcaagaaagttacaactaggaaggaaggatgatttttggtgtcctgttgcacagtggagtagctatagtaaacagcaagacattgtatatctcaatttagccagaagagaggatctcgaatgttcccaccacaaagaaatgataaatttttgaggtggtgaacatgctaatgaccctaatttgttcattatataatgtatacatgtattgaaacatcacgttgtaccccataaatatgtgcaatttgtggagccctaaggagttgaaagaaaactgaaaaatgggcttagctggcagaaacagaaatagggggtagagaggaacaaatgttctgagaaatagggtcaactgcaaatggctcactagcacccaagcatcctgttacaagcatccaaatcacagcccacctgcaccaagcatcctgtctgcaaacattcagcccaagtagcacaacctaaaaaactcccttgcagtccctgcctctttgcagacagcagacagccttccctctgctgtattgcccattgctcactggcagtgtatctccccttttctttaaatagatctgcctttccagactcgttactgtcttggtaaattcctttactgactatgtgtcggccccaggcaatcactaaccatgacattttatgtgtttattaaaagttttaaaaacatttccctcattggtggtatagacccaaatcaaaatgacaggaattaaaaggaaattctgaaaatcaggagatctcatttcaaatgagattgatttatttttatccacttttctcaattggctgtaactaatttattttaaaagatcaattactggagctttgtctgtctttctcccttctctgtcccaagccagtgtgagacatcagtcctgggtaagggtttctaatctgtggatcaagttttttcttggtgggtaggcccccgagttctatgggagtagaaagctggcagtctttagcaacaccttttgactgagagctcaagccatatttgcagtccatttctatcaacgatgaagctgacatttctatctgtatctctccactggttccaaacttgaatgggaaaaaatgggtgcctatttactggggcactcaaactcaaatatcacttagccagaagtaaccagatttttatcaaccgagtcctcagagggattttggagcacgatgcaaatgcttcacatctctggtgatttgaattgaatcacacttgatgttgagcaacacacctgcttgtgaatgctgaattaacattcattcattgtgaatgctggaagtccagatggggcatgtaggagggagagagagagactgaacacaaaggcaagtatgtcagtgccaacgtagtctagccttccttttaaacaagcatgtgggtgcattagcaacctcagagttctaccacctttttcatgggtgcattagttgtttttattgttgtggtaacatattactataaatatagtggcttaaaacaagacaaatgtattatcttacggttctgaaggcccgaagtctgacacaggtcctactgggctaaaactaacatataggcagggctacatcattctggaggcctagggaaaaattaatttcctttttttcccagcttctagaggccacccatattccttggcttgtgattccttcttcagtcttcaaagccagcaatgctgcatctgtttgaacatttttctttttcttttatttttcttttgagactgagtctcactctatcacccaggctggggtacagtggcacgatctcagctcactgaaacctctgcctcccgggttcaagcgattctcctgcctcagcctcctgagcagctgggattacagatgctaaccagaatgcccagctaatttttgtatttttagtagaaacagggtttcaccatattggccaggctggtcttgaactcctgacctcaagtgatccgcccacttcggcctcccaaagtgctgggattacaggcatgagccaccgcacccagactgaacatttttctgtagtcatatcttcctgtgaccacagctgggcattgttctcccacctggataatcctagataatttctccgtctcgaggtctctaactttagttatatgtgcaaagatccttttgccatgtaagataacatagtcgcaggttccaggggttaggtcatggacatcttgtgggccaaggtggtgcattattttgcccaacacaatgggatagctaaagttttctttggtctgacaatttccttgtagtcattcaagaacaaatttcaaaacagtatgatttccagcaataatttgtgaaactatttaaaacaattcattttaaaccccagatcaaggtgttacattttgggatctcattctagagtttctctgtgtgtgtatcactctgctctagctaattccaaaaaggaacctattatcaacacaagtgttagagtattatgccacatagtacagacataaaatgtaatctgctaaaattatgcacatgaggtgcaatggttaggactttggtatactcgagtgaagatatgatgcccctgaagctctctgggccttgggggttacctgtggtctctaatttatggtccctctgggagaatgcggcagaaatgtttctaggttggtaagaaatagatgcttggggtagagtaggaaggaggtggagaagcaaatgctgccctttttagttctcagagttggaatccttagagagtcctaagagaggtttcataagaatatagcatcagttgctatgcttgtcattgcaaactcagaatttccaacaaaattccttatttgtaaaataagggaaggttgtggcagtggaagtgtccagagcatccctttgtctccacgtgccacagtatctgcagctgtgcacgcccaagctgtgttgcaaaccagaggtgcataaatgcagccccagcttcagtgttgataatctgtaagagtccattcctgcacaggagagattatgcaagtatattcctgaatatactatagaaacattgcaaacatgttgagtgccataagtggatgtaaccacaatgaacttggagtatgaatatggttgtatctttttttccatgtaattacttgaactgcttcctgctttattaattgggggctcaaaatatccacctcaccatagcaggagtggggaccagtctgcaacccaccccacctcaagtgggagaggaccaagttctgatgagcatccccctgctgttacttctcactgccttcccactgccattcaatgccttactgaagactggccacactagttcagtggttagtggagttcattttacctggaaatggggatggtcattcactcttttgaaggaagttgcctttagtgattctaagatgaggagttcttttgagggatacttgccccctgattcaaacatgcctacacctatacttccaggaccgtaaaagccctgtattaagggacggcagggtcttttcagtcccatccaagagatgtcatcatcaatggccaaactcagtctctatcagagtagtctgctgtatggagaaggaggtgtttctgttagtgagccttggagatctaacactggatcatattccagagattgctaaaagttctgtttctccatgggaatgcctgaaggctcaggctgtcagccttaagaccatgggttgttgtctatacgtgttgacttcctcacacttaactgaaatagtaataataatagtagctcatacttattaagtacttcctgaatgctaggcattattctaagtgccatttcatgtataaattaatgtaatcctcacactaaccctgagaagtacgtgctatttttatttccacatttacagaggagatttaagtaacctgcccaaggtcacagaaccgaatttaacctcagacagtcaggtttcggtgagtgcacacctaaccactctactacactgtacaagagtatggaaaggctgtaacctttgtcagataataaaatgatggtgcagacagcagtagctaaagcatggtagcttttagcaacacgtgagcacaagaattgctgtggttttggagacacattatacttccagataccattgtagaaaatctaactgtggaacagtaggtcagaccttctaaataatcttagttggcaagggccagagatcagggaagagcagggaattaactgaaagagacgcaactgaagggagtcagagaaaggaaatcctccatggctattcgttttccactactccagcagcctggggtggatccctagcataggggaggatctgacttaacgaggacagactctgacagttgcatttcagaattctacccacctcagcagaagacactaaagaaaaaaaaattcagtcactcaagaaaagatcaaatgttcttttgttatgaaatctagttgtaatagggacatgcattcacagcacatagatgaagatgaagaaattccactcctggtgtgcaggagatcatgcctcaaatggcaggagcggaagacatatccaggccacgaggaccacaccactctccctgacaattcagactttggttcagtggctctcctcaggttcactctgtcaggggagatggggatttgggctttgggcctgaaagattatggaacagaacatgcctgggtacagtgccatggctcctgggtgactgctgtcttcagacataacctgctgatcagcacttagcatatatctttatagccagagactggcccctgagccctagataaagaattatccttatcaggggtattttggagcaaatggagaattcctaagagaagtcatgcatgtcagcagggaggtctaatacctgaattcactgatgagtcatgtttttataccagggtttataggattaaaggcaatgctggaagaggcaaagggaaaataattttaagataagtgtatcataatttggtaaggatgtttttgtggcatgaacacatttttatatgagcacagagggaggcctggtgtacttgcagacggggctcccagggctccttcttgactttacagaagggacatttgatgtgaccattgcgggatccctcatacctggatcctatgaatggctagaatctgacaattttccattcagtatttctcttgaaggtgttcttttcttttccttgtcattagtcctactctgggcaagagtcaccccctctcatgtctgtctccagacttccaggccatcttgcgattatactgttcctaaaatgccatcttttatattttagtcccctccgtggatccttattgcttttaaatctcctcacttgcattcaaggaccttcttatcttcaggtaagatttatctcttatttaaactcccaacttccaccctttctggacaaggctgcacactgctccttatggataacgaatttatttctgctgtttctcttttgttacgtcgtttcccgaatcttatcctgtttacatcacaccatcctttaaatccatctgagatttcacttttccacaattccttatttgccaactctagcttacagtggccaccaacaatttatttttatgctagaaatgttgtcatttgttatatgaaagaatcacaaaatttagctcatagtacaacttggatatgaagttaaaataaaattttaaaatttgcttgtagcaacaatattatttctcctgagtccctacttgctggttattgggagaggggattgggagggggattgcctaaatgtctgatctacatgaaagcttggtccagtcctattatataaataatctcaggtaatggcctgtctctcttgcataaaagtactcagtttattagataatctttcattcctggcttctatacataagttgcccccaggttttacatatccccatggttttaggaggggaaggagaccttgttttcaagatggtttgggaaatgggtgccttttgtcatttgttggctgtggcagctgcctcctcttcctttctcttcccttctcctcctctccatcctcttctcttcctcctatccttctcctcctctttcttcttttctgagcttcccagactggctacctgcactgactgacacttcctttttattacttctatcaggttagagtcaagtcttgctgatatggaatctattcttattaacttcatctaatcaattgtacaacttaactcttggataacaattctgtgcccttcattgcattcctacttaaagtctacaaataccagtgataacacttgttcagtgtgtttcatgcgtatagaagctacatctccaataagataacaagctcattgaatgacagtggtggattatatttttttttgtgtgttctccctagcacgtgacctagggcaaagcccatcaagtatatttcataaataagtgttgtcttcaacttaactgataggaaaaaaatgcttcttagggaaaggaaagcagaagaatgtttggcattttgctccctaaatgtcaaatagactgtttaagacacaagaatccctagcttgtcttgagctgggacatgggacctagctgagccagattaggcaagtttagcgttgacactggaagaatgtgaagtgaatgaaagcatttattgtaagcagtcagcgtcccccacatttactagaaagcagtattctataatagagtgcttgttactttgagaatcagtcttggctttgtcatatcctagtgtgtgtctttggactagtggctaaaaactttctaggtcacagttttctccatttatagagtgagggtaataatcctgacctacctagttcaaagggtggtggtaaaaagagaatgtcagtgattacccctgggaaactaaaaagcatgatccggatatcaggctgccttaatcagatagcatcatatgctaagaacagaagtccacttagattagctcaggacaaaggggattcactggatggatatgtgggtttttaagagaatttaagcataagcaggccttgagggcctggagccagaaatcagaaaatgaggaacacaggttacttattcctatttaaatgcatagtttactgtctttcctcctcctttcttaccgaattcattcttctttgctgtgggaactggcttgctttgcttcaacatgaatcttataaaagaaatggccagtccaaccccagattgatatgagttcttagctctcttagctccagctcttttgttgcaatcgcaaatttctgggaaagattgacctggtgtggaccagatgtttgcctctggatagtcagctgtggccaagggggctggtcacatgtacaaatctggccaccctgaggctgacatcctaaggtgtcttccgctaattaactcttgttaattttgtgaaacttcattggtttatgtttaagggagtcgagagttagctagccggcacattcagtccctagagaatgcttgccattgagcctaatgcaaagaagttgcttgcatcctgctctcttagacactttcctttggttggtttcaaagagtgagatatagagaaaactagctgtggctggaggaagaggaggtgatgtaattttgtaactgatgatccttcctatggccagatggaggatacagtcctcatttcaacagaggaaagtcatctggcctggcacggtggttcatgcctgtaatcccagcactttgggaggccaaggcaggcagattgcctgagcccaggagtttgagaccagcgtgggcaacatggcaaaactgtctctacaaaaaattagctggatgtagtggctcgtgcctgtagccccagctacctgggaggctgaggtgggaggaaaacctgagctctggaggtcgaggttgcagtgagccatgatcatgccactgcgctccatcctgggtgacagagtaagaccctgactaaagaaaaagtcatccagttttagtcttcttcagtttgacttgcttctaggagtgtaacctggtttaattttgctaagacaacaaaaatgtggatgcaatataggattttggaatgtttcacagcaaaataatacaactaatctcagaagaatgtttgttaattatattctatctattccctatctacttccaaaaaggatttaaggaagtttataaaggccaaaagtgtaaacaataaaatacaaacgtgaagtagcaaaaagaggaaaactgtatttaaaaatcttggctgataatttatcaatatctatttgtggaaaaagaaaagctagatttctaacttaaaccattcatctaaataaattccaaatataacaaatagttaaacatgactgctaatctgtaaaggaactaggaagatacatttaagtatttatctgttctcagagcagagtgggaaaacatttctaagcccattaaaaaagaaagaaacctgaacgggaaatattaatagagctgactgcatgaaaatgtaaaactttttgactttacaaagtaccaaaaccaaaatgaaatggggaaaatatttccaacagaaatgacaaagagttgataatttcactatgaagtttaatagtttcatctgctgaaaataataaaaagacaaaaatgccaatggataaaggatataaaacaagacatttttgaagaattaatacaaaaagcaaatacacatgaaaatatattaaacaataaaaagaaaatgcaagctgggcgcggtggctcacacctgtaatcccaacactttgggaggctgaggtgggtgaatcacttgaggtcagaagtttgagaccagcctggccaacatggtgaaaccccatctctaataaaaatacaaaaaaattagctgggcatggtggcgggcacctgtaatcccagctactcgagaggctgagacaggagaatcacttgaacctgggaggtccagcctaggtgacaaagcaagactctatttcaaaaagaaaacgcaaacgaaaacaatgaagttatattttatacttctgattggaaaaaaaactagaaaattataatggagggcaattttgcaatattttgaatagtctataaaatgtgcataaccttggactcagaaattttatttccagaaagaagtccttggtaaataatcaagatttgtgtgaagatttagatacaaagatctatgttatttattcttttgttgagtagaaactattttccaaagtttttagaatgaatatttattacctttataatacaaaaaaataataaaatactttatggtgtggtttttttgttttgtttttttggcaacagagtctcgctctgtcactcaggctggagtgcagtggcacaatcttggctcactgcagcctccacctcccaggttcaagcaattctcctgcctcagcctcatgaacagctgggactacaggcatgcgccaccacacccagctaattcttgtatttttcacagagacggggtttcaccattttggccaggctggtctggagctcctgacctcaggtgatcggcccgcctcagccacccaaagtgctgggattacagacgtgagccaccacgcctggcggctatgttgcttttttctacctgttgtctttaattatgaagtttgcatatcaaaagtagatttttgatgagtaaagtaatacttttctcaactagtatcttgctttggaaatatctggtgggcggaatcagtaatttagtaaaaagaccgatgagtcatcaatatttgtacaaacactttttattatgagagcaactgaaggcatgtacttagaatttatttgcttttgttgtagacagaatttgaacaagctatgttttctgccgtccatcctacagccagttgaaggcaggtacttggtaccagtgaagagatgggagggagcctgacgggaggaaagacagatgaattaaaaacaacgacaggccgggcactgtggctcacgcctttaatcctggcactttgggaggccgacacaggtggatcatgaggtgggagagccagaccatcctggccaacgtggtgaaaccccgtctctactagaaatacaaaaataagctgggcgtggtggcgggcgcctgtagtcccagctactcaggggggctgaagcaggagaatcgcttgaacctgggaggcggaggttgcagtgagccgagccactgcactccagcctggcgacagagtgacactccgtctcaaaaaaaaaaaaaaaaaaacaatgacaaagaaacaaccacaagtgctcacagagcacagcagttttgggctaataatccttcacattgaaatggctcctgaaggcatggataacaattaaattttgatgaagaccttgaatccttgaatcacctggaaaaattgaaagcatttggtttcccttgttttaaaaggaaggagattagataatgcatttgaaaatttatattcaagatggttaaaatagggcaaagtttgccatctaagtcttgtaggctctaattatctggaaaaaatacctgggtgggtgaatgatcagaataatgagataatctcctgtataaataattattgcagtgatctctgtggaatttcatagcatacattcaacgttgaatcaaaaaaaaaaaaaaaaaagagggaattaggtgactcccagagagaggcaagtgaggtgtggtctcatgagattctggtgaacttatttcatcttctcttggcctctctcactgggtgatgtgcatgtggccttttccctctgcccccaggactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggtaagcacacttacctcccaatcccctgctttggggatgtgccacgcctactgtcaataaacagaacccttttcttctgtatttttgttcatgcagatgtaaatattgctattggccaggtacggtggcttacacctataatcccagttttgtatttttatacagcaaatacaaatacaaattgtatttgtatcccaattttgtatttttagtatagatgaggtttcattatgttggccaggctgatctcaaactcctgatctcaggtgattcgcctgcctcagcctctcaaagtgctgggattacaggcatgagccaccgcgccgggccatcgattagtgattctctaacttgaacaagcatcagagtcacctggagggcttgtgataacagagtgttgggctcatcccccggagtttctgattcagtaggtaaaagggatggggcccaaagatttgcatttctaacaagttctctggagatactgaagctgtgggtctggggaatacactttgagaaccgctgttttggaagagtaatactagagagtctcttattaaattaagctttcttattaaaattaattcattgttttggatctttgggcacaatgatttatttactgaaaactaacatgaatgcattccagcagatttttcagagtggtctctgcagagctgtgacaaatgtgactgagacataaaccccagtggcttttaatgagtataaggattcaagacactttaggccgggtatggaggctcaccctgtaatcccagcactttgggaggccgaggtgggtggatcacttgaggtcaggagatcaagaccagcctggcaacatggtgaaaccccatctccactaaaaatacaaaaattaactgggtgtgatggtgtgtgcctgtaattccagctactagggaggctgaggcgggagaatcacttgaacccaggaggtggagattgcagtgagccaagatcacgccactgcactccagtctgagtgacagagcgagactgtctcaaaaagaaaaaaaaaaattaaaaagacactatgacaggttgtgagacagggatggcagggaaattataggattctgcatctattcttttgacttctgaaaaatatttttttttttccaaatgtgagcagaggttattttattctttcctttcacttactgtctgtctccctgagtttctttttttttttaattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacgtcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttccccactttctattccacaaaaccgccgttgtcgtcatggcccgttctcaatgagctgttgggtacacctcccagacggggtggtggccgggcagaggggctcctcacttcccagtaggggcggccgggcagaggcgcccctcacctcccggacggggcggctggccgggctgggggctgacccccccaactccctcccggatggggcggctggccgggcagaggggctcctcacttcccagtaggggcggccgggcagaggcgcccctcacctcccggacggggctgctggccgggcgggttgctgacctcccccacctccctcccggacggggtggctggccgggcagaggggctcctcacttcccagtaggggcggccgggcagaggcacccctcacctcccggacggggcgcctggccgggcggggggctgacccccccacctccctcccagacggggcggctggcctggcgggggctgacccccacctccctcccggacggggtggctgccgggcggagacgctcctcacttcccagacggggtggctgctgggcggaggggctcctcacttctcagacggggcggctgccgggcggaggggctcctcacttctcagacggggcggctgccgggcggaggggctcctcacttctcagacggggcggctgccgggcggagggtctcctcacttctcagacggggcggttgccgggcggagggtctcctcacttctcagacggggcggttgccaggcggagggtctcctcacttctcagacggggcggccgggcagagacgctcctcacctcccagacggggttgcggccgggtagaggcgctcctcacatcccagacggggcggcggggcagaggcgctccccacatctcagacgatgggcggccgggcagagacgctcctcacttcctagatgggatggtggccgggaagaggcactcctcacttcctagatgggatggcggccgggcagagacgctcctcactttccagactgggcagccaggcagaggggctcctcacgtcccagacgatgggcggccaggcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaagcagactccgtctgcaatcccggcacctcgggaggcggaggctggcggatcactcgcggttaggagctggagaccagcccggccaacacagcgaaaccccgtctccaccaaaaaaatacgaaaaccagtcaggcgtggcggcgcgcgcctgcaaattgcaggcactcggcaggctgaggcaggagaatgaggcagggaggttgcagtgagccgagatggcagcagtacagtccagctttggcttggcatcagagggagaccgtggggagagggagagggtgagggagagggtgagggggagggggagggagagggagagctgaaaaatatttttaaaaaataatgaatgtgtctagtatttcacctaccctattctgctcataacaaaaacaatagtaacaacagcagatgagcaacctgaccacctgctaagtgtggggcactaccaggagcttcagacttaaagtgctcaaaggtgaaccttcatcctgcttttcaaactagcttcaactttgttcatccctttatctagaaaatggcttctagttgcttatcccaaaactttgacatcattcttgcttttctttcaacccacacatttgatccattgccacgtcctgtcaattttccctcccaaagattacttttaatttagcacgtctttccatctttactgcctttcttgtagcctaagtccttattagctaatctaaactgcattaacagctttctgttctgttctccgagctcccaccatgattccctccagtctgttcttcacacagcagccaaagtgattatgttaaaaggtaattcagagcttgtcattcttgcattcctcaaagcccttcaatggcttgtccttgcattaatgatgaaattgaggattcttgtctatctcctttaggctcttcctacactatccacctccctgcccttttaaaacagactccatttccttcttcttcttcctcttcttcttcttcttcttcttcttcttcttcttcttcttcttcttcttcttcttcttcttcttcttcttcttcttcttctcctcctcctcctcctccttctccttcttcttcctcttctttcttctttcttccttctttctttttttctttttctttttttttttaaagagacagggtctcatctgtcacccaggttggaatacagcaacatgatcatgcctcattgcagactcatcctcctgggctcaatcgatcctcctgcctcagcctcccacgtagctgggactaaaggcatgtgccatcacgctcagccagttttttgcttgatttttgtagagatgggggtctcgctatgttactcagctggccttgagcctcccaaaatactggcattacaggcttgaaccaccatacctggcctgactccattttttagagcaattttagattcacaacaaaatttagtggaaggtggaattttcccataggacccccctgcttccttaaacgcacagcctcccctactatcaacattccccactaaagtgatacagttattacagtcgatgaacctacactgacacatcataatcacccaaagttcatagtttacattaggcctcactcttggtgttgtaaattctatgagtttggacaaatgtataatgacatgtatccactattatagtataatgcagagtagtttcactgacctaaaaatcctctatgctttgctctttcatccctctctcctcgctaacccctggcaaccatggatctttttactgtctccatagtttttgccttttccggaatgtcacagagttggaatcatatagtatgtagccttttcggattggattctttcatgtaataatatattatacatttaagtttcctcagtgtcttttcatggcttgatagctcatttcctttttttaatttaaaaaatttaagataaaaaattaaattaatggaatgtttcacaaatttgcatgtcatcttggcgcaggggccatgctaatcatctctgtatcattagcattgtatcataaaattgtatcataccaattttagaatatgtgctgccaaagtgagcacaatagctcatttccttttcacactgaataatattcccttgtctggatgtaccacagtttatccattcacctgctgaaggacactttggttgctttctacttttggcaaccaaaagtagacttttgacaaaaggtcaaagcttaccatataattcttccattttataaaccgtctattgttccccattattgccatcagttaaggtttgggctctttgaccaaatgataatagtaatccttctcagtgggattatgctgttgttttccaagttcttgacaatgatcatgcattgtttttataattaaaatgaattgttattaaaagcaatttaggttgggcgcattggcttctgcctataatcacaacactttgggaggccaagacaggagagttcgttaagcctaggagttcgagaccagcctgggcaacatggggaaacctcgtttctacaaaaactttttaaaaattagctgggtgtgttggcgcaagcctatggtcctagctacttgctactcaggtacctgaggcaaggattcgcttgagtccaggtagtcgaggctgcactgaactatgattgtaccactgtactccagcctatgatagggtgagaccctgtttctaaaaaataaaaatataaataaataaaaggaatttagtctggcctcaaggagcgctctctggataaggtgatgtttggacactgaggttttgaaaagttgagtaaaagttagataaaccaaggtgaggaagagaatgacaagcagaagggacaggaatgtaacagcaggtgcagatgtgtttaaggtccaggagtgcattctgtagagttgaggtgagaatacccatggaatagtgctaggagatgaggctaccagtggaggtgggaaaccaatcattaacttattctgaaagtagagagaggagctgtttcataattttataaagaatttgggcttgtctttagaaaggtcatttcagtggcaaagtggcagattatttgcagaggacaggatctagccaaacagtagaaggtcaagtatgggataacaagagcttaaaataaggcaagaggtaggatgaattaaatggagacaaattctaaagattaaggatgtattttttttttgagacagggtcttgctttgttgtccaggctggagtgtaatggtgtggttacagctcactgtagccttgggctcctgggctcaagtaatcctcccaacctagtctgcactccacccctaagtagctgggactacagtaatgttccaccatgctaggataatttttattttttacattttttgtagagatcaggtctcactatgttgcccaggctgatctccaagtcctggcttcaagcaactttcctaccttggcccctcacaacactggggttatagacatgagccactgagcctggccctggaagcagatcttttttttttttttttaatttttatcaaaccatgctttatagcacaggtacaattttttatttctttttttataggacttttaaaaaaattatactttaagttctagggtacatgtgaacaacgtgcaggtttgttacatatgtatacatgtgccatgttggaatgctgcacccattaactcgtcatttacattaggtatatctcctaatgctatccctcccccctccccccaccccacaacaggacccggtgtgtgatgttccccttcctgtgtccaagtgttctcattgttcagttcccacctatgagtgagaacatgcggtgtttggtttttcgtccttgcgatagtttgctgagaatgatggtttccagcttcatccatgtccctacaaaggacatgaactcatccttttttatggctgcatagtattccatggtgtatatgtgccacattttcttaatccagtctatcattgatggacatttgggtttgttccaagtctttgcttttgtgaatagtgccgtaataaacatacgtgtgcctgtgtctttatagcagcatgatttataatcctttgggtatatacccagtaataggatggctgggtcaaatggtatttctagttctagatccctgaggaattgccacactgacttccacaatggttgaaccagtttacagttccaccaacagtgtaaaagtgttcctatttctccacatcctctccagcacctgttgtttcctgactttttaatgatcgccattctaactggtgtgagatggtatctcattgtggttttgatttcatttctctgatggccagtgatgatgagcattttttcatgtgtctgttggctgtataaatgtcttcttttgagaagtgtctgtttatatcctttgcccactttttgactgggttgtttgtttttttcttgtaaatttgttttgagttctttgtagattctggatattagccctttgtcagacgagtagattgcgaaaattttctcccattctataggttgcctgttcactctgatggtagtttcttttgctgtgcagaagctctttagtttagttagatcccatttgtcaagtttggcttttgttgccattgcttttggtgttttggacatgaagtccttacccatgcctatgtcctgaatggtattgcctaggttttcttctagggtttttatggttttaggtctaacatttaagtctttaatccatcttgaattaatttttgtataaggtgcaaggaagggatccagtttcagctttctacatatggctagtcatttttatttttgccagcaccatttattaaatagagaatcctttccccattgcttgtttttgtcaggtttgtcaaagatcagatggttgtagatgtgtggtattatttctgagggctctgttctgtcccattggtctatatctctgttttggtaccagtaccatgctgctttggttactgtagccttgtagtatagtttgaagtcaggtaacgtgatgcctccagctttgttcttttgggttaggattgtcttggcaatgcaggctcttttttggttccatatgaactttaaagtagtttttccaattctgtgaagaaattctgtgaagaagattggtggcttgatggggatggcattgaatctataaattaccttgggcagtatggccattttcacgatattgattcttcctatccatgagcatggaatgttctcccatttgttgtgtcctcttttatttcgttgagcagtggtttgtagttctccttgaagaggtccttcacatcccttgtaagttggattcctaggtattttattctctttgaagcaatggtgaatgggagttcactcatgatttggctctctgttagtctgttattggtgtataagaatgcttgtgatttttgcacattgattttgtatcctgagacttcactgaagttgcctatcagcttaaggagattttgggctgagacgatggggttttctaaatatacaatcatgtcatctgcagacagggacaatttgacttcctcttttcctaattgaataccctttatttctttctcctgcgtgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgtttaattttgtcaaaggccttttctgcatctattgagataatcatatggtttttgtctttgtttctgtttatatgctggattacgtttattgattttcatatgttgaaccagccttgcatagcagggatgaagcccacttgatcatggtggataagttttttgatgtgctgctggatttggtttgccagaattttattgaggatttctgcatcgatgttcatcagggatattggtctaaaattctcttttttggttgtgtctcttccaggctttggtatcaggatgatgctggcctcataaaatgagttagggaggattccctctttttctattgattggaatagtttcagaaggaatggtaccagctcctccttgtacctctggaagaattcggctgtgaatccatctggtcctggactttttttggttggtaggctattaattattgcctcaatttcagagcctgttattggtctattcagagattcaacttcttcctggtttagtcttgggagggtgtatgtgtccaggaatttatccatttcttctagattttctagtttatttgcgtagagctgtttatagtattccctgatggtagtttgtatttctgtgggatcggtggtgatatcccctttatcattttttattgcgcctatttgattcttctctcttttcttctttattagtcttgctagcagtctatcaattttgttgatcttttcaaaaaaccagctcctggattctttgattttttgaaggtttttttatgtctctatctccttcagttctgctctgatcttagttatttcttgccttctgctagcttttgaatgtgcttgctcttgcttctctagttcttttaattgtgatgttagggtatcaattttagatctttcctgctttctcttgtgggcatttagtgctataaatttccctctacacactgctttaaatgtgtcccagagattctggtatgttgtgtctttgttctcataggtttcaaagaacatctttatttctgccttcatttccttatgtacccagtagtcattcaggagcaggttgttcagtttccatgtagttgagtggttttgagtgagtttcttaatcttgagttctagtttgattgcactgtggtctgagagacagtttgttatcatttctgttcttttacatttgctgaagagtgctttacttccagctatgtggtcaattttgtaataagtgtgatatggtgctgagaagaatgtatattctgttgatttgggatggagaggaaacagatcttttacggctgaatgtttggttggatgtggggagtgagagaatgatatttagatttctgatatcatgattaagtagatagatagtgagaccattcatcaagacaaaatattgggtgagaacagggggcatggggcaaaggtgatgagctgggcgtgcctgtcaatctaagttgatgtttgaatttagagcttaggagagaaatctagactagaaatatagatctggggctctcacatggttaaatctaatgatctaatgtcattggggactgagtaagaaggacaggttgtactctcaagtacagagtcctggtgcccataattgaaggaactagcacagggagaggtgcccctgatggggactgaacagaatagctttctatatagtagcgagaccatgaaaaacggaagataagggcgggtgagcatttaagaaggccggttagcagtggcacatacttcagagaagtcaagagcagtaagaactgaaatccacccacttcattttgactaaagatcactggcaacagctggcacagcctcagtgtggtgttggagtaggcactggcaggggatgcaggatgcattagtttcctgtggcagctgtgacaaattaccacaaatttggtggcttaaaacaacagaagtttattttctcacacttctagaggccagaagtttaaaatcagggtatcagcagggttggttcttggctggaggctctgagggagaatccattccttgcctctcttccagcttctggtgctggaatttgggcttgtctttagaaagagcccatttgcaggaggccagactgggagcagcaggtgggcaggatggagggaaaagaggagggtgggtgactttaaaacttaagcttcattaactttctggtaaatccacgaatgaacaagaatatatgttgccaagtgggtgggtgggtggagtattgatttagatgtagaaatatacaactaatgaagtaaagtttgggctaatcaaaagagttgataggcagaaacaaaggggacagatttttgtgccaatgatttttggtgttccttgcttgtggaagcatcactctaatctctgccttcgtctgcaccttacctcctcttgtctatctctatgttttcccctcctttcataaggacaccttcctattatttcatctcaacatccttaattacatttgcaaagatatttttccacatatggtcacattcacaggatctgggtgccatgtctttttttggggggagtgcacaagtcaacccactacacatggtaaggaatgaataggctgaaatgagtagggatgatgagcataaacccccttttcaaaaagtatgaatcagaagaatagagggaaagatacaactacagccagaggggatgtcaggttcaggaagaatgtcttcaagatcagagatacttggaaaagcactggagcagatgcagtttttagggtacctgaagcatatgtaattagaagtgccctctttatttattaacttttgagacaaagtctctctcacccaggctggagtgcagtggtgctatcatggctcattgcagccttgacctcctgggctcaagtgattctcccatctcaacctcttgagtagctgggactacaggtgtgccaccactggctaatttatggcagattcttccgtagaaatccttcccagttgcagcccagcttcccctccccacctcaaatacttcaattccccacaactctaagcatttgtgggagcccagactgggaacagcaggtgggcaagacagagggaaaaggagagagtggttgaccctgaaacttaagcttcattaacttcatggtaaatccatgaatgcgcaaggatatatgttgccaggcaggtgggtgagtggagtattgactgagaggtagaaatatacaatgaatgcagtgaagttcctgggctcttcaaaggagttgataacagaaacaaaggagacagattgctcgtggacaaggaggagggacaccttttcccttgaggcaggtaggaaggggtaaatatgggccactgatcagtttggtatgggaatggacaggaaggtgagatattgtttgatggcctcaattgagtgaaatataaagcaaaggcatctttttttgcctgcagtcaacatgagcttttatttgcctgcagtcaacatgagctccccttcccacatttacccttctgctcactactcgccaccccctgttcttattaatggtctaaatccagttgcttagttgactccaggagtttccagggtttaaaggggcttgcaggataaaggtggtttcagtatgaattagtgcattttaaatgagtgcttctaatcacgtttttgtgatgctactgagtaagccagttctttgggtgatgaggagtgataccctggttgctgaaagctggatgctcttttggctaggtgatttgaattaaataattatgtgttcttcctcggaagtgacttagacacttcttggtagaattcagtatctttccttcagcaggataatgttcacataaattgcctttcttgtgccacgtggccatgggcatcagttaggcagattcagtgtctggtgagggcctacttcctgcttcctggtgattctttctgcttgccccaggatcactgatgtgagccataatgactacttggcatagactacacataagtcttgtaaatgtctgtatagttttctcatttaaatgaacatgtcacagtgctcttgggaacaactttccattaacctgagcacagcagacagcctgagacagtggtgctcactgaatgaaatttgcttctgctttggaggtctgatttgtattagaggcacgacctggttggtaccagctctgcagaccaagtttgatttgtcattcatgtttattgaattccctgatagctgtgcagatgaagaaaccacttagaatttagaataaaaataaaaataatagcaactaacactgggtgcttagcccaggtatcaggcattgtggaagtcctttactgttagctcatcataatcctatcaagtaggtacagtatttattccccactttgttgataaggaaactggaaattgaagaggctaagtaaattgcccaagttgtacagtatcttagtcagtttgggcagctgtcactagctaccatagattgggtggcatattaacaacagaaatttattttttacagttctagaggctgggaagtccaaaatcaaagtgctggcagattcagtgtctggtgagggtctgctccctgcctcctggttcatagaggctgtgtcctcacatggcagaagggatgagggaggtatccagggtattttttataagggtactaatcctattcatgaggtctctaccctcatgacctaaccaccccctaaatgtttcacctcctagtaccatcaacttgagggttaggtctctgcatatgaattttgggtgtggacacattcagtctatagcacatagctaggaagtgatagagctggaatttgaacccaggcaacctaattccagaatccaatttcttaattattgggctatactgatgatactttttatattggtacaagtgtagctgaagtttgtaactgaaaatgagatataattcggtaaagaacagtcagttcaacagatgattcatgcttagatggcttagtacggggattaaaactcagatgtctacatactgccccagagagaaactgcccagatgtagtcacattggctggtgactgtagtggtgaactggaggatacatgctcattgtgaagggagcaactatgtataaacatgtcggaagttttgttttgttttgtttttgtttttgtcaagagaagccagaaaactggattttaatgtgaaacttccaattttaaaaatcgtcttcctgttaataaccgtgctttatccattaatggttaaattatagtcctgtatagtataggctgggttttcctgcagtaaccaacaacacccaaagctcagtagcttaaaacaattaaaggttacttcttgctgatgccacttgcccaacagtggttgacaggagcctcagctcttagaacgtctcggagactcaggctttatttggacacattttttacataataactgcaatagtgcaaggggaacatgagactcagacactgacccttaaatcttcttatagaagtgacacagatcaatcacttagactcatatttcattggccaaagttagttaatgaccacacctaacttcaaagggggtggagaagtgcagaccttctgtgggctgaagcaaaatgtttctgagtatccccactgactaccacagctccatatactctgatttttaaggcagaaatgtcagatttttcccccaagttagattctgatttgcagagatttcaaacggttgatttaaaaaaaaaattgttttgttcttgaatgattaaatttgactgctctgaaaaattcatattttgcttcatttggactagtgccacttatttaagtattatcatcttttagctgattaggaaatcatatgcaggaactgtgaaataatttttagctgaagtgatgatttatagatgaatatttattccaaaaagcactactcatatattttaaatatttgtttatgtcatccactatcttgtgtaacttgtctcattaactacactgtaaggtaagaatcttatgttattaatttatgctctgtagtgtctggcagtatagaaaatggttatttaatagatgttaataaattttattgatatatctgtcaattagtagttaataaatcactataattagagatcatgacttcagatgatgtcatagaagttggaaacacttcaggcaattttttagaagttgcttattgttgggccgggcgctgtggttcacgcttgtaatcccagcactttgggaggccaaggcgggcagatcacgagatcaggagatcgagaccatcctggctaacacagtgaaaccctgtctctactgaaaatacaaaaaattagccgggcatggtggcgggtagctgtagtcccagctactcgggaggctgaggcaggaaaatggcgtgaacccaggaggcagagcttgcagtgagctgagattgcaccactgcactccagcttgggcggcagagcaagactctgtctcaaaaaaaaaaaaaaaaaaagttgcttattgttgattatgatgggatatgaaagccaaaattcagtggcccctcaatttcaaaggcatttctggcttattcgttatgaatcacaaggcaagactttcttttcaaatatcatttttctgtgatgttttcacatgctttattttgctataacatttggatgaattgtaacttaaaaaaaattatgaagcaaatatcagtgctcagggaggtattcaattgcctgagatcttgcaaggccttaaacactcttcaaaacaagcccctcctagctcctaagcccacgcccttcctggatgaccagatagagagtgattctcattctcatgaaatgcagagtgctcagggacatgaatgtgtgaggacagagtttggcccaggagcagtgtttctataatttaatagtggtattactccccttggagaaagttgcatgaacacaagttactcattgattgaatcttgaccatgcaagtgtgtttccaaaatcaatcactcttaagttgttccacatgtacttgtaaatgttaatttaatggcctgtgtaactgggcttttgttgttgttgtctatctgctgatacttaaggtagaggaagttgtaatgtagtgttaagattctgagtcagataacttgggttttaaaaccattaccaacactatatactagctgtgtaatattggcaaatcatttactcagtaatgtttagattccttatttataaaatagagttaaaggtatcacctcatgacaaaattgctctgaagattaaatgaaataatgtgtacaatattcatggcataatgccaggtacatgctaagcattcaataaaaatcagcaattattaatattgtattactatctttataaaatcatataatcaggattaaaggatctcaaaagtcattggattaagctactcatccaataatttaatcccccctacaatttttccaccaagagatctcctagactatgattgaatacttattattagataactctgacttttcaaactttctcatattgaaccaaattatgcttaaacctgtagctttcaccatttggaaatatacagaacaaaagtagaccctttcctcatgatagctctttgtgaatttgaaaatatctctaatcataagctattctctaaacttccttgaaacttactatctctccctgaaattttcacttgatctttctctttcccttcaacaccaaaatgttggaaagaattgttataaataattgtctcaacttcctctagtttcatttcttcttcaacagcttggatatagagtctgattcaacaactctccaagctgaagcatgagggctacccaggagtcaaaataagatgaaaaacacagagaaataataacattggcccttttttattgaatcctttatagtgtttgaatcattatactaagaattttacatatattttctcactgaatcatcactaggccctatgtgaagtatatattggtattattatctctattttactgttgaggaaaacgagtctctgagagtttgaatttttcaacatcctgcagcttgaaagggtggtgagtggatccaggtttgtacgtgggtgttttcttcctccaaagtccctgcacttaaacaccagatttataaataaagttagatgaatatgggaaggaaggaagagataaaccatcagatcagttgatattattgttgtttacacattatgtaaaatatatgcttaagaaataaaaaagaaatataagacatgaccttttttctcatataaggaagcttataatatagcaaatacacacacatatgtacacatgaaaaatgacaagagaaggaaggatagcagtataaacacgtattttatatgagacatctctccttttaattattttttatattttaaaaattgtttataaatatataggtataatgacagcggtggagatacataggcataggtacagctaatgataaagacaaggagatataaagatatagataaagactatagacagatattaatatagggatatagatatttagagatagaagtaaaaacagaaaaaaaaaagatatttaaagtaaaactatgaaccagaaggttatacatcaaatttaggacagtggttgttttggggaggaaatgagagaataggataagtgtagggctggggagagaggaaacgtctgtaatgttctgtttattttatatatataaaaatgcctgggctgggcagtgtggtacatgcctgtaatcccagcactttggaaggccaaggcaggaggatcacttgagcccaggaattcaagaccagcctgggcagcatagggagaccctgtctttacatcaaattttaaaaagctgggtgttggggcacaggcctgtgactcaacctcccaggctcaagtgatcccagctacttgggaggctgaggtgggaggatcacttgagcccaggaggttgaggctgcagtgagccacaatcccactattgcactccaacctgggcaacagagtgagatcttgtcttgaaaaaaaaaaaagacagaaatctgaataaaaatataaatagaaaagggaggggtatggagggacagcttcaaatcttaatattaatatttcggccttacattagaatcatataaatgatactatcctgtaagacattatattatttagatttataaaactatgttctcataaaagagagccaaactgtaaagttaaggattacatcacaactaagcttcctgaaatgaagagagctccccctcccctggctttgggcaccactgactgccatgcttctgttggcaggcagtgggctgcgatcggcaactgggaagcaatgccaaggaggacaactgtggagtctgtgccggcgatggctccacctgcaggcttgtacggggacaatcaaagtcacacgtttctcctgaaaaaagtaggttttaaacccaatacgttattaccatcatacaagatatattttagactgtctattgctagaataacattttctgaatgttaagcttttttagttggaagtagcttttgtaccaattttctaaaagtgaaatttcttccaagaagtgtgtatcaaacttttgttcccattatatctttgaagaggacccgttttctttgaacctttgccaatgcagggtattactgttttaaaaaaatatatttgccaatttttcaggtaaatcatgaaatagtaatttcttttatttgtcttcctttgactgctaacaaggtagaaaatattgtcatgtatctattgaccatttatactttttaatttctcagttagctactgaagccatttatcaattttcctatttggatgtagatcttttcctcattgttgagagcttttaatatatcaccaatactaacattttttctgtcatacctatttcaaatatggttccagtttgttaattgactttcaattttgtgtaattagagtttctaagtttctaagtattatgtatttggaaatttccatcttttcattttaataatatctgtcctttaaaacatcctttagtttggggaatcagtaaactttttctgtaaagggatggataataaatattttaggctttgctggccatatagtctcaactactcaacacagctgttgcagtgtaaaagcacacacagacacctgtaaatagatcagcatggctacattccaatgaaactttatttacaaatgtagcctgaaggctgaatttggcctttaggtttgttaaccgctcctttaaaggaaacaaaaattattcacgtatgttttctgccagtacttttatggttttgtttttctttataataattctttctgaatacccccttgttggtggtattcagttataaatgtaggtgagttccgccaaagatttgattttaaatcttttattcctttgaatttagtttgatgtaacttgtaaagtcggcatcttacttattttcccaaatggggaaagcattgcgggaggggtggagggtttttcaggcagaggaaacacaaagttcatggcgtgacactggagaagagtctgggtgttttgaggaactcctaatatgttgttcaggcctgactgtacattgaatagggtagaagataagacagaacggcatttggagtcaaagccttcgttattgtgttttatttttcagattaagtggagccctcaaagcaatttaggcagtggagtgatatggttaggttagtgttttagtaaaataattctggtggcatatggaggctggattacctgtcagatgagcttggaagcaggtagtccaaataggaagtgtctttcaagctattcaagagtgtttaaaatcatgaggccttgatctagggtagcgtgggaggaaacgtagaggaaggaacaggtggagagatctttagcatgtagaatgaacagagtttggtaattctttgaatgacagctataagagaaaagaagcagctagaatggcccaaattttccatcttgtgcagctcggtggacatgtttgctattcatttgggtaaggaattcatgaagaggagacacatatcagaggtgagactccacctccctgaattttattctctccaaaattttcaccccataagtatccaatgtctaagtatctttctgatgcctgcaaacagatgttgattatgttttctttgtggttggagggtttatctgaaacatgctaggttatcatggctgatagcaaaaccccttgttggtggtattcagttataaatgtaggtgagttcctctaaagagagtatgtagaatataagaggaaaccaataattgcatcctgaggaaaagctgaagtcaaagcatttagccagggaagaagtttaagggaatccaaccgagaaggaatgaatagagtaagtaggtaaatgcagaacttagcaagagcagtaccatggaccccaaaggaataagtaatttcaaaaatgagatgggggtggccagcaatgttaaatgcttttatgagttcaactggaataagggcccaaaagtttgtctttggcaatttgaaggtcatttgtgatgtgaacaagagtgattttgatgaacttcaggctgaaatcaaagcttcattgcaatggattgataagtgaagagaatgtatagagggaaggatttgctcaggacaagaggaggggaacagaccaacaccgtgtcaacaactggatagctctacagggttggttggagaacaccgtgaggtgttccagcctattgtctttatttgactcttcattaggagatagagttggccagtaggagtgagggctcagagacttgagcctgttcccatgaaggaaagaagaaggaaccatcaacaacagtacaaagatagaggagtagctgtaagggcctagctgagatgggaaaccatgaattcatggaggttccaatttttggacttcatgaaggaggtggctttgaatggtggtataccaatgaggaatgtatcctactggaaatcacagaaaactcaacttagaaacattggagtttataagtcttttctaacaaaaagcctggagtaggcagctaaggctggggatgctgttttactgtgtctttcaggaaccaggcacctttctctcttcttcacatccttagaggatggcttttgcctacttggctgcaaagtcattattggacattgagatgttacatccacatcccagataataaggaagaacatagtgtgaaaagcgtttttttaaatactgtgttctttatccaggaaaggatattctccccagggaattttgcttcattgaccagaattatggtgtgtgacaccctggcttccaaggaggcaggaaaccaagtagttagcattctatccattctgctattactaatattgatcaaatgctttataattcccaaagttctcttcagacttatcatttaattctaccagcattcttacattataatttggataatgtcctgcctattttacagatgaggaaactaaggatgagaaatgttaagaaacatctcccataattaattatgaaaggaaatattgggaagtggttaagaaattggggtccggagccgccagccttccagggttaagtcctgggtctgttgcttatgagctgtgcagagttatttaagttatttcacttccatgggtatcttggatctctaattttaaactgggaataacaacagtactgcctttgtagagctgttatcaggatttaaaagatcaatccatgttgagaactccaaatagcgtagtaactagagagtactcagtaaatgctagctgcatttttgttaaaaatattacccattgggatactaaaggatgtcacactgatacgggagggggggcaggaaattgaagggcggggttcctggctagggctccgcccttgggcctgtgcccactggcctgggtgaggacagggactctgaaaacagagtccctgtcctcacacccaaatgttgcattttccaaggccactctggcctgccatgccccccattctgtgtctataaaaaccccaagaccctagcagtcacacacacaagtgactggatgttgagaggaacacactggcagaagaacacacagacgccgacaggccattgacagtggaacgacagagactcagggggaaatttggccgagggcggacggacgagatcctagctgctaagcgacccgactccaggggaagaccaccttcccactccatcccccttctgcctccccatcccccttctgccttcccatccatctactgagagctacctctaccattcaataaaaccttgcactcattctccaagcccatggtactggaaaaaatggatcacacatgggcttggagaatgagtgcaaaggtttattgaatggtggaggtagctctcagcagatggatgaggaggcagaagggggatggagtggcaagggatacagaaagcgctgcgataccgaaagccctctgtccttgagaaaaggcagaggttctaactgagctgattaacagaagccacctgcggacagctaagctgaaagagcacactgtaacacatgctggaactttgggagctgtaaacattcaactctagacgctgccttggggttggagccccaagctccccataacctgcccgtctgcatgctccccctaggggcttgagctgctgggcacggaagaagcaagccactcctcctgttgcatgccctgagagggggataagggaactttgcccctttcaatacctcttacatactttaagtgtaaatgtgggtatttgtaaacatatttgaaaatcaacaatcagtccgtctggggattgattttaagagagctactgcttggtatggaggaaaacgttgaaagtgtgaaaacagagtgattgtaggacaaaccaaagttttaggactcagatcagtgaacacagtttgaagagaggctatactgagaagtgttcatccaggaaggcatgtggatgaggggagtaagggagaaagacaatagccagatcccggtgtaatggaagtacgtagagttagtgttggccttagaaagtttggaaatctcatcagaaaatacctcgttttgtcagggtccaagaaagattagaacttgagataattctaattgaaccagggtaaatgccagatgaaattgtgccaaagggcagtcttatttggagaagtgtgcagaagaggtactgaaatgcaaggtagttcattattctctctctctctgtctcttgattttcagcttttggattacatatgcttttgagaatctattaaaagttatgcattttctttccaggaaaatgcatgtgtatttataagccccacatttgccattctgatttttttgtggggttctcagacccctgatgcctgtttaggacattccaggttaagaacccctaaaatgtccttttttttaaaaaaaatcaatttctacgtagaaaggggaactggagggcacagatccttcagtgcagggcatgagtgacatggtataagccaggaacatcccacaggatgctggcatgttatcaggttccgtatgcatgcgcttgagctaaggctaaaggtagcaaagattcctgcctgcgtgaaaacacagtccttcaccatcttgattctaattatggccccatcatgtttgttacagctctgaaactgaccagctgaagctgtttttggctgggattttttccctaggccatatggaagcacttccctataatcatgctttgtgtgaaagaaatgtaggaaatgaagccatgtctccccctgagtgtgcatcactggagcctgcagaatctacgcagctcctacatccacaccttgccaagaattcattccaatcttccctgggactcaccctgagtcaggacatggcaacgagatgctgttggcacagccctgcactggagaatgtgcacaaggctgcacacagaatatcatttccatcacgcagtgaggcagacacaaggtgtaagagcctggagccaaaacctttgctatgaaaaatatcagaaatttatccagatacaacatacagatttcctgttcagagggaggaggagagagacggaactgacaaccaacataaacagctttggatgttggaaaaggaaactagaggccactcaggtattaaagagagaaagctgtaaaaacaacaacaaacatatctgtttagagagtcttgacttggcatttagaaacttagttgtatttccaggtttgttccttattttggtcttgtccacatcagggcacacgtgtgtgaggcaaataaacaagatcggcttgtctattctaagctttttgtccatttttacatggtggcagccaagcctattgatacagtgatacctaaggccaactgggaacaccagcattttgctcaagttttggcagtatgaagataaacacacactcttctaatgcattccttgacacaaatagaatcctgggctaggtggatcatggggctgcctcacagtgtaattcttaagattttttcccttcatccactgttcatttctcctttgactgtcactcccaaaaaccatttacaaatttaacttattccatagcaaggaagattgtgtaggatataaagggtctgctaacatggtaacatgaattggttttcattctcctgtcttcccacatcatctctttctacctccacattcgtctttctagggtgagattctggctggtcatactcttctatcagaactgcgattgagaaaggaatattcaaaccaaagaccctgttccttttaatggaattaaaagtttcaccctcctccatttaattcagcaagggagagtgtggcctggaaggaagactctgtgactagaaataaagactcctgggttctagtccttgcctagctcttttgcatggttttgtttgtcttctggccctgtgcatgaagagagataatggaaaaatagcatgtagactgtgttgcaaaggaatgtcatagattgtattttacatggagaagcagacagactgtgaactccctggcctcttcatgaatcaccttacacctatgatgaaatccgcgtccctctccaaagcctttaaagcctgtatcatctggcccctgtgttacatcatgtgctgccatctgctcctcattccctaatccccagttacactggctttctgggagattccagaatgtcaggtgcccattcccccgatgggcctttgcaccgacccatccctgaacctggaccatgtgtctccctgctcttcaacgtagttacctctttctcaacgttgagcacaagtgtcgcctcctcagagaggctttctttgaccactctacgtaaagtaggcccttctcttttctgtttagttcttgcttagcctttagggaaagaagtggttatttcatttatttgtctagtttgcctctcccactagtaagctttgcaagagcaggcaccatgtctatgatgtccaccattttattcctagtgctagtgcagtactgaacacatcctaggagctcagttaatgttgaacaaatgaatacatggccttcgctggagatgattctgcttcctgttatgatttcagtgggactaaatgatattgtgcaatagaactggactggaagccaaagactggggtaataacctcagtttggcctctgacaatctatcttcttaggcaagatgcttcacttactgcgacctcaactttttcatctgcacagtgagcatggacaatttataagaaatcttctagctctgaaaatctattaagtgtgtgtaatttgttcattgttaaaaaaaaatagatcttaggattgaatggagtttagagaaagaagtcccaggaacttatatgaagcaattttccaaacttttaataaagggcttgacagtgatggcttgtctttattcttaaagggcccaggaaattttagatacaccacaagaatgagttggtgtgaggtttcctcttatctcccatgaactgctacttggttgccttttaacatgttattgtcacaacctgcaagagggaggtttagtttttgcactgaccccctcattggtatgtgagctcctcaagaacctcatgcacctggcccagtacctggcacccagtatgtttccagtaaaggtgtgtcgacttgacctacacagaattgaagagcccacttagaccagcatccctatggaagcagtccttgaggaatgtgaattaaaatcagaagcagcttattagtagccaagcactgcaacacccgtggtcacccaggagacctgacacctgctgaccagctgagagcactgggattattagtaaaaatacttattgggaaaataatagtaataataatggcccccagggtttgtatgcttacactgtgctatgtatttgttatgtgtgacattatttattcttaacataaccctgcaaggtaggtactactataccctccccatttaacaaatggagaaataggctcagtgaaattaagcaccttggtcaaggtctcacaactggtgagtggtcaagatggttctgacctcagagttcatgtgcttaaccaccctcccaaagtgtcttccaaggacggcgagatgagcatgaggcgagaggtgcaccgaggcttagagtggtgggacagggaacaaagatagcacagaaatggagtcagaggggagcaaaggctgcctcagccaacccaccccttgtttccccttggcagagcccagccagctccatggttcctaacccagggtgcacatcaggagcacttggggaacttgtcccatgttctaatcctcaggccccaccctagaattttgaggggtaaatctgggcaattgcaggttgccaaacttcccaggtggccactggtgcatgcctttggttaacgcctctgcttttcagtgtctgatgccccactacagagtcagaaggcagatgactgttttatcctcaccagcctcctgatttcttagaggcagtattataaagggcagaaaatgagagttacactatgatgctcgagaacatctggacagatatttgttattagatgctgtgtgacatagtcccatctcctgcatgctgttccaaagctagccctgccaataagcacagaggcatacattattggtcagtctgcctgttaccatggtcttttgaggtaaaggcagtttaggccagtaaataaacatacgtcaggttgggagcagatgtttctgcataggagctaagggctgaagatactcatttgcagattgagcaatcagagactttagtaatgtggcctaacagctcaaggcatgctggtcagttttcagtttgcagccgattgttctcaacaaggcaaagctctgctgtgttccttccttcttttgtaaaaaatttgctgttaatttcctacatttgctttttctacttttgcttactggcatactgcatttttctcacccccatttgcaaagtagtgtatagacagtcctccagctgcagaatcagtgttgctacccattgacttttccttttttcgccttccaaaatcccccactgctcctacagaatgacagatgagcttgaagcaaaccttactatcctacttttgaaaaattgtgcagaccctgttctgtacaataccatgccaggtaactttttttttttttttttgagatggagttttgcttttgttgcccaggctggagtgcaatggtgcaatctcagttcactgcagcctctacctcctgggttcaagtgattctcctgcctcagcctcctgaatagctgggattacagtcacgtgccaccatgcccggctaattttgtatttttagtagagatggagtttcaccatgttggtcaggctggtcttgaactcctgacttcaggtgatccacttgcatcagcctcccaaagtgctgggattacaggtgtgagccaccatgccctgcctcggtaactctttttagtctaagtgatgacaaatagttatgggtgtgtgagggaattaacaaacacttttttttttttcagtttacaaaatgttgtcacaacattatctcattttaaaaaatgcattccttaaaaataaaacctattttttttttgcaattttctatagggttcaaattattagcattagcatgtatttaaaaagttttcttattttttaaaaaaactactttatgccttgggaatggtgtgtgtgtgtgtttgaatctaaatagcagaaggagaaaataaatgcaggttctataaatgtaacatgaaaaatactcgacagaaaattttgttcagaaaaaaaaacccaaccaactaaaaaaacacacaccaaaaaaataaaaaaataaacaaaacaaaaatagaaagtggggatgaggttgtcaaagtgagagtcactaagacatccttttccttgttttaccttggaatgtatatatttaggttgatgtagttccggttgaactttatagtgaaaataaatgatctgatataaattacagtgcttctgggctgaaactgatgtttattgattagttaatattgtgtggacaatttatttcctgtacatcttgctacttagcaaagctgtgatatccagcaggaaatgagacatagaaaaaatatgatggaacagctggacttgagcatttatgtgtgggagggaaagtcagtgaatcttaggtcagtccagtgattgcaaaatcaaacaagtgaaacccataaaatgaaactctgtgtgatgagtgaatttgagtttatacagcatcacttggtctcatagtagaaggatttaaaagtgtagttttgggtccttaccctggttctaatgcttaggagcaccgtgatcttgggcaagtcactttaaccttataaaattttaattgtcttaattatagaaatgagttttcattagaatgaatgaggtaacttatctcaagtttcttagcatgttgcctggtggcagagtaagtgctcaacatggttttaataataacttatacttacccaacgcctaattggcaccaggttcttttctaagccctttgcatatattacctcattgaacactcataacaaccccttggaacaggtattcctattccaagagattatcaagaatctcttaccaccaaatttcaataagacagttttggaataattccagacaatgaatgtgatcaacaggaaccagttaccaccatcaacaacaaatctaggtgtcccagacatgagcctactgttagcgacaccataagatgggatggagaggaagccttttctctccatcttatatgttttcttttttaaattagacacggtcgcctaggctgaatgcaatagcataatcctggctcactgcagcctcgaccttctgggttcaaggaatcctcctgcctcagcctcttaagtagctggcactacaggcatgtaccaccacacctggctaatttttaaattttttgttgagacaaggtctcactatgttgcccaggctgatctcaaactgctaacctcaagtgatctcctaccttaacctcccaaagtcctgggattacaggcatgagccaccacgcccagccaccgtccgctgtgttttcaataattggcttatagaccaatagaaaatataggatttcaaagcaggcttagaatcagacctgcttggcaatgccatctgcattcttctgataggaggtttcaggcagtctatactgagcttgtgctgaaccacaagcagcagtctgctctttcttactgtacttacaattgcttcctctctttatcatcgcctccagctccaggtctacctccaggccaagggggtcctttaccaggaggccatttgtctgcaatttatgaatggcccattctgaagggtaagataaagaaagcgtgggtaatagtctttgtatcagtgcaagtagaatttcaagcaaaaatacaaaatgagtactttgttgataatcaaaaaacaaatagtttgaagaatttgtgaaccaaatgccattacatcaaaatatgtaaagaaaaatcccctgtagttatataagatgaaattgaaatcagtaaaacttctgagagactttaatacattgaagtgagtgaaaattacataaagaatctgtgcaatataattactaatgttacattaataggtaacagaacattgcatggtgaggaaatataccttcttttcaaacatttatgcaccataatacaaaaactgattctatgcaacgctccaaggaagattagaaaaaaaaaatccaagtaaaacagaaaccatcagaagagacctcgccctgcagctgcacccatccattccctgcttcctcccgctacggaggcacaaatgtctgtcttcctttccaagactaattaatccctccatctgtgttctgcattccagctcctctgtgtcctcagagaactcactccacccatcatcccctctctttcctttatcttctttcactgtctctttcctatcagggttaatatgaccagcgggtctcttcccatcttaaataaaagtataattttaaaaatgtctatgtatatacatgtatatacatatgtgtgtatatacatatgtgtatatatatgtgtatgtttatatatgtgtatgtatatgggtgtataatatttatatataaaaatatttttaaattatatatatatatagaacactcttttaatcacgtctccagctacgaccctaatttttcacctactctttatcgccaagtcttgaaaaaactgtttacatttgctgtctctaatttttcatcatcaatgtattcctcagatcacagcttcctgtgccagctacttgattgaaactgctttggcaaagcacattaacagtctctttactgctcatccaaaaggcacttttaagccctcatctgcagagcacttggtactcctggctcctgcctccttaaaatcctctgcctcacaggattctcacttcatttctggtcagacctagaactgggccgtctcttgcaggacagtgaagaaatgctgaaaagtttgtgactgtggaccagtcctccctttctgccctttatgacttgagttctccctctctatatcctgcgcccgtgctgctcaaaatgtggctcacagtctagcagtatcagcatcacctgggaggctgctgctggtcgggcacattcttgggctccaccctaaactgctggatctgaatttctatgggtggagcaggtgtctgtgttttaacaagttttctagatgattcatatttaggtaaaatgtttgggaagtactgccttatcagcgtatcacagagacttctacaaatgtatgaaactttagtggagggttacagaaatgaaagggaattccagtttaggagatgatccttataggctgctccttgttcttagctttgcctgggtgctcggcagtgtgctttctctccaagagttatatagtaggcagctccacccagaagaacattttcctcaagtttgaggctttttggctaaaatcaactgcaagggatttgatttgcagggtttcattaaagtgtgtaattatcaatgggacaatggttggaatatacacatatatgcacacacacccctagacaaatgcttccccaagataccacagcctacattcacaaagattttgcaagagagcccaaccaatatgcccaaataggttttcttcagttcagtaaagctttctaatttatatgtattttcaaaacaatttttattacatatataatatgctgtatatgtgttgtaaaaaaaatccagaatatccaggcaaggaaattgacaaacatgtcatgtattcaatcacactgccaagagattacatgtgttatcatattagtgtgtatccttccggggatgaggtgaagtggttgaggatgcataacatatattgataatttatattgtaaaattaatacatactttttataaaacttaaaaagttttttaaacttacaaaaacttcaaatggcacagaaggatataaaatggaaagtaaatgtcaccctctaccatccacaaactcctaaccagttccactttttagaggtctaaacaggatgaatggttgcttctattaagatatttcctatggatgtgtatgtgtgcacctttccatacaaacatgtatgcttttgagaagtatacagaattgatcattaggtataaacttttttacaatttctttttattcactgaggtttttttgcctatcagttctcataatttggcttgttttttttgtttttgagatggagtcttgctctgtcgcccaggctggtgttcagtggtatggtctcggctcactatgacccccgcctcctgggttcaagcaattctcatgcctcaacctcctgagtagctgggattgtaggtgccagccaccatgcctggataatttttgtattttttagtagagacagggtttcaccatgttggccaggctggtcttgaactcctgacctcaagtgatccacccgcctcagcctcttaaagtgctgggattacaggcgtgagccactgcacccagttggcttgttttttaactggtgatataaaaggacattacataatttatttaaccagactcatatcaatgagcatttagattttctctcagtgttacaacaactttgtacttttgtgcaagcatgtctttatgtgcttttagttctcaaagatactgtaatttctcttctctcttcataatcttcttgacattttgatttttctgtgaactagtttttcaagtgtctgatcaattctcctgctaatttgtgtttttttcttactgatttgtaaacactctggatattaagaaaacagtctttgcctataattataatttttccttctttgacatttaattttgcttaatttttatttcaaatgattaatattttccttcgattttctcaaggcatttttttatatcttgagagagagagatttaaatgttgtttttgtaggttgtgtccatttttggggggctggaaatggagtctcactctgtcgcccaggctggaatgcagtggcgtgatcttggctcactgcaacctctgcctcctgggttcaagtgattctccagcctcagcctcctgagtagctgggattacaggcacccaccacgcccagctaaattttgtgttttttagtagaaatggggtttcgccatgttggccaggctggtcttgaactcctgacctcaggtgatcctcccgccttagcttcccaaagtgctaggattacaggcatgagccaccatgcgcagccggttgtgcccattttttaaaagttcattccaacatattctatcttttctctagccattgcaaatggggcattttcttccattatttttctaaatgattattcttggtatttctaaaatctaataattttttaatattaatttcttcttgatttccaatgtttagactatttttttcttgcctaattaccttggctaatcttttaaaaactcttcagtcatacggtgctgactggtatcccatcatttccccaattaaacagcagtgtttctaatgtttaagcattaagcatattaatcatgacttgcatttataaatggtgttacaaacatttactttattttatatacagaatttttatcaggaataatgactgaattttactaaatgctggaaacttatttgaggtaatcaaacttttctactttgtctattaatatagtaaattacattagtaggtttcctaaatttgagcaacactagcatttgttgggtaaacttcatttgtatatagtgcataattcaaatttatgattaaattttcttttcaaatattttacttaggaatttggtatcaaatagatgttaatgacattggaatgtagttttatctccaaaattgtactgtgtaaaattttcaagcatacataaaagttgataaaataacacaattcactactgtacattttttcaactagattcactaattacttatattttgctacattggttcattatccctatcactctatctctatctatctatctatctatctatctatctatctatctatctatctatctaattcctccatccaactagctagctgacccttgttaatttacagacatcacaacacttacttctaagtattaatactttagcatgactcttctaaaaataaggatcttcttcataacatcatctcactagtacacctaaaaaattataatttctaaatattatctaatatccaatctatgttaaaatttctccttttatagttgtttttccccttgaactggtcaaggctcactcattgcatttagtttttctatctctttagtttctttttttttagtgcacttattttttcatggtatcgactttgtaaagagttcattccagttgtattttagcatgtcccatattctggatttgtctaatccagacaaaatttgttaatttgattaatttgttgatctccctcacgtaattcctgtgaattgatcagcaaggtcttaggtttaattagaattggattgaacatttgtggcagcagcacatcaaaagtgatgcgtgatttatgttgcatcatatcaggaagttgatgatgtcagcttgatccagtattactcacacaggtggtgaactacacatactgtgttgtatagatccatgtttccctgtaagaaatctgcagagtgatgccttgacaacgtgtaaatattctggcttgcaacagtctttcacacaatggctttagtgtacattgatgatccttgcctgaaacagtatttaacacagagagttgcaaacggttattttctaattctatcattccttcttcactcattcttctgtttttaaaaaaaggtttctgtttcttaatttctcactctgtattcagagatttttatttatttaatgttttatatgttactgacaatattctttttgggtttcaaattgtccaaaatgtagccagtgggagcactttaaactgtcttcttttgtcataattccattgaattttagacattgccttggtttctagagcaacaggtgttccaagcccaccttgaattttccctactccagacctggcattacctggtttttcatggagagttggttatttttagtggactttgtgtgtgtgtgtgtctgtgtgtgtgtgcatatgtgtctatgttgggttacaccttcaacactcagccaaggtaattgacaactttgttctggcctttacttcctgcttccttagagtctgtaggttagccatagatgacagcttaggaccttctcaggttgtttctgggcatgcacaaagctctggcatacgcagagccccacatagacatgcggtcttctagattttcaggaatatgttggagtttttcaaaaccacctgtggacatctcattcccagctttttggttagcttattgttttccccaattgttatccaccacctcatgcagcctcaatgttatataagtatctctgattgttttggacaaatgcctcctggggaaaagctgtttacactgggcaaactcccagttagataaaccaaagacagctttgtgagtgaagtcttccagggaaccactacacaggtcaaataataattgggaattgggcattgaaggagctccaaacccattctacccctgcaaagtctgccaggctgctggtttgcactatgattacgggctgttgttttcaaggttaccatggaggtggagaatggggagagatggaaataggcagcttagcatgccacaaagctcactgttcttactgagcatttttctttgataattactgctcagattgttgcaagcctttggttaatttccagagttttaaaaatgttggttctgaccatgtttttactgattttatggaggagaggatttttcagaagtctttatcacttttgcttgtttgttcaaattagtctctacaaaaaattcaaaaattagccaggcatgctggcatgcaactgtggccccagctactcaggaggctgagttgggaggattgcttgagcccaggaggtagaggctgcagtgagcctagatcaggccactgcactccagcctgggtgacagagtgagaccctgtctcaaaaaacaaaaacaaaacaaaacaaaagaaaaacaacaaagcatgatgaatgcattaatcttttctttacttaccagttttcaaaaacgatgagctgtttgctagcctccttaaaatgactgatgctgtagtatgcatcatttcctttcctttccttttttttttttttccccctgagacaagctctcactgtgttacccaggctggagtgcaatgggttgatcatagttcactgcagcctcaacctcctgggctcaagtgatcctcccaccccagactcccaagtagctgggattacaggcacacaccaccatacccacattaaaaaaaaattataaaattttttggtagtgaccaggtttccctatgttgccccgactggtctcgaactcctgggctcaagccatcctcttgccttggcctcccaaactgctaagactatagatgggagccaccatgcctggccccctccttttttttaaaaaaagctaaataagaatccattgtaggtatataccaaaaaacatctgtgagaaccatgatttccagtaggtaattgtctaggccaaggatcacgaattttttctgtgaaagcccagatagcacagtaaatattttaggtttattgagctgtatgatcttcactaccatgactcaattctgcctttgtagagcaaaaacagccttatccattcatccatagacagatacttaggttgtttcttcctttcgtctattgggaataatgctgccatgatcatcaatgtaccaatgtctgtttgtgtccctgctttcaattcttttgggtatattcctagaggtggaattgctggatcatatggtaattctatgtttaatatcttgaggacttgccatactattttccatggtagttgtaccatttaacattttcaccaccagttcacaagggttcttttcgccacatcctcaccaatacttgttattttctgcttgttttgttattttttttgtgtgtaattctcatcctaataggtgtgaagtggtacctgattgtggttttgattttcaattccctaataattattgatactgagcattttcatgtgcttattggccatttgtatagctgttttggagaaatccaagtccttttgtcctttttattgaataggttgttttttgttgttgttgagttacaagtattctttatatatgctagataataacccctttccaagatgtgatttgcaaatgttttcccccattccgtgggttgcctcttcattctgttcatagtgtccttttgtgcacaaaggtttgattttgatttggtcaaatttagttttttttcatgtgtttcctgtgcttttagtgtcatatccaagataccactgccctattttttaaccttccttttttaaagtcttcaatgtgtatattggcaggctttccacgttaggtcatatagcttcttatcattacttttatcagttgtagagtattcctgagtatggatgttcttgtttatgtaatctttcccatattgatggacatttaggtacggttcagtctttccttttacatgtatacatgttaaacaaacaaaaaatctggaatggacattcatcaaagtgttagaagtgattatctctgggcaatagggttagaaaaagatttattttgtatttttgtttatctacattttctaatttttaataataaacaggtatttctatttaataaaaacttgcaaactagtcaatcaatatattgatatcctttgcttcactaatttcactctggagagtttatccaaaaaaaattgttttgcgtaagttagacaaaaacatctgcttgaagtaattcgtatcattgataatgttctagtttcatttagaaacagacaatcttcagagaggggactagtgagataaaatatcatatatgagcttagattattatgtgaacacagaaattaaattatcagtgtatgtagcagtgtgaaaaaacatctctgaggaccaggatttccagtaggtaattgtctaggccaaggatcatgaaatttttctgtgaaaagtcagatagtaaagtaaatattttagccttattgagccatatggtcttcattactacaactcaattctaccttgaagagcataaacagccttaaatgaatgaagagatgtggctagatttggcccaggggccacagtttgcagaccctcatcaaagcacatggattgggccatgagagtaaaggtaattgaggtaggcagtgcatttactttaaacgtttctttaatgttatttaagggtgtatttaaatgaaattatgtaatattcatctgctttacacatagtttgtgatttccaaagatttatttatttttttcttgagatagagtcttactctgttgcccaggctggagtccagtggcacgttctcagctcactgcagactccatctcctgggttccagcaattctcctgcctcagcctcccgggtagctgggactacaggcacacgccatcacacctggttaatttttgtatttttagtagagatggggtttcaccatcttggccaggctggtctcgaactcctgacctcaagtgatctgcctgccttggcctcctgaagtgctaggattacagaaatgaaatatagttaagaatattttgcagacgcccccagttttgattgacttgctcattttcatgggcctttagtgtactggttttattgcagttgcgttctgttctttcccaggagaagaaaatgtaattgctgttcctttgggaagtcgaagtgtgagaattacagtgaaaggacctgcccacctctgtaagtagaatttaatcttaacattttttaatatcctgaaagtttagttagccaaaaaaaacaaaaaacaaaaaacccacaaaccaaaccaacaagcaaaaaaactttctctaagttaatgggtaatgttactgaacttgcgtccacttacttggcacagcaaagctaaacactgacattaggatttgcagccagagacagtgaggcatttattgcagagcaccaagcaaggagaatcaaacagctcatgcttaagacctgaactcccagatgtgttacatgtaaggatttttaaagacagggagatagaagttacaggcaaagtcacaaattaatactggaggctacgcactggtttgacctgaaaaggtggaatatcttgaagtgggggcttacagaccataggtagattcaaatattttctgatttgcaattggttaagagagggaagttttgcctaaagacttggagtcagcagaaaagaatgttagatctggcccttgggcgtgatctcctccaggtgcctcaggaagaaatgtaggacaaagaaaggcagtcagagttcagcctcagttccctcttaccggaggtctctgtgccggtggatccatttggtagggatctagatttcctgaaaaactacccagggacatatgttaaaatgttatcttcagtttctatagggaaccatacatcctgtgactctaactttttctggctattgttttaatccactattaccttgttgcctgtgaagttgctcattacttctcaaggctagctagatgcctggaatttctcttgaaggaattcaagattttcccttatttccattcatgggggtggtggtaccctgttgggtacccccaactattctgtagtgggcaaaatagtctatataaccagggaaattatctgtattgtaccctgaatttttctgttctcataccccaatgggaaatttgcctgtttaagattaatcccctcatgggagaataaaaaccaaattttatgtcaaataaactatttttgtataggatggctgggtgtggtggttcacgcctgtaatgccagctctttgagaggctgtggcaggaggatcacttgagtctaggagtttgagacaagcctgggcagcacaggaagaccccatctctacgaaaaattaaaaaaaaaaattagctaggcatagtggcgcacgcctgtagtccaagctactcaagaggttgaggtagtccagggagtagcttggctactacaggcatgtagtccatgctactccttgcgcctaggagttcaaggttgcagtgagctctgattgcaccactgcaatctgccactccagcctgagtgacacaggaagaccatgtctctaaaataataatagtatatggagagtaaagtaagatttgggaatgttctggagattttagcaaagtgggacaaaacaaaacaaaatttaaaatacaaaaccttatcagtgaatatggccgatcagaacaagccttgctgctagcacatcacagcttcccatgtaggggtccctgaaggctgacactgttttcccagaatactgtgattttcaaataataaatagattattgtgatgatttcactctgggaatacactgaaaccattaaattatgcattttaaaagggcaaagtttatggcatgcaaagtatatatggaaaagatgcttaaaaaacaaaaaaatgcaatggatggtcttgatattctcatgatattaaaggccattccccaaaattcagctccaaaactagttttataaattgtaaaaacagaataagtaagcaataaatagaataagtaaaggtgagggaggtggagccaagatggccgaataggaatagctccagtctacagctcccagcatgagtgacgtagaagacgggtgatttctgcatttccaactgaggtaccgggttcctctctctggggagtgtcggagagtgggtgcaggacagtaggtgcagcacactgagcctgagccaaagcagggcaaggcatcgcgtcacccgggaagcgcaatgggtcagggaattccctttcctagtcaaagaaaggggtgacagacggcacctggaaaatcgggtcactcccaccctaatactgtgcttttccaatggtcttagcaaatggcacaccaggagattatatcccacgtctggctcagagggtcctatgcccacggagccttgctcattgctagcacagcagtctgagatcaaactgcaaggtggcagcgaggctgggggaggggcacccaccattgctgaggcttgcctctgtagactccacctactccacctaggggtgcctgcctgcctctgtagactccacttctgggggcagggcacagccaaacaaaaggcagcagaatcctctgcagacttaaatgtccctgtctgacagctttgaagagagtagtggttctcccagcacgcagcttgagatctgagaatggacagactgcctcctcaagtgggtccctgaccccggagtcaccccctagtaggggcagactgacagctcacacggccaggtactcatctgagacaaaacttccagaggaacgatcaggcagcaacatttgctgttcaccaatatcctctgttctgcagcctccgctgctgatacccaggcaaacagggtctggagtggacctccagcaaactccaacagacctgcagctgagcgtcctgacttgtagaaggaaaactaacaaacagaaaggacatccacaccaaaaccccatctgtacgtcaccatcatcaaagaccaaaggtagataaaaccacaaagatggggaaaaaacaggagaaaaactggaaactctaaaaatcagagcacctctcctcctccaaaggaacacagctcctcaccagcaacggaacaaagctggatggagaatgactttgacgagttgagagaagaaggcttcagacaatcaaactactccgagctaaaggaggaagtccgaacccatggcaaagaagttaaaaaccttgaaaacaaattagacgaatggctaactagaataaccaatgcagagaagtccttaaagaacctgatggagctgaaaaccaaggcacgagaacgtgacgaatgcacaagcctcagtagccaattcgatcaactggaagaaagggtgtccgtgatggaagatcaaatgaatgaaatgaagcgaaaagagaagtttagagaaaaaaagaataaaaagaaatggacaaagcatccaagaaatatgggactatgtgaaaagaccaaatctacgtctgattggtgtacctgaaagtgacggggagaatggaaccaagttggaaaacactctgcagggtattatccaggtgaacttccccaatctagcaaggcaggccaacattcaaattcaggaaatacagagaatgccacaaagatactcctcgagaagagcaactgcaacacacataattgtcagattcaccaaagttgaaatgaaggaaaaattgttaagggcagccagagagaaaggtcgggttacccacaaagggaagcccatcaggctaacagcagatctcttggcagaaactctacaagccagaagagagtgggggccaatattcaaaattcttaaagaaaagaattttcaacctagaatttcatatccagccaaactaagcttcataagtgaaggagaaataaaatcctttacagataagcaaatgctgagagattttgtcaccaccaggcctgccctaaaagagctcctgaaggaagagctcaacatgcaaaggaacaactggtaccagccactgcaaaaacatgccaaattgtaaataccattgatgctaggaagaaactgcatcaactaatgggcaaaataaccagctaacatcataatgacaggatcaaattcacacataacaatattaaccttaaatgtaaatgggctaaataccccacttaaaagacacagactggcaaattggataaagagtcaagacctatcagtgtgctgtattcaggaaacccatctcacgtgcagagacacacataggctcaaaataaagggatggaggaagacctaccaagcaaatggagaacaaaaaaaggcaggggttgcaatcctagtctctgataaaacagactttaaaccaacaaagatcaaaagagacaaagaaggccattacatagtggtaaagggttcaattcaacaagaagagctaactatcctaaatatatatgcacccaatacaggaacacccagattcataaagcaagtccttagagacctacaaagagacttagactcccatacaataataatgggagactttaacaacccactgtcaacattagacagatcaatgagacagaaagttaacaaggatatccaggaattgaactcagctctgcaccaagcagacctaatagacatctaccgaactctccaccccaaatcaacagaatatacattcttttcagcaccacaccacacccaaaactgaccacatagttggaagtgaagcactcctcagcaaatgtaaaagaacagaaattataacaaactgtctctcagaccacagtgcaatcaaactagaactcaggattaagaaactcactcaaaactgctaactatatggaaactgaacaacctgctcctgaatgactactgggtacataacgaaatgaaggcagaaataaagatgttctttgaaaccaatgagaacaaagacacaacataccagaatctctgggacacattcaaagcagtatgtagagggaaatttatagcactaaatgcccacaagagaaagcaggaaagatctaaaattgacaccctcacatcacaattaaaagaactagagaagcaagagcaaacacattcaaaagctagcagaaggcaagaaataactaagatcagagcagaactgaaggaaatagaaacacaaaaaacccttcaaaaaaatcaatgaatccaggagctggttttttgaaaagatcaacaaaattgatagactgctagcaagattaataaagaaaagagagaagcatcaaatagatgcaataaaaaatgataaaggggatatcaccaccgatcccacagaaatacaaactaccatcagagaatactataaacacctctaagcaaataaactagaaaatctagaagaaatggataaattccttgatatatacaccctcccaagactaaaccaggaagaagttgaatctctgaatagaccaataacaggctctgaaattgaggcaataattaatagcctaccaaccaaaaaaagtccaggaccagatggattcacagctgaattctaccagaagtacaaggaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcaatgcaaaaatcctcaataaaattctggcaaaccaaatccagcagcacatcaaaaagcttatccaccatgatcaagttggcttcatccctgtgatgcaaggctggttcaacatacgcaaatcaataaacgtaatccagcatataaatagaaccaaagacaaaaaccacatgattatctcaatagatgcagaaaaagcctttgacaaaattcaacaacgcttcatgctaaaaactctcaataaattaggtattgatggaacgtatctcaaaataataagagctatctatgacaaacccacagccaatatcatactgaatgggcaaaaactggaagcattccctttgaaaactggcacaagacagagatgccctctctcaccactcctattcaacatagtgttggaagttctggccagggcaatcacgcaggagaaagaaataaagggtattcaattaagaaaagaggaagtcaaattgtccctgtttgcagatgacatgattgtatatctagaaaaccccatcgtctcagcccaaaatctccttaagctgataggcaacttcagcaaagtctcaggatacaaaatcatgtgcaaaaatcacaagcattcttatacaccaataacagacaaacggagagccaaatcatgagtgaactcccattcagaattgcttcaaagagaataaaatacctaggaatccaacttacaagggacatgaaggacctcttcaaggagaactacaaaccattcctcaatgaaataaaagaggatacaaacaagtggaagaacattccatgctcgtgggtaggaagaatcagtatcgtgaaaatggccatactgcccaaggtaatttatagattcaacgccatccccatcaagctaccaatgactttcttcacagaattggaaaaaactactttaaagttcatatggaaccaaaaagagcccacattgccaagtcaatcgtaacccaaaagaacaaagctgggggcatcacgctacctgacttcaagctatactacaaggctacagtaaccaaaacagcatggtactggtaccaaaacagagatatagaccaatgggacagaacagagccctcagaaataatgccgcatatctacaaccatctgatctttgacaaacccgacaaaaacaagaaatggggaaacaattccctatttaagaaatggtgctgggaaaactggctagccatatgtagaaagctgaaactggatcccttccttgcaccttatacaaaaattaattcaagatggattaaagacttaaatgtttgacctaaaaccataaaaaccctagaagaaaacctaggcaataccattcaggacataggcatgggcaaagacttcatgtctaaaacaccaaaagcaatggcaacaaaagccaaaattgacaaatgagatctaattaaattaaagagcttctgcacagcaaaagcaactaccatcagagtgaacaggcaacctacagaatgggagaaaatttttgcaatctactcatctgacaaagggctaatatccagaatctacaatgaactcaaacaaatttacaagaaaaaaacagccccatcaaaaagtgggtgaaggatatgaacagacacttctcaaaagaagacatttatgcagccaaaagacacatgaaaaaatgctcatcatcattggccatcagagaaatgaaatcaaaaccatgatgagataccatctcacaccagttagaatggtgatcattaaaaagtcaggaaacaacaggtgctggagagcatgtggagaaataggaacacttttacactgttggtggaactgtaaactagttcaaccattgtggaagacagtgtggtgattcctcaaggatctagaactagaaataccatttaacccagcaatcccattactgggtatatacccaaaggattataaatcatgctgctataaagacacatgcacatgtatgtttattgtggcactattcacaaaagcaaagacttggaaccaacccaaatgtgtaacaatgatagactggattaagaaaatgtggcacatatacaccatggaatactatgcagccataaaaaaggatgagttcatgtcctttgtagggacatggatgatgctggcaaccatcattctcagcaaactatcacaaggacaaaaaaacaaacactgtgtgttctcactcataggtgggaattgaacaatgagaacacatggacacaggaaggggaacatcacacaccgggtcctgttgtggggtggggggagtggggagggatagcattaggagatatacctcatgttaaatgacgagttaatgtgtgcagcgcaccaacatggcacatgtatacatatgtaactaacctgcacattgtgtatgtgtatcctaaaacttaaagtataataaaaaaaaagaataagtaaaggtgaacactttgaggcaaaaattcatttatgtgtatatgttctggcatattcaacataactttatattcaagactggcactcgtccaagaacagggctcagaaatgttcccatttctccaagagtgacaaatctgttgcttggactatttccctttctgaacaatctcacaattggcagtagaagtatttctgaaagttatccttctttgctgatgaatagaactggcttcatttactaaggacttagttaacatttctgaatatctaaatatagaagtggttttattttctggatttatgcaacttttttcttagtttttatttgtaaaagagatatttctgaaatgaagcttattttgcagtaataaatcattcttttaatatccacattaactataactatccaaaagactgcattactaagaactgaaaatacccagcaacatcaatgtcagtctctttgctgtgaagtgaattttaattacagaatatccatcttacatactgcctagaggtgtttgtttagatcctgaatttccagtcctgtcccaagcctggccacagcattatggggagcacacagccccaaattttccaggagtgcatcccttcaaaaatggaagcaataagcagatccctgcaaaacagattttattgtagcaaaaccttagcattaaatgtgtttaactagcagtaaacttaagaagccaagaggtcataaaccaaaaacctccaattcagttggaagaatattttccctttaagccctatctgaggaccatatatagagatgtataaatataagcatggatgcagtacctgatgaccagtcaaaggaaattgacatgaatgaaattagcatatgctatagaaatacagctctactgtacatataagtttgatgtatttataactatgttagccatgctaaacactcattccacatttacctgacagtactttcatggcctttagaatttagggagacctcttggggatggttaccatgaccctgccttttttgaaagaagcctgaactgatacttctcagtgcagatccttcaactagaagcaattagaagcattcatcattttctaggcataatttcttttacaaataactagtagtggattaaaatatttaaaggcatcactagagacctgagttgtgaagattttgggatacaagaaagtcttgatttctaatttttactctttttgagactacctatcatatcttcctcaacacttccctccctcccctcaatattaagtctggagaggagaaagaagttgggccgtgggcagcaggaaagaaggctcacactctcttcccttaattctggtggggatgcttataggcttcctggggtcgcctacacactaaccaccttgctgcggaaaccacagagggtcagtgaaacctctgagaaccgaagggcttgtgcatgcagctctcactagctatgaatcacacattgtgaacaacatggggctacagtaaatatagggaaatggtggaaattaataaaaacttaaaggtatccataagtcaatacatcatctgaattgttgattgaaacaccacaaactcctttttttgtcatttatttttaagaggcaccagcacaaagaagcaagtttgccaccaataaaaatgacaacttttaaagaactgcatcggcctccaccttgctgtggattgggcacagtggctttgttaatccagattatcagaattgtttgcatccataaactccaccttcaccaaatcacttcaccagtctttcttcacccacctttgactctgcttacccatttacacaattgaggtcaaaacacctgctttctgcctcctagataggcaaccagtgtttgtgctttagagaactggaagccttttgaaatactcaaattaaaaatattttacaataagcgtaccatttagtggagaagcagagtggtttgggtaatttatgtgaacttgaaaattgtttttgctacttgtgtttttatatccatgtcactgagactcttagacaccattaaaatagtggctagattctgtattaaaaacaaagtatcaaaaccaagttaacaaaaatgctggcctatggtttagggaatggatatcgtagcaactggtcctcccttcctcccagatcaccttcccagatttttacaccccttgccccaattctgcatcccgatctgcaacttggaacgctgtggtccagaaggttagcacaatggtaaagcaattactactccaacacagccgcggaatccattgcacgctacttgaatttaatcaagtcatttcaggctaaatcagtgtctagaaacttgtattttgcatgccttctgtgaggatgtgttatgttccactgaactttgcatcttaatattgccttaatgctcttattgcttatcatttttttttctcatggactttagagacatccattgtagggcccatttactatctctagttccccatttcatttttactgacaactcactttataacactcagttttatatcttcattggaactaggaaatgaatttaatctcacactttccaaaaatctattgcggtcatggagatcagggccaaagtggttggggttttgtatgcctgcaagtagccagcattattcttcgaccactaatgactcctccagatcaagtagctcatgtccagcctttgaattttcccagaaaagttcccagcctgcctgtcagggataatcagggatgtctcctaaggcctgttatgcagtctgtccagggcacttgaattcctgcagctgctccagtgacagagaaaaatccagcaaatgaaaacaaccaaagcccagcaggctatggatggaagctccctaatgctggacgattttgttgcattttatcagctttccatttttgacactcaacggagttttggttcttctgtgttctttgtttgagatttttaaagactggtatgatatcattgaatcaagtgtgggttttagaatagagctggacctgagagattgtctgctctgactcctcattttaggtatgaggcaatgaaaacccaaggcagaaagttagagaaaaatacggggccagaaacgcaggtgccccagaacctagctgtatatacattttttgttgcctctctcaacatgaaaccagatctactaagtgtggtgacacttagaaaataaaagaaagaaaagaaagagggaggaaagacagaaatttaaataaagtacaaatgtttttttgtttaaactgtgataagcaaactttttttctgtaggaaatcttaaaagcacttttgttcatgtgaaagcaaattcacataaaggggtttcatgcacaagggaggtctttgtggcaatggagtggttctgtattttgattgtggtggtgggtgataaaatggcattgaactatatgcacatattgtaccagtgtcaatttcctggttttgatattcaactatacttttgtaacatgtaaacattagacaaaagggaatgaaggttacaaaggacctctctatactatttttgcaacttcctgttaatctgaaattatttcaaaatcaaaagttttgtttgataaaaagcaaatttgaaatttgctgtgatttttgtctaaaagagtaggcataagatcttttgaacaagtaataaaatgagtgaacatagctttactttgagtattagctaaatcatgaaaacatataaagaaagaaaagttttctctttccccttatgctagaaatggctccaaatatttgagtagaactatttgggcctgccacccttgttagctccttttgttacgggcaattaaaaatctgatatatctattccaccaatatcaatgaatgtttgtaaactgagtggctattttgacattgttttgatatcatatactgacattgtatttgctaaaatgtcttttgtaataaaatacctttaagattgtttcttatttgaatcatatattttaattttagttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaaggtaggatgatcctcttcataaacttcatgtacctgaatcccagaacatcttgatttttaaaacaatgagtttgtttagcaagaggtcatcaatcattgttttttatacagagcatgtgtcatcaatatttccatcttggcagtccattcttaaaaattgttcagcactcttaaatttctgctcctaaccctaacagttaaaaaacaaacttcacttttatgggggaaggattgattctgtatttataatctctggttgctttgttcagtttgtttgttggtttaagaaacagggtctccctgtgttgctcaggctgctgcagtggctattcacagctgcagtcatagccttgaattcctgggcccaagtgatccttctgcctcaacctcccaagtagctgtgttcagttttagatagagtttggtgaaaacggccgatggttaaatgcaccatatcctaaaccagtattgtgccgctgcatgtcttcttgcaaaggagagcagagacaacagcggctcattccttagcctcctttaagatagttatccttaaggcgtctttacttcgaccttcagcccttagaacatgcagtcttgcggtgggctgattcaagatcaggatttgcttccccagatgttctatgacagatacttgtcacaagataccttcagaagaactcttcttctctggaaccatgagcctgtgtcccctctctggatactgctggggcatcttccctcattcagaggacatgaagtatagtggccaatatatttccaaggtgacacagtttgaaactcttctgataaatttgaaaatgcctaagaaatgaaaaagatagttcagtgtgtggttttgccgtatcctgtttcagaaacccattccaaaatgtaaatggaagctaggaaatagccccaattaccagttatatttttctgtatgaaaaaaaccctttagctttaaaaagctgtctgtgttctacatattaatttgtcacggaatgtttcactgagacatcagttgtgtcagcagaggaacatgcacggaggtagattagagttgctgactcatcccaatccctgagatacaaattcagcctgcagtgggactggccaagcgttggcctgcacagtgtattgttttgtttctgaaactttggattttgaataatcaactcttaaaaatcaagagatttttacatcaaaagatcagggtttgttttttttttctttctgcttctctgtaaaaatgggaagagcttgcattttacaatagcaataagtgactgtaactgaggaacagctgccttccagtctcgggtctgccgtggtccacaccactgtgtattgtgtccctaacactaaaggcgtaagtggttggttgccattcatcctgatctgggcatttatagcatctgcctagcctccacagacatttatgtttctgacttctgtgtcatatccttaaagcattgatccaatagtcttcttagacagtcatattatgaaaggttttggggaagccataattacctttttttttaaagtctctctctggtctattgttatgacataaattctatgctttccttgccctccttagggccttcctatgtgattctcaagtagaaaatatacaccacacacacacacacacacacacacacacagagtttttgttctcttttaattactactcagagaatctgtattcttctcaagtcaacttggaggtccttgactgaataggagacattaatacaatgatgaaacgaggaaagtacccacaaagattagtatttcaagatattgtttggttacagtgtcagcatcagtagatcttaataatatattgtttattgacaccatttataaaaacacacataagctgcatatttctatgagtttgtatgtacacacacgtatatgtatatgtatatttttaaaaataatttggaaggatacatttcaaaatggaaacactgaaaacaacagtgactattttagaggggataacattttgtaatatctaattcttaaaataatgtttaaaaggaagaatgtggctgggcgtggtggctcatgcctgtaatcccagcacttagggaggccaaggcgggtggatcacctgaggtcaggagttctagaccagcctgtccaacatgatgaaacctcatctctactaaaaatacaaaaatagccggacgtggtggcacgcacctgtaatcccagccactcagggggctgaggcaggagaattactccaacccaggaggcagaggttgcagtgagccaagatcgcaccactgcattccagcctgggcaacagagcaagactccatctcaaaaaaatagtaattaaaaaaataaataataaaaagtaaatggaagaatgaattcttttgaagtggccaagtcaagtagttgaatttgaattcatttttataccattggttttttttgtttgtttgtttttgagatagggtcttgctctgtcacccaggccaagtacaggctgcaagtaatcctctggcctcagcctcccaactacctggaactacaggcacacaaccccacagccacctaattattaatttttttgtagagacagagtctcactatgttacccaggctggccttgaactcctgggctcaagcaacgctcctgcctcagcctcctaaagagctgggattagaggtgtgagccaccatggctggccacatacttttattataaaactcattttcctcatcaaacagtggtaatacacttttgcaaatgttaatgtgcatttctcttttgccattctctgtacttcaccatctgctttgtcagcagagctgtttgccctgcggatttgacagcagtggtatggcaggtgagtgattagcaggagtgcaagagaaagcattcatgctcatcttttcatgattaaagtagggttattattatttttagcttagtcttttgttttgacagccacccttagtggagagagatgaagattttccaaattgatttagtccccataacatttccagggccaagcccggggtcctaacccatagcacatcttctataacatggagaggatgctcctttctccagtaaggctgcacctcggtctagtgtcctcaggaggatgtgcaccacagggcatgtccagccaggatgtggaaagccttctccctctcctggcgccaggacaaaggaagcgggcagcgagccatgaaattcatgatggtggttgctctccagggcagggaggctttcagggaaagccaaaagcagaaaaggagcttttgctcccatcccacgcagagctcccagaggaaagcgcctcatagggatcccacctccatcagcagcaacccagagaagccacatgagagtgaaagtggaattagtgccatgaaatgtttagtcacaggttgagtctccccggagtctccttcagttcctgagtggtaatggaagacatctagaaaatttagtgtactcctgactggccagggggtgacatggtgctggcaaaatgaccctttagcggagaggtgtaggtagagagactatgggtcctattttgttcagaaaaggcccagtttgtgcctgttacccctgcttaattgttagtagctcctcctttcactctcagagccatcctggcatgaacaataaagccgatggtctccctagatgcagagctctaaagccagccaaggattggataggggtcccagccacaccaccgagaacgtgcagcaagacaagaatgacagtgtcgagggactaggggaaagatagtgtgctcactggcagcaattagggcccatctgaggatatcatgcatggatttgagtaagttgctgtgtatttgccctgcactgaaagtaaaaggcactggtccaggtgtcacatgtgaacaagacgatgtgatctccggaagcccggtaggcgtttgtctttcttgtggaccttctcagcgaggaaacctcagaaactccacagtagaccttttaccacctctcatcgacaagaattgggtcacgtgcccactctataccatccaccactgtgttcatctgggtcctctaagaatcaaatgccaaggcaggatgagaagtgaaagaaatttattcaggaaatgcctgtgagaaaaaagagggagagaaagcagggtgatgctgagagagccgtcagtttgcactgaaaatctgaccatgagtgaaggagagagggaaggaaggaaggttggatacaagcatattaaatgcagtaggttctaggagaattcagcaaagctggagaggaaaccctgagccaatgtcattcatcataggactccagtgtctcccaagaatggctctgccttcagtacccttgctgtgcttagtcactggctaggagcatcccatgggaagcttgacccagaactggggctgttggccagtgacaccctttgcagttgtgtatctgagcagaacactcatgggtcctgccactagcaaggcaaatgtgaccatggtgattcacgtagaacaatcaggatgtgcggtggctcacgcctgtaataccagcactttgggaggctgaggcaggcagatcatgagatcaggagatcaagaccatcctggccaacatggtgaaaccccatctctactaaaaatacaaaaattagctgggcatggtggcacgcgcctgtaatcccagctacttgggaggctgaggcaggagaatcacttgaacccgggaagtggaggttgcagtgagccgagattgcacagccgcactctggccgggtgacagagcgagacttcatctcaaaaaataaaataaaataaaataaataaaaaaaagaacaatcaggatgtatgtgtaagacacaggaggaaggaatgaacaagaacaaaattgagtgtctgtagactggaaaggagaaatggatgctggtaggcaatgaaatgtgtctactacactaaggatttctctttctgtaacacatctggcttaatgccttttctctctttttttcttttcttttcttatttttcttttcggtggtaatggaaaagacttagaaaccatttatgtttctcttaggcttattattttagccaattttgaaatttacatttttctacggaagtatccaattcatccatttttcaaacttagctcttcaaatgtaatcatggtattcccttattgttaaaaacaatctcctctttacctataacaatgtctctttcattcctaaactcgtttattggttccttgcgtaattgttgttttgttcagaccatccaaacattgtctctgagacatctaacaactacatttttgttttgttcgttaactcagagttttttttacatttctatttatataaatttttatttacttcttttatctttgtatgggtttattttggtattatattttcagctgctagagctgaattcttaattcattctattttcattttttttctccattaaatgtatttagggctatcagtttgcctatacagaagttctcaattttactgtaatgtagtttatcagcctttaactttatacttagtgctgtttgtatcctggttgagaaatctgcctcatccagaatcatgaagaaattcttctttttgttgttgtttgtttgtgggtttttgttttgttttgttttgttttgagatgcagtcttgctctgttgcccaggctggggttcggtggcacaatcatgactcactgcagctttgacctcctgggctcaagtgattctctcacctcagccttccaagtagttgagactacatgtgcacaccaccatgcctggctatttattcatttatttatttgagtctctctctgtcgcccagactggagtgcagtggcacgatctcacctcactgcaacctccacctcatgggttcaagctattctcctgcctcagcctcctgtgtaactgggattataggtgtatgccaccacacccagcaagttttctgtatttttagtagagacagggtttcaccctattggccaggctggtcttgaactcctgacctcaagtgatccacccacatcagccgcccaaactgctgggattacaggtgtgagccactgtgcccagccaaattaaacaaaaaaaattttttttttgtagtaacaggatccagctgtgttgcccaggctggtctcaaactcctgagctcaagcgattctcccaccttggtctcccaaagtcctgggaatacatgcccatcccctaagatattcttctatgtttgtgtttggaagccttaatatttttcttttcacaccaaaggctataatccatctagaaattattttgtatatattgtgaggtataatagaatcaatattttttctatatgactgtttaattgacctagagccattaggtgaagaatgatccattgcctatttctctgaagtctggtaataacaatgtatttatggaccctactttgtttcattgatctgtttgtttatttgtgccaataccattgtgagatatctactgtagcattaaaataagtcttgatatctggaaatgtaagtttcagctttgttcttgcagattatctttgcttttcttgacactgcatttttatatcattgaaatcagcttgtctgtttttaaaaatctgctggattttgattggaattgcattggatctgtatgtcaatttaaggaaaattgacattttccaatactaagtcttttaagtcataaatatgccatatccatacattttttagttcttttaaaatttctctcaataatgttcataatttttactctatgtcattaatatcttttattacatttattttcaggtgttggttattttgatgttactataaatggtatttttttcagtttctatttgtttctggggtgtggaaatattgatttttgtgtattgacattatattcttactatattcatgtattaatactaatagtttgtgaattcttttggattgtatacgtacgcaattgtgacatctgcaaataatgaagatggcagctgtccttgttttgcatctcacttcaggagcaaagttccctgtaattcaccattgtatatgatgtttactataaaattttttatagatattttatttggtgaaagaattttttctttttctagtttgcttcattatgtacaagcatagagctttatcagatgcattttctgcatctttagagatgatcacatggttttctcctttttcctttttaatgtaataaatgacattgatttttcaaatgttaaaccaactgtatcttcctgtgataaacctacttagtcattattcttttcaattagaatttattgttagttgccgggcgtggtggctcacccctgtaatcccaacatttttggaggccaaggcaggcggatcacgaggtcaggagattgagaccagcctggctaacacggtgaaactctgtctctactaaaatacaaaaaattagccgggtgtggtggcatgtgcctgtagtcccagctacttgggaggctgaggcagatgaattgcttcaacctgaaaggtagaggttgcagtgggccaagattgcgccactgcactccagcctgggtgacagagtgagacgccatttcaaaaaaaaaaaatagaattcattgttaatattaattattttattgtttgttaaaaggtgtatccttttatatatcactagatgtgattttaaattatttcacttaaggtttttgttgttgttttggtacctatgtgaaggaaagggtttgcttgtttgtttgttttcttggaatgcctttttcaggtcttgacattttattctgcttttataaaacaagtttagaagtgtttcctcttattctctgcaatagtttgcaaacgtttgatgcctttttttttctttaaatgtttggcagtgtgcaccaggaaatgtttagaattatgcatttaatgtctttgaaagatacagattctttagattttcttatttcttatgtccgttttgtttcaatgaatttgtctatttcaactaacttttaaaaagctattggcatacttttcatagcattctcttattatttgttcactttctgaacaacctgtagtatgtcctctttctcattcctgtcattgactatttgtgcctactcttctccttgctcagtcacatcagagggttatcaattttattagacatttcgcagaaacaacttttgggttcatgactgttttactctagttttctttccatatcattaatatctgcccctatctttattatgtccactcttacttctttagatcccataggctgtttttttcctaaacttcttgagatggattatgaaatcattaattttcatcttttctccctaaaacatgtacatttaagtctataaatttctctcaatgcatgccttatatttaatttaataattttgatatgaaatgttttccttcatcattcagttaaattactttgtaagtttcataattatatattctttgacttgtagattatttagaagtataacatccaaccatgagggaattttccagtaatctttttaaaatttatttttatagcttaattctactgtggtcaaagaacatactccatattatttcaatatttcaaaatttgtaaaacttggtttgtagctcagaatataacaaagtttgggagaatgtggtgtgtagtcttctgttgttggatacaatgttctatgtatgtcaattaggtcacgtttagtaattgtgttattcaaaattataaccttcctgatttttgtctgcttattctatcatgagagatgtgctaaaactaccccgtgactgtgcattgtgccttctgtattttgaggctaggttggtaagtatgttcacatttagaatcattgcatcttcctagtgaattgacccttctgttattataaaacgtttctttcagcactttgaggatatctccccattgtcttctgacttcagtttattctgtgaagaagtcagctatcagtcttctttttgttccttagaaagtaatttgtcctttttcttcatctgcttttaagtgtgttccctttgttttgggttttcatcaactgggctatggtgtaattagtgcctttcttcagcttgaggtccaggtgtctcatgaatctgtggcttgagatccaccatcagttttgacagattctcatttattatctcttcagattaacttctgtcccaagctctttgttatgtatttatatgtaattatacctttacctgtatccaatttgtctaatttccactttctttttatctgtcattttactgatcctttgctcaggtgtgtctgattcagggatcagcagattacgaccagcaggccatcactgtttttgtaaataaagttttatcagaacagccacccctatctgtttacacattgtcaatggctacttttgcactatactagcagaattgaatagttgcaacagaaaccatgtagcctgaaaacctaaaatgtttactatctggctctttataaaatacttgccaaagtctattttaatccacttttaagtttgtccattgagatattgatttaaattattgcatcttttattcctagaatttccattttagttatagcttgtttccagtgaaattccccatcttataatttgatttcttgaacattttaatcttgttccaagttctctgaaaaacagagcccgaggcaaagtgttccaatacttatgttataatcataggaatagcataaggtgttgctaggcccctcctgcggggaaacaagactgaagccaaggccagggttgcaggaggtggtaatggtgtacttaagtttttatattttcatcagttaataccaatatctggatttcctgtcattatgtttataatatctattttttttcacttttttgggttgtcattaaattttgttttttctattcttggttatttttaaagtttgtgctgtatattgtggaagaaaggttgtggatataatttgagattgttgcagatttattgatactctgttaaaatcccctttaaaaattattatcggattatttttgcttctagatcttcagtctaacactcttccaactggattattttagctgtcttatttttgcttctagaagacagctaggttagcaaccagtgatctttatccaacaaagaattgaaataacttgaaccagggctttattccctttgaaggttgtcgtgtttccagtttactttattcctatgatagaactttctagggtcctgggttgggaacctggggtgtttaccaacacctgacaccttggaaggccttgagctctagtgttcgctttccactacgtgaggctgatgacagatctgtccagtttctcagctgctcagccaccacttgcagactggaaaatgccttgagcaaaaaggtagagccaaatgtcatgccaaatttgctcacatttctgagtttcttttgtgtctttggtcttagtcctgcaaatcctcactggcatggtagttttctgatgcactaaaatacactaaaaatattttatgggccaggcgctttggctcatgcctgtcatcccagcactttgggaggctgaggcaggtggatcacctgctgtcaggagtttgagaccagcctagctgacatggagaaactgcatctctactaaaaatacaaaaactagctaggcatgatagtgtgcgcctgtaatcacagctactcaggaggctgaggcaagagaatcccttgaacctgggaggcgaaggttgcagtgagctgagatcgcaccactgttctccagcctgagtaacagagcgagactccctctcaaaaaaagaaaaaaaaaggccgggcgcgatggctcacgcctgtaatcccagcactttgggaagcggaggtgggcggatcatgagatcaggagatcgagaccatcctggctaacatagtggaaccctatctctactaaaaaaaatacaaaaaattagccaggcatggtggcgggcacctgtagtctcagctacttgggaggctgagacaggagaatggtgtgaacccgggaggcagagcttgtagtgagccgagatcgcgccactgcactccagcctgggcgacagagcgagactctgtgtcaaaaaaagaaagaaagaaagaaaaaagacagaaaaagaaaaaggaaaattttaggcagcatttttatttattctcattggggagattcatcagaaacaagcagtcctgccacagccagaaacaaagctccttagcagtgtatcctatctctgtaatacctgtgctgtctccactccgttaccataaccctgcctctcctcccctacacacacatcttgtgtctggaatttttatgtcattttgtaattaagcacataaaaccactattttaaaatcagtccttgtttagattctctcataagctttactgatttatttaatcattattgcttcttgcatctcaccacttctgtatttatattagttcttaggtacattctttagtagttttttttctttttttccagtgaatatctctaagtgttaaagtttcacaatctttttgtgtcggaaaatatatttatttcattgattaatgattggtcatctgattataggtgaatagctgataactgattactgattaataacttggttatagaattctagatccaatattcttgtccctcaccactttgaggacttgactttgttttcttgaatccaatattgcttgtgagaaatgtgatgttaatctgatttttcacatttttctaggtaatcatatttttgtatgtgataacttttaggatttttgtttatgctttttgttttattttttaaaatgtctagaactcaatgagcattttgaaacagagacttctgtctttcttaaaatctaggaaattctaagcaattatatcattaaatattgtctcttcatcattctatttgtctattatctctattttttaaagaaatatagcagatttattgatattccttattaaaattccctttaaaaattaaactgtattattttgataagctgtttcttccactaaatatagcatttctcatatgaaatatcttttataatactatttctattttattttattttattttattttattttattttattttattttttgagatgcagtctcactctgttgcccaggctggagtgcaatggtgtgatctcggctcattgcaacctctgcctcccgggttcaagcaattctcctgcctcagcttcccgagtagctgggattacaggcacgtgccaccacacccagctaatttttgtatttttagtggagccagggtttcaccatgttggccaggctggtcttgagctcctgacctcaagggacctgcctgcctcagcttcccaaagtgctgggattacaggcatcagccaccacgcctggcccaccatatttatttttattgttaaaattttttatcccaattttatttcttttttttttttcaattgcattttttagagatttttctttttcatgtttttttgagacagagtcttgctttgtttcccagactggagtgcagtggcgtgatcatggctcactgtagcctcaaactcctggactcaaggtgtcttcctgcctcagcatccccagtagctatagctgggactacaggtgcatgccaccacacctggctaattttaaactttttcttttggagagataggatcttgctatgttgaccagactgatttcaaacttctggcctcaagtgatcctcctgccttgaactcccaaagtgctaggattacaggtgtgagccactgtgcctggcctggtttttctaacacattaattttttcttttacttttttttttttagatggagtttcacttttgttgccccggctggagtgcaatggtgcgatctcagctcactgcaacctccgcctcccgggttcgagctattctcctgcctcagcctcctgagtagctgggactacaggcacatgccaccacacccagctaatttttgtattttttagtagagaccaggtttgccatgttggccaggctggtctcaaactcctgacctcagatgatctacccacctcagcctcctaaagtgctgggattataggcgtgagccactgtgcctggccacattaatcttttcttagcatttttaattgacaaaaattgtacatatttatagtgtataacatgatattttgaaatatgtgtatattgtggaatggctagatggaactaattaacatatatgttacctcattggtgccctatttccttttttttttttttttttttttgagacagtggttcaagacattctcccacctcagcctcctgagtagctgggactacaagcatgtggcaccatgctgggctaatttttgtatttttaatagagatggggtttcaccatgttggcaaggctggtctcgaactcctgacctcaagtgatctacctgccttgacctcccaaagtgccgagattacaggtgtgagccaccgtgcctggcccccatttccttttaattagatactagactgtttaaacaccatatatttgtacacttaagttgagttcttgcagttgtgcttctagaagaatttttcagaaggatgtgcttaaatatattattattaaaaatgtaagagtctccactatgtgctatattgtgagcaaacccaaatcaattctcaatctgtgtcgtcaaaattaaaatccaatgtttcaggaagaaagacagtgtgaaacgaacaaacaaaaaagtctacctacattttttgtgaatccattcacaggcatggaattatctggaaaaatgactccagggagatttgcagaagatcacctgagcccccatttatgacaaatcttaatgaaatgtcatcacatcttaaacttattggactcttgccccatagtttttctaatggatgggtggttgtctacatacatgaagaacatttatcttattttgaaaggtgtggaaagcactagctccttgtttgcacgtgtgttctcacagttctctttgtccagaccaggtacactgcagccaaagacagcgtggttcagttcttcttttaccagcccatcagtcatcagtggagacaaactgacttctttccctgcactgtgacgtgtggaggaggtgaggcccaggctttgttcatgaatatttagagctcagagttagataaattagacatttacatttttgaagctgattttaaaattggtgtggtgattagagatgtctcatcacacagcaccttactcagcagcctgaatgcaatcgtgttaatgaagaagatgcatttgcctttattcttgaagacaggtgcaaaactggatttggaaaataccttttacttttagccaaaaaaaaaaaacaaaacaaaactgtaaacaaacttgttttcatgtgttactgcatttctcttcttgattgcccttaaagtacgtattatttttaattttctatgaaaaatctgagaagcagaaagatggagtgacttgcccagcctggttgagtcaatgggtgtgttggttctaacgttagatttacaacttttctctcctcaggtgcaagagtataagcttattaaaaagagaaagggtccctactaagtgttaaggggaaagccctgcttattgtctgcttagttcaaggtcttttttttttttgagtctcgctctgtcgcccaggctggagtgccgtggccaaatctcggctcgctgcaacctccgcctcccaggtttaagcgattctcatgcctcagcctcctgagtagctgggattacaggtgcccaccaccatgcctggctaatttttgtatttttagtaaagacaggtttcaccacgttggccaggctggtcttgaactcccaacctcaggtgatctacctaccttggtctcccaaagtgctgggattacaggcatgagccactgtgcccagcctttttcaaggttttcataggcagttgaggaaggtttggggacaagtgtaatccagggctccacacacacgctacaaaagcagcatctttcatgctccggtggaagataattgtccatttgatatggagaactggcaactctctggagcaaattaggaggcaactagagctactgtcaaaataattctctttttctgaactgaccttttaaatcaaagaataaatgcatgcaacccaggaaccatgacttagtagaatagggatttatgttgaagcttccccttagagtaccaggcagtggtactatgtgtttaccatgtgtcaagccaagggttagatgttcataatcacatttattcttgacgaaaaccctaaggaaggtctcttttattcctgtcttatgcatgaacaaactgacacttagaaagtgtaaagagcatacagtagtatcttgttcagctagtaaacagtgcagctaggatctggtgccaggtctgcttgatgtcagagtcatgctctaaatgactttgccctttgcctcccctaaacctcctactacacctgggaccagatcagggtatacaggctcaggtatggtcttgtttgaagagctagaataaatccttctccagcccagcctagctccacatcttttcaatccttgaagcctaccgcatatcaatttacttagagtcagaaactggcctttctcctttaaactacaggtatatgaaggagggctcttcagtcagtgaatatgctgtgaatatgcaggcagatgtctctcttctggaatttaggctccccctaaaacaacagggcaggcacttttttgggaagcactgggcagcccaggcccaagaagaagtttatgtccctggaaatggaagagaagactgaatagtgccacagaaagaaagtaaaagtgaatctccccagttcgccagctagttcttcccagggccagggttgaggcaatggaccacttgattatgatcctgcagcagtgattctcacagtgggcttcctggacctgcagcatcagcatctcctgggaactaactagacatgcagattctcaggccccaccacagacctactgagtcagaaaccccagagtgtggctcatcctccaggagatgatggtacacactccactttgagaaccattgcctctttaagccagtgtctttggatagcagctggagccatattgccatcactatttttgccatatctgtgttattcctgcactgttatttactaaaggatttttctttaagggggcatttattcaacttaaataaacatattaacaaaaagaatttagtagtactaccgtaagtggaaatctatcccttgtcacaaatagagtacaatcacaaaattaatacagtgaaaacaaaccagtggagtaagtcatcttcaagtttctaccagctctgacattcattcaggttattttcaattcctccagaattttcttgaatgttacaagcatttttatgaggcaaaggttcctttacatctttgagtcacttatgactctttgggtactcttactctgcagaaaaacaaacatttctctctctcctttttgtttgtttgtttgttttagaggcaggtctcaccaagttgcccaggctagactcaaactcctgggctcaagcgatcctccagcctcagcttcccgagtagctggaactacaggcatgtgccaccatgcctggctaatttttaaagtattttgtagagatggcatctcactatgttgcccaggctggtctccaactggtgggcccaagccatcctcccactccagcctctcgagtagctgggagtgcaggcgtgtgccaccatgcttggctcaaacatctatttttttttaaattttatttctttgttcttacacatagtcattcagagagacgttcacatttggatccataagataaaagacacttactactccagaggagacattttatagtgggattcagcttagtccagttgatcaaattcttgggaagcaaataggtgtttctcctacttgggtgcccatggaaagacatagtcctgctggaactataaatgtgcatgagcacttagcagtgagatcgtctccaaagacagcagtggatgtaagaacagaagggagattttaggctgcttttggggttcctgccgttttctatacactggcagaatttcaatacatttgttcaagatatagaaaggcaatctgcctcatttcttttgctttttgctatttctaaactgtgataaaacaaaagaggaaaattaattgtctctcctcaaattataaacacctgtatatgccctgttttcatttagaagtctatttctatttagaacaaagattttttttttctgactcaaggagctgtaatctcattttgtacttgttttggggaaaataaaacacacacataaaacccacaaggaaaacattaccaaaatttaattatattagtaatcaaatctgtgtgatgtgtgtgaatggaatttcagagttttttggataatcaagaaaattagttcatcggtctctaaggtaccgggggtacttgaatggactttcctagtcccgtctgtaatcgtcgatgtgagacacttgagatcaatttggagaaggtacctagattgccattgccatctgatatcgttgactttctggcagatattggcacccaagtaacattttattgactccatttggattttcattcttgcggtttcgaccttgctttttataatgcataccagtccgtccttctgcactcagcttacatccaagccatgtcttgtagaaagctgtctagtggtttataaaatcagattcctctcgacaatcaggactttaaatgtatttttagacctttagaccaactggcagaggcagagtgcttggctttgggcattttttctttcgtaaagagctcattctagttttgaaaaattacctttttttgaaaaagtttaactttaacaagacacttatgtggtgacaggaaacttggaatcagatctttcaggaaatagaagcatcattttgtgacttgctttttaaatttatagcactcatctatttgcaaagttcactttcctcagaaactctacaaattagatttaatagaatcaggaataagtcttcattccttccgtttgaaggcttgtgagatgagggctggggagtgacatacggggatggattttgttcctttctgtatagacaatgcttaattccccatttggaaagcttattggtattgcaggtgcctgtggcatcccaggggagcagaggagtaaaatgcggtactgtgtatgcatatcataaaatgttatgaaagaaatattcaacccagcaaccacccagcgcaagggtagttctcaaaaacatgatgttgagtgaaaaaagtggaaaacggaacaagatttaaaacacattatcatttattaagttaaaaacagatacacaaaaaaacaaccttacgtaagacggttgcatatttcaggacgtatcaacaacaaatcgaaataggtgtgttgcggggattggaatgggagtgtcaataagggaagaagagagattatacggaaatgagagaagggccttgcacagtgccgtggtgacaatgaggagaaaagacaatgaacccaggagaatgaataactctcctgcacctgggctggaaacagttcttaagaggagactattgtcattttttagttcgaagtgctgagagtaccacagttggtattaattgtcgttctcaattttggccacgcattttagtcatctgagaagaacctgagaatctttttaaaaagatactgttttcctggatcccagccacaggacttctgacttaattggaccatgaaggaacctgggcattagagtatattaaaagctcccatgtggttctgttatagagccagggttgagaaccactgagttaagtttcttaaagaggaaaaaaaaaagtgtgtggcaagtgataactctgccaagtaaaaatgaaacggatgcaatattcagacttgccttttctaacactttaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaaggtttgtgtcattgtccacaccctttttacttcaaaaagaaacaaatcagcttcaactgagactgatcaatctttgcagggcaatacatttccatttcctggctttgtctactggcggcaggtgcctacattcacatttgtaactatggtgcataggaattaggacacattcattaggaatgaaagtctagctttctcttgtcgtgggctatgtgttcctaagtttttttataatgaacccttttgaacagctcctgctctcttcatccaagtaaaatgtctagtccatctgccaatcataaatatctttcactcaccactttagcttttaaactgggtcactcattatcatcttttggcttttgaagtattcatattaaattcagtataaataatgcattgtgcaaggaagtaaaagttttaatgccaaagtataaaaagctatgtgtaaactatcctattgcataatttagtacctgctgacttggattgcctggggaagtttcctggcttactacaataccttaaaataacagaacaatatcaagtcccagaatcctccagatatctgccagctggcttaggaagaagtgtgcaagtggaaaaggaagcgttctcagtggatttcatttcctgttactgaactgcacatttcctgtaagcctggttgaacataattattaatagagacctttcaaaggacaaattctgtgaaataaagtggttttctgaagagcctactaataggacagtgtgttaatatcactaatatattaagagagtaatgattataaaaaggaataaatttattgaaattgcaagatacttttctcctttgattaatatactgctagtttagttttctacattttcaaatagaactggggaatttgtgtcgtagatattcttgacaactaaagagatggtggctgaatttttgggaatggttgataacacttgatatttttagtttccaatttggaagagctctgtctcttgggatgtcaaatattatattcgtcaattaatgaatgtgttaatttattatagaaatgatattctcacaatgatttcatttgtagtgatggatttaaagagataatgccctatgaccacttccaacctcttcctcggtgagttatatgtttccttttcctttttgcaatttaagtagtttgcaaggaactgtagcatctgtagcaatagcctaaaatgtatgagggttagatattaaatactttatagagctaagggaaaacagacttctactcaataataggaaaaatctttctaagaattagatggaatagactgcctcaaaagatgatgtttcccatcgctagagctgtcaagcatatcttggacaactgagtattatagcaggagctcaagtgttgcaattaatcagaaattttaatccccttttataccgagatgagtagtatggtccttcctgactctgaggttctgtgattctctaataatattgtccattagtatttaacagtttagaggcagtttgaagatgcagccacactgtatgttttaattgatttaattttcacaatggtcttatgaagggtaaatagggaaggtatattattcccagttgacagaaaccccggatgtgaggagctaagtaccttgtgacaagaatttgtgtgtggcagttaagaataaagtcttggccgggcgtggtggcacatgcctgtaatcccagcactttgggaggctaaggcaggcggatcacttgaggtcaggagttcaagaccagcctggccaacatggcgaaaccccatctctactaaaacgtagaaaaattagccgggcttggtggcaggtgcctgtaatcccagctacttgagaggctgaagcaggagaatagcttgaacccaggaggcagaggttgcagtgagccaagatcttgccactgcactccagcctgggtgacagaaagagactccatcttaaaaaaaaaactaaattaattaaaatttaaaaaaggctgggcacagtggctcatgcctgtaatcccagcactttgggatgctgaggcaggcggatcacgaggtcaggagttctagattagcctggccaacattgtgaaaccctgtctatactaaaaatacaaaaattagccgggcgtggtggcgcatgcctgtaatcccagctactagggaggctgaggcaggagaattgcttgaacccgggaggcagaggttgcagtgagccaagattgcgccattgcactccagcctgggtgacagagcgagactctgtctcaacaaaaaaaagtataaagtcttatgactcccagtcccaggctcattcagctgaaccacaattgataccttaaggccatactttttgccaccatctttgcaaacttcaaacaaacaacaaataaataatataattttatttgtttgcttttgagctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcaggtaagatttgagaatatgccacttttaattaattctcatattttaagggatattttctatatgcccaccatggtgctagacagcatggagacaaaaaaaaagtggtaaaagagcatggttcctactccaaagagcttaggaagacagttggaggacgagggaagaaagaccacaagcatcatggtaggtaaggataattaatattaaggacattaataataatatttccatacaattaccagcgtaattaatattaagtactgtaaagaacaaatctgtaaagaacaaatgttgaagcagagtcaatcaggaattatttgttgcccttgtggtgcctaatccatctttgaataatttaaacaagcaagaattacaatttaaattgtttaaattctttgaagaatgtaaacaagcaagaacctgagaaacatcactgggttagggttagtgttagggagatggccaaacagagatggcttgagcaaaggcagtaatgacaagaagtgactcaaagttgaagatttgaagagatgacccatgatactaagaactggaagattaagagattgaagagatggcccatgttactaagaattgggagattaagttggaaatgctgacacgacatgaaagtgtgtgtccttgatccagtagccactaagaaccttcacaatttttgtgaagacataatatattttaagtaattgaggcaagatagcctaacattgggaaagaccagaggcgggcagcctatttagaaatcatccgtggggtcaagttgtatgaaaaaagaaaacagaagaaggaagacacctcagaggtataacaaggttcatgtcaaattagcgtagttttcactttctaaagagatgactgagtaagcctccagaacaaataaaatgcagccggattagtcaaagatgaaaaatgcagacattggtatttaattatttaatcttaatcctttaattttctagagagtgagatgtagttgactcaagtttctccagctttcttaagtgatttctgcacacttagttcatcatatatgtgcattaatatatctattcatatatttattcaatgggtcagctaccatactaagaagtaaatacaacttgctccaaccacccaaaagcttagaatctagttgcacagacatgcatgcaaacaaagttgtgttacagtattgtattgtgcatgagtagtgtcatgtgcccagtacttcagaggcacaaggtggaatgattcactccatctgaaggtgtcaggaaagcttcagaaaggaggtagcacttgaacctgaaggacaagtgtcaggtaaagaccatattaatctttttctgatatccccagactaaacatcatcaccctgtaagaactttattcaaacttgctggggaagaagttaccaattaatttttggtcacatactccctaaaaagaagattagagaattacgtatttcttcacatatatttaggttgacatctgaaatttcctatcacaagtttaaataattacaaagaatatcatttcaacatgttgtgaatgttgacattttaaaataagagtgttgcagcattcaaaaaaatctgtctagtggaatttaaatgccatgataatttctgtctttgccatctttcatttaaaaaatacaggggcgagctcttctttaacaatttggatgttgagcatatttctccctttgaactcacatttgcaatctactctccccacagaattttattctaatataatgtatttttatgctttaaagtctttttttaattacactattctacttctctccaagaaaatatatatgatcattgaaattaatttattttactttcctgtggccataaggccctaagtatttaaaatattcctctgaattgagttaattttaatacacagtcaaaataacatatatatatatatatttcaaagtttggtaaataagaataacacataaaaattacattttcatttgaatacacacttagttcatcgtgtacatgcattaatatatcttgatagaagataagtggaacttaaaaaatagtccatatattcatcatcagaatgagccatgtgttcagcaatgattttattgttaattttttctattggtttcttattttgttttgtttgcctttgcatgtatacactgggaaagcttgttcacataaatcaatagaccgggatggaaggattttattttagcaaggtcggtttgttctttgaactcttgagttacgtgccagaattcatgtgatggtctatcatcaaaaattatttttaagggtctttctactggcaatttaagtcctctttctattttgttgaaagcaaaaaatatcatctcagctgcaaaaggatttgttatcgagacattagggactttcactttttcagcccccaatcaacattatttctacaactgcagagcttgttttcagctctcataagtcctagccatatgttttatgttggctttagagcttttatatcactctccatccccataaatatcatgactttatcattatgtatattatcagaatagaggatgttaactagctcttctcattcaccatacttcacccttaatacttttcacttttttcaaaaatcaaatatattctcagtgatgaggattttccatcatcgaggacatatgcagctccacagaggagttctggaaccgttgtaaacagtgacagtgccattaggggaagtgtccggcttcccagaacggcggtttaaaaggagaggatactcctttggattaaccagttgtagtatagttatatcttgtactgttttctttctttttgggtgaatttttttctttcttggctaaaacagccactcaatattatatatatatatatctcaaattgataaatttgggggtaggtgagtcaattttccaaaaacagggtaatctcaagcttcgctgaactcattaaagtatttgttcagtggtttcaagagtggcatcatgaactagagagatttcccaatattctgcctgatgtgtgtacactgagaaaggcctccatatcctcgaaacatatctttgaaacttgtccctagcaacacccaggtacaaagtgcttagggggtcagaaaataattttcaagctccttaaagcggtggcttggccgtggctttggcaatagatggctctgggaggaaattccactctgcctgttaggaactgtgtgaccttgagcaagatccttagatggtgggccatttgcttatctgttcaataagcctgaagctactgacccggaagtgggtcgggaggattcatgagataacaaatgaaggaggtgcctgtcccatagcaggtaaccaaaggcaaccaagaaccctcagcccctccctggggtggatccagaattagtggggtctgaagtttgtacagattggaggggactcctcaaaaacaagaatataaaacacaaatattgagtattgaagagaatgtttatttagaatcagaaaggaaattataagaaattacaaattttagaaagctgacaacaaccacattgtgaactctggacttgataatatttaataatgatatattaaatgatgtattagttatgttaataatgatgtattaataggggttcatcggttggaacaatggcaccacactaaggcaagatgttaataatagggaaaatcatagggggaaaaaggggtgaaggggaagattggcgctgtctgtactgtctgctcaatatttctataaacccaatatggtcctcaaaaaatatagtctatcaattttttttaatgcgtacatatatacactccccaacatgcagattatattagtccattctcacactgctgtaaagatactaccagagactggttaatttataaatgaaagaggtttaattgactcacagttccacatgtctggggaggcctcaggaaacttacagtgatggtggagggtgaagtagaagcaagtaccttcttcacaaggcagcgggagacggagagagagcatgaaaggggaagagccctttataaaaccatcagatcttatgagaactcactcactatcatgagaccagcatggggaaaactgcccccatgatccaatcaccctctaccaggtccctcccatgacaagtggggattatggggattacaattcaagatgagatttgggtggggacacagagccaaatcataacagataaatttgaaaagctattctagatttttatatgacatgaaaacattccactcataggcaagagtaactttcaaatcataaacaaataatccaagaaaaaaaatgctgacaacacaaacttcacaaaaattcagaaaaataatagcataatgtttttattaactttaactgcaggcagttatagatgtatggggatacatctatagtatttttttctatagcgtttggctgaatactctttgatggcctcgttatatggtagcagttttgcaagactgacttctatagacagaatagaaaaataatcctctggcataattcattagaattttattatatttttattgacagttcagaaaggtttcattcgtcttcaaaaattattttgggtagggtcatgtaaacgtttaatcaaacttgagaaaacttgtaacaagtttctttgatatttgagcagtaagatttcagggcatttttaatttcttgaactatgatctcaccttaaatactttttgaattgagaagtggaacaaggttgtacaaaagaggggccctgaaatacaagtatcacagaaaattagcctctgtacccttccttacataatatttgtctaaaagtcttttgtgtttaacatttatgtagttcaatggctctcctttgcattcgataaaataatgcctttgtggttctcttaaaagaaatgcgttggcttctcttttcttctttgaagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaaggtaagtctgtggtgcactgtaaattcaaatcaaatggtattttccagctcccattccaatattgtagcatttccctttcaacttactactttcttataaaaattgttttattgacagattgcaatagaccttcccatctagataaagaagttagatatatgtgaattattcatctggagggaaaactgagctcctgttgattcagtacagatggagtagctcctatctatctagttttatactaacatttcttggtggacgtaagaaaattaaatgcagtccctcccttgaagaaaaagaagaagaatggcgggggagagattaaaaaaggaggggaaggaaaagtagaaggaagacaagaaagaagagcaagaaacagaggaagaagtagaggaggaggaggaaattattcttttcccaagattctcattcttctttatagctacctctccgctggagtataagatttttgagggaggaatgatgtcatctttatcatgtgtactaatgcatggaatgaatgaaaacttcccgttcccagtggagatctatggatgcatttataatctctccagtagttcacatttgttccacatgaaagagcagaaatgggtagcatccagggataggaggatttggcatcagctctctgatatatgatcttctctgtacataattatttccatgttctttaatgttaaccatcctcatgaaaagtatcttccatcttgaaatgggagaaaagattattcccaactattagtaagaaggactcctccttagtacttgagagaggatggtaaaactctcttttgttatttctgggttcattattcatacaaatagcctcataattagccattcaataaatatttttgagtacgtctatcttgcagaaaaatcactagttgccatgacaggtacaaacattgactacttaactccatcagtgaagtcttttttccttccttctgcatttatgatactttcatagccactttcattgtgtccatagtttccttgaagcaccctaaagttatttttatttctcacttcatagatagattattcctttcttcacatcaaggaggcttcaaaggacaggaaggggggcaacagtttgttcctccatgccagatgtaattggtaatcatctccctcaacaactacaacaacagtaaaagtctgagtaaactataacacagactccttcatcccccctaactttcttaactttcatattatttgcctttctctattaatgtttgcattccatgggcaaaaataaaatgtgaccaaagatagcaagctgatatggttgaagtaaaagcttcaatatatgaacaacagaaattggtattgatttataaaaggcatttttatgttaactttgacagcattttcaactgtatcatgtgatcattttggttgcattttaataatgtattaatttttttaatatacagcagaagtgtttaattcattccagcagccacctaatgtattgtactaaggaactcaacttgcatttgaaaaacatgacctctttataaatgaaatcttcagccaatatgatcacctatccaactccttaatgattaatagtaattaggctcattgtttatgttctctttttcttagaaaaaagtccagtggaagcaaaattgccttggctgaaacaagcacaagaactagaagagaccagaatagcaacagaagaaccaacgtgagtccaggaccttttgtaggaataatcagggcatagccagttaacatgatatatgtaatttttgtactcattggagtacagtgatacatttaatatccaaatgacctggatttacagactctagagagcttgagctggctagaatttttctttgtttcacaattcagcagtcctcctttggcagtttctctgagcagcacagaaaagaacagtgttacttaactcaaagcagatccagtggtctgctacacttaagagactggggataatttctaggttttaacgcatgtgatttgaccatgaaccatcatagtatcatacaaataaaccagtcattccatgggtaagtcatggtcaatctctataaaatcaattaagttgaaatgcattagtcgcctgagtgatcatagggaaatggaaagaacaaggtactaagagtattggagcttagaaccacccctgctaactacatgacctaagacaagtctaatttttctgtgtcttattctccttacctataaaaggagcaggttgggcttgatctctccagggttcattccaactcaaaaatccaatgactaccatctgcatgtgatttgatggatctggattgtaacagtgccagtggaaattaagaatcaagaggaaatcaaagaagcattctggaggcagttatatagggacaaaaagagagcaagaaatcaaaggtgctctgagatttctagtccaggaatctgtaagaacaacagtaccaatgatagactcaagtaattgaacagaacagctgattccatgtcaaacatgttaagtgtttggtgctgacaggctgtctatgaagagagcaattcccagagcatcagaggaaaaggggtctcagcagtaatctggccactttccctctcggagcaggcatttcttcttcaacaccttcagcaatgggcagagttcactgcattaagagacacctcattcttgtgttgagcaacccgttatttgcaagatctttttcttctgatgagacagaatagacctcctaatttgtgttctctgaagcagaaaaaaaaatacatctatgccccatcccatgtgacaagttttcacaaatatgaagaaagctgccatggatcccgagagctttgtctttcccaagttcatcattcttagccttttcagcagtcttcatgcactgttgtttttagatcccttcccaacctcctgtgcttttcagaacccactctcatttgtcaatctcccttttaactgtggtccagcccagtggtgagccccagggcagtgtgggttactttgctttgagaaggcacatgtggcaaagtgatgtgggccaacatagctggcacatcacactcatgacaggcacagacttctccacgtggaccactgtcagtgctggctatgaccacagaagaaactgtggaccatgtgagggggaatggcttcacagtatttgagtaaaaagagaagagtgttgggctcctgacagaagcttggagatttagaggaagagggggaatcaaaagaggaagatggtaagggagtaaagtagtggagagagggaggagtaagacccaggaaagcttattgttccagagaccaaaggaggaaggagtttaaggaggcaaggaggcaagcagcagatggattcaaatctcacagaaagacaaggaaaaaccatgaggaaaaagaaaagcctactttgattaacaagaaaggctttttcagtgaattttagagtagtagcattcaaagggtagagaataaaacattgtggatatttcagaaataaatttccaaaaaagaagaaaacggagcaatgggtatttaagtactaaagaaggagcaaagattggtagtcaagctgatggaaaagtgtatacgtatgtgtttgttgtttttcattttgatgttagggcaatcttaaattaaaaagatatggttttgcacaagtcagttaatatctgtagaccttccaactgtataaggaaggcattaggctaaatgctgctggaaccttctcacatctctgatcacctacaatcctgtaagggaaggagtctatagaaagaaaagggtttgaggcacttgagagagagagtgtgtagttgtcacagaaggaaggtcacagagtcctttgtctagaatgatgggtcctaccaagatcttttgctttcaaaacacagttagatgatagttgataatgcttctgtatgtcctcttttgggtaatagggttgcagtccgtccagttccccaaactagaagcctggattctttcttggctccttctcattcttctctgatgtgtaattagccactgagttgtgccgactatatttactaaaatctttcttggttccagctcctcctttccatccaaactaccatccttgtacaggtcctgaaatcagttcccaggacacctacaacagctttctaatttgctcctgaattgcttccctcaaatccacccctacacaacacagccaccagagtagtctatctaggtagggcacaagtctaattctttttgttttgttgaaacagagtctcactctgttgcccaggctggagtgcagtggcgtgatctctgctcactgcaacctccgccttccgggttcaagcgattctcctgcctcagcctcctgagtagctgggattacaggcatgtgccaccatgtcaggctaattttttgtatttttaatacagacagggtttcaccatgttagccaggatggtctcgatctcctgagctcgtgatccacccgcctcagccccacaaagtgctgggattacaggtgtgagccaccgcacctggccaagtctaattctttctttgcaatgttcagaatatccaaatgtctccccatcactcaaagatgtatgtgggttcatatgcccaatgggacttggcagggtattacctttcctggtccccagcctcatgtctggccacctccttttttttgccttgagtgggatgctccagccacactgacttgcgggctgtttcttgcccacagcaagctgcctcttgcctcctctttaattacactcccctcttaattgggagtggccccacctgttaagtctttttctgtaactttctttttaatcataggaaattgcaaacctatttaaaagaggagaaaacagtgtaatgaacccccatgtcatgttcataacccagtatcaacaattatcaacccagggccacccttgtttcatcgaaaccatcaccactgccactaccccctgatcatttttgaagcaaacacagacagcacatcatttcattcataattatgtatctcaaaaagaagtctttaaaaaataatcaaaataccatttttgaaatgctatcctcaatacttctatcagaatcacccgtggtgctttttaaaatgtggtgatttccaggccccactgagtcagatactgtaggagtggggctccatcaccaacattttctttttctttcggctgccagatctttttttttttttttatcatggtgagagatacacaacacaaaacttaccattttaaccatttgaaagtgtacagttcagtggcattaagcacactcacattgttgtgcacccatcaccacctcccatctctcaaattttctcatcaccccccaacataagctctgttcaccttcagcaataactccctactccctcccactagactctagtaacctctattctattttctgtctctctttcattcaccagcattttaaacaaataccccaggtaactttggcaggggagtgggcatatccaagtttgggaaccactggatccgatcgtccctaaggtccctttaaagttcagaaaatactgtttactttattgaattagaaaagggggatatcagccgggcgcagtggctcacgcctataatcccagcactttggaaggctgaggtgggtgtatcacttgaactcaggagttcgagaccaggctggccaacatggtaaaaccctgtctctactaaaaatacaaaaattagccgggtgtggtggtacatgcttgtagtcccagctactcgggaggctaaggcaggaaaattgcttcatctcgggaggcagaggttgcagtgagctgagatcctgctactgctctccagcctgggtgacagtgccagactccacatcaaaaaaaaaaaaaaaaaaaaaaaaaaagaaaaaagaaagaaagaaagaaagaaaaggagctacagtgaggttcaggccccatattcattccaagcctgccttttctgtcagccccacctgactttgctaggggtttcttcctcctcgtattcacagagcaaagccaaaaggttctttactcctgaaggacaccaccctttcttcccccgtgttgaagactgagcagacagcacctgttccctggcccaagcagctgcctcttcccaccttctgccatctctccctctgtggtcgctctgcaattttcctgcataattcacactgcctggcagtttctggcctggtcctggccatctagtgtgaagtttatattttcctgccaccacttctgactctattcattccctcgatttccaaacaaaaccgcaacatatctcagcttccagtgcatccttttattaccactgtcttttgtggtttggggatgcttgcttgttgacagtgaaggagaggatgaacgcagctgtattttacatccctccagtagagcctgccaagccagcctgaaggagataaatatttctgcctctgtggtttaccatggctcgagttctgaatttacatagggagcggatgttcaaaaggcttttttgctttttttaaaattaggaaaataaaaattatagtgtataaatctaagccaagggaactgcagtactgaccttcttagctttcagctgtggaatgtgttgacagttgatatggttcattggttcatggttgttttaaaattcctccctggagcctcttcgtttgtttctgtgggattcttaacacttcagcaaacttgttgccctcgctgtcgtttttcatatacaaaaactaaggaaatagggtggacttagttagcacaccttgtatgtttccttcactgctgacttaaattctccatttgtggagattatatttgctaatgtcaaattaggtgacatttcaggaatctgtttttctaacaacaacaatgataacaacaactaatattgaggagtgctttgtgccagaccttgttctgagtgttctacgtggattaagttgtttaatgctcacaacaaccctatgaggaggtgctattcttattttcattttggggctgaggaaacaggcgtagaaacataaaggaattgttttggagatattaagtggtggacagtgattctatggcacgtaagactagaaagagctgcagtttcgtgtcagatgtcctgaattcaagtttcacccatccttgggtttatctaatggagtagacagagaagtgagtgactgcatgatggtattgtaaggttgcaatgcattataattacgttatggtgttattcgggatcagggatggtttccggaaatagatggtacatgaactgagatcctagagtgtcctacaatgtcagaagagcagcatgtcaggtatttggaatagaggcttgtgtgcaggctcactggcccatgtaggccacgcaggttgctaaggtggtctgaggtgggtgaggggcgaggaggatgggcccggggagcagtaatggcagcaaggatgcagctggaggagccagcaagtcttgagggtcttccatggttcactaaggagcttggactttatcaggaggctgtgggagccatgtaaggattttaaccagaaaagtgacataatctcaattacatttttgaaagatccctctggtggtctgcagtttatttccaattattcacaatgataaataaaactgcagcgaattccaaattgcacatctctaattgtctcattggacatattttctggcgtggaatttctgggccagggataagcatttaatttctactgtcaaatttccttttagagagaaatcagtgctggcttctctcgccagcagcagtactccagcttgcctttttccccatacgttcatcaaaatcaggagattatctttttttttttaaatgttattttgtagttttttttatggttcatgttttgcacttaactttgatccatgggaaatttactttcacatgtaatatgtaatctcaatctaacaattttttccaagtaattaaccaactgcccctagcactatctgttgagtaaactacccactttggttttaaaatgacgtcattgtacaaataatactccagtgccagtaccatattatttgaattactgtgtcttttaaatacttttttctattaaactgtgcaagtactctgtaattgttattccttttaaaaatgttcttgattgttctcacctaaccttacataaaactttagagttgtattgtctgtttccaacttcccccccaaaaaattgcttcagccgtttggctcagaactgcattttttctaaattaattaggggagaataaacatctttctaattttgagtcttcccattcaggggcatgtggtctctccatttattcaggtttttaggcttagaatcccctgagtattttatacctcagttttcctcatctgtaaaatcaggaaaataatgatatttatgcataaggtcatggcgagaattatattaaataatacatgtaatatgcttagcatagtgcctggcagctaacagtaaatgtggttgaattctgggaaaactggtaattttagtatatgtatctatatatttatatagtgccacacaccacacacacacacacacacacacacacacacacacacacacacacacacacacacagagttatgggctactttattgaactgttttggttttttccaaaatttttcagttaattttagtacttttcatagctatgtcattttcaaatatgataattttgtctattatgtttattctttcctaatatttatacctgcttttttgctcttccactatattttcatttgtatttttcttatctcattttgtttattcttttactttttacatatctgaagtcattctgtgttatttgtattatctgtaggttttaaaattaccagctgggtgcagtggcaggcacctgtagtcccagctattggggaggctgaggtgagaggctcacttggttgagccccagagttcaaggctgcattgagccgtgatcacaccactgcactccagcctgggtgacagagcaagaccctgtctctgggaaaaaaaaaaaaaaaaaaagagagagtctatttttaaaaggaaagtttaatccatttaaatagattttttattactgatagttctggtctccattttaaatgtttccttgtttctgatgttttcctacatgagctatatgaacttgatttgttttctataatagcaggagatttgtctactataatttcatttttttaacacactcaaacctatataatttttatcataaacatctagaatggtgccatttctgctgatttctccaggtttaaaatgaataaattggcattgttttgttgttgttgttgatgatttttcactttgagacggagtctcgctctgtcacccaggctggagtgcagtgatgtgatctcagctcacttcaacaccacctcccggcttcaagcaattctgcctcagcctccctagtagctagaactgcaggcatgcaccaccatacctggctaatttttttttgtatttttagtagagacagcgtttcaccatgttggccaggctggtctcaaactcctgacctcaagtgatctgcccaccttggcctcccaaagtgctgggattacaggtgtgagccaccacaccctgccagatttcattctttttaatggctgaatagtattccattgtgtatataggctatattttctttatccatttatctgtaggtgagaacttaggttgatttcatatctttactgttgtgaatagtgctttgataaacatacaaatgcagatatatttttgatataatgatttattttcctatgagtaaatagccagtagtggaattgctggatcaaacggcagttttatttttaagtctttgagaaatctccatggaggttgtcctaatttaccttcctactgacagtgtttaagtgtcccaagatatgtttttctttcactaatacatgctgccttcttctcttgtgctgaagaatgattttagcagttggatatttgtgctttgttttcttattctggaattagaaaaataaattatctaaaagagcattgtcaaattgtctttggattcatatgctgtcatcctggatgatgtttaagtgcttctgtatcctctgatacagatgaggccgtgtacaataatgctagcagctgttgtataccctttggttacttgtctgtacctcagttttctcatctgtaaagtgggcataataatatttcctgatacggttgttgttataagaaaatgatagaatttgtttgaagcactgaagacagtgtctcacaggaataagaatgcaatgaatgtctgatgttacttttttattttattgtacttattgagcttttaactcagacatcattacatttaattctcacccaataccattaggtaggtaatattattgttcttattttacagaaaattattacctttgtatttgaataacagttttactggacataatattcataggactctgattctgtctctctctcaaaactcttactctatcttttcctggttttgaatgttgtgtgcatctgaggtacccctgtctttatgttcctataggagacttgctttttgtgcctagacacctagacaattctttcttcatgctcaaagttttgttagccaggtgtattcattttccatagctgctaataccacaaacttagcggtgtaaaacaacacaaatgtattatcccacagttgagtgggtcagaagcccagtagattcagctgatgtctctgttccagttactagtaggccaggatcaaggtgtctgtcagtctgaagtcttctttggcaagagtctgcttccaggctcatttgaataattggcagaattcagttccatgcatttgtagaactgagatcttcatttccttgctgactgtgggctgagagattgttttcaatttctagaggccacctgcattccttggctgatggtctcatccatctttgagccagcaacagtgggtaaattcctgttacacttcaaatccctctcgcttattagtctacttacatttctgactctagccagagtgatatccttgtttttaaggatgtctgtgattagattaagcccaccaaagtaatctgggattatcttcccatctcgaggtcacacctgtaaagtcccttttgctgtgtatggtaatgtattcacacattctggggattagggcatgggagtacttgcaggggtgaggagccattattctgcctacaattctaggtttttatgttcatcatttttattactttttcctggaagacagtgtaccttttcaggatgtatttcagtcacttttttcatattttatttctgagcagcttttctgtttcatgcgttggaatctctacatgaagaatccagttatcttcaatattggattacctaggttctctttaacttagtcccttaaaattgtgcttcagaaaatcaattttatagagatgtagtttacatacaataaactgtgtctatttaaagtgcaccatcaatgagtggttttttttctttctttttttgaggtggagtctcactgtgttgcccaggctggagtgcagtggtgtgatctcagctcactgcaacctctgccttctgggttcaagtgattctcctgcctcagcctcccgagtagctgggattacaggcatgcaccaccatgcctggctaattttttgtatttttagtagagacggaatctcagcatgttggccagcctagtcttgaactcctgacctcaggttatccacccacctcggcctcccaaagtgctgggattataggcatgagccaccacgcccgctgatgggttttgacagatgtatgtacccctcaaaccccagtcccactcaagatccagaacatttccatccctacaaaagttttctttgcagcttctctttctctctctctcaacactgcattcacttccaagtctggcctctgtgtcattaatttgatcttcagccatgtttcttctgttttttcctagttatgaattgttagacttgtgacaatagtgttattatgtttcacagttggtttccattttcccttttactctgttgttttatcatctcatctcgaaactctcacatcagtgaaatgatattctttttaagttcttccatgtgcaaagacgtaggtaacacagcctgttcctctggttgtgttttgcccagacatggctctttcaatgtattcctttctttctttaaaaaaaaaaaaattggtgaggggagacaagattcagaattgtatgaacactataatatctttaatttaaataaaaaataatacatagaaggaaatcatgctggattctgtgtaattattttttagttgccgtgggtttttttttttttttaacctttaagtcacttcttgttactttggacagaactaacatttactttttaacaggacttttaaaaagatcgttgaaaaccaacttgaaatatacagaaaaactaggaggacattgagtataaccattatttgccctgctgggagtttaggtgaacctttttttttttttttttgagatggagtctcactctgttacccaggctggagtgcagtggcacaatcttggctcactgcaacctccacctccttggttcaggcgattctcctgcctcagcctcccaagtagctgggattacaggcatgcaccaccatgactggctaatttttttttttttttttaagtagagacggagtttcgccatgttggccaggctagtctcgaactcctgacctcaggtgattcgcccgcctcagcctcccaaagtgctgggattaccggcgtgagccaccacgcctggccaaggtgaactttcttacctcatctcctctcgagattctcaatcaccaagatacagaagtccaatttgaatgaaaatatctacttcccattaaaacaaaatcccaatttttaattttttattaccaaggagaaaagagagaaaaaattaatgaccataaggtaaaatatgcacatgcttagaaactttaaaccttttaaaaatataaagtaaaaacctccctctttacacactctagttcctgacactttcaattgcttccagaagagagaaattatacataaaccagcatacatacaaacatgctacatatggggcagttcatgtactacgatctcttttttctaaaatcaaaaaatagtatataggtatatatagatagtgtatgttatagactgtgtgtatgtagcatatatgtataatgtatttatttcatttaacagtcttcaagagaagactgttatcagttcatacctaaacctatgtccttttaaatgactacatattattacactgtcgggatttctcgtctttaaccagtctccttcccaattctaccatgagagtagcagagaaagaaaagacacatcaaatattaactccagcattgccccatcctggggagttgagcaagccctcacatggaatctgagaattagagagaagggttccccactaacaattttcaacacaatgaacaacatgttttgtgttgattgatgtttctttgcaggacacgtatatagtaatggcatttcattctgctgattgggggtgtgcttttttggacaactatatttaagtcttgcctggggaaagaaggttggatgactctgtgagaaccttacaaccctgtctttctgaggttagaaatattaagctttggaactgcatcttaaacaaacatcttagcagtgttttctgaagtcatttagtagaacataatcccacggacaagggtctatattcacttaagtttatgaaatgatgcacgtaatatttctctcttaagcatttgtagtttgcatttatatttcatagtctttggaaaagttttgcagtgaataaatctgttgaacattatcgagccctgagttttcaaaacttattctattactgaactctttctcctctatcacttattaatatctcaagatacaaagtgttttttcagagtatcttaaatatatctgtccctacggaatctggttttcaaaattctgtgcaggggtccagtaaaggaccagatagtaaatgttttaggcattgtaggccaaatggtttctattgcaaatattcagttctgttgtagcacaaaagccatagacaataggtggaaaaatgagtgtggttatattccagtaaaactttagttatgcacggtaaaatttaattttatgtaattttcacatgtcacaaaatatctttttttctgccaaccatttaaaaacataaaaatgattctcagctggtaggttgtaccaaagataggtgggccagatttgacctgctagtcatagtttgatgacctttgatttagtagataataatccggaataagaattaaatgctttgttcagcaagattgtgcaatatttcttttgttttgaagaagatccagaagcttcgtgcacttgtgtattaaacataaaagaatattaaggcttcatccactctgtagaaagtatttaagataccctaaaatttagctcctaaacttgagacagtttaatactactctgcccattacagaggataagctcaatactaatttactgaataaatattggtgaaaatctccatattataaaataaattagattagaaatgatctccatatgatggtttatttattactaaatcttaaagaaaacctttataattttgcaaaggccatagcacagattcgaattatgaaatggatgtaaaagtagaatatagtttagtgaattactctttctgttgctagtaagatttgaatgtttgttaactgcattactgaccatcaacaaaagtataaaattccaaatgtgtggaattccaccgagtgaagctggttatttttgccttcgttgaatgtgtcactcctccttttctggcctatatttaatgaccctcagtgtccttttctggtggcttcctggttttccctaggttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggtatttgaacctttgcttaagggacagttatgttgtgtgttgctagtggtttgagaaattactcaatcaggtaagccaaatatgcaaattagcaaaagtctaaaggaggtgaagtcattcaaataactgaaaatgatactttttcttctttttctttcttttttttttgtagtgattattttagaaaggagagtgggactatatactaaccaaaaaaagtatatttgtttgcctgagaatctgcatgactgagatggttcatatgaaataaataggaaaatgcagaatggataagttaaggcaatcttgttcataaagcagtcttatagattgaggtagcctggaattgcaatatctgatgcaactctagatcagagtttgtcctcagaaaatatttgggttcatatccgcacattgggccagcacctaggggaacaaactaatcaccatgatttatgtttgtgtacatagagggtgacatacacagccaggaaaccctgttaggattagaaagtggttgtatagccaggtgacccctttggggtgagaagttggccccctgatgatttatacaatctaggatccaaaagggagtgaaggagtggttaacaggagtccagagagccactcttgagggctctgttgaaagtaaaaagatagaaataacaaataagaaaactatatcttttacttacatgaaggagactgggtctgaccaggaatccagagcccctgtcaccccgtcccctcatcctttgacccctgactgtgccttccagccagctgctatgtaaagagcttggtgcctgaatgtgctctgctcttgatccagccaatggtgggaaaaacacaaggagatgctgtcttagagctcttggctcaagatcatgctttactcctcccaacagtcttgagcccattacttgaaactccctatcaagttgtggagctcatggcccattcattgtgcctgaacccctcactcttgagcctgaattctcaatccttatcattcagtctctatggcttgattgtatctgtttttctctttcctgtctaattcaacttctatacctgcgtatccttgccactttttgtataacattgctagcctggcagtaaacccggctaaagtggcatgtgccttacccccaggctgcccctaaactactgccttgcggacagagttgcacatgtggactttaggtgccttagctgcctctggactctttctccccttacttgcttctgtctggttgctaaaagtccatgccatctagctaggaatttagcctctctggtttagttgaaccttaaacatctgctgcatctcttccctccacagcacattgtctgggttgccccccacactgccttgtgtctgttcttgcccaagccaaactcctgcctgctcttgagttcagaaccctggacacgtttttgtttgtttgttgttttttgtttgtttggttttgtttgtttgtttgtttgtttgttttttgttttttgtgggtttttttatgtcttggaaaccttaactctaacatgcccttggcaatttgggaactggtgctttctcttgatgagtttggggaaaccctctagagatagccacggagatgcaaagatggtcccctattcagtcacaataatacatgcctggaacttcctactgtatgtctacaaaatgccagctgtctccattgcttctgagtcaccacattgctgcagtctcactagagacttggagctgtgtctttcattaggagagcagaagcaagcccagctgttgcttgcacaccccaacatctaccttgtaatctcaagcttttaggtgctgttggtagaatccctgtttcatcttcttctcctgactggcaagatcccctcaagttgggaaagcatagcatgctgggtacttggaactcagcagaccaatcagagttgctcaaagagagatgaccaggtgaattctaattcagctgagagagactgctgtcagagctcatttttggagccttttactaaaatactagaatctaccttgtgttctcagtacccactgagatggccctagattccacctctaggatggctgaactcatgtgataaattcctcttttgttttttttcagtaacagctttatcgagatagaatgcgcacactgtacaatttatgcatttaaagtatacaatgtagtggtttctagttacaaagttgtgcagccgttaacataatcaatttcagaacacttgcccaaagaaacactgtgtccttaagcaatcataccccattttccctcaaattctaacccctggaaaccactactgtctattatggacgttgcatgtaatgggattatgtaatatgtggtcctctgtgactgcgatctttcacttagcgtagtgttttcaaggttcatctgtgttttagcatgtttcagtacttcattcctttttatggccaagtggtattccattatatggatatacaacattttacccattcatcggctgatagaaatttgagttgtttgcatgtttagggtattgagaatagtgctgctgtgaacgttcatgtatatgattttatatggacatatgtttttatttatcttggttatataccttggagtagatagaattacctttgaatccatttaaaacatacaagttttttgacacttgactaattgaggttgattatccttagtggcactgcgcaccttttgccctgctatgagaagagaaactgccttgcatctgtcagaaatgcaatgcagtattcaggtgggtgatgttaaggtgcccatttgctttatgatatactcttgtgtatcaggaacacattttacaaattttagaaaagctcaagttggtagccttttactactcaggtaagcagcaatttagccttataagggtatattttatcatttaatcctgtaataatattattgaaatgagccttggacacctactaacccaaattttatagttgaggaagctgagactcagagtccatcataaagccaaaaatagaaaatgaataacttgattctcattacttagctgaactataagtacatgtaataagcttcttagctttacaaaaagtaatatttttaatttcttgggttaaaaagtaaatttttaatttcttgggttaaaaaagttatttttaattaacttgagattaaagttccttataataaataaccaaagcctatgaaactgaagagctaaggcaaaaaccaaaatcctttataaaggctgggatggaaattgtgggtgaggtgactcatgcctgtaattccagacctttgggaggctgaggcaggaggatctcttgaggccaggagttggagatcaatctgggcaacatagcaagacccagtctttagaaaaaaaataaaataaaggctggaaattgggtacctgctctgtgttagactccatggttcttcaccaagttctgcactaaatcttcagggatataaaataaatagaacatattctttgccttgatggagcacagcttttggttgttttggtttgactgtcccaaccacactgcttatagtcagtggtacttgcctctgtgatctatttcaacgtggttcagtaagttcagcttccataagtccactaatgtgtgagttatgaatgtgggcttttagccttcaccctggatagcagagaggataagtctgcaatgactgacaaccacaataaaatgaaatttacacaggcatatatttatttcttcaacattcttatttctgctggaaaagtaatatacaaattacaagtttctgaaaagataaattttggtcacattctgatattctgtatacttatattttctaacctatcttcacatcatacaggaaataagaataaatccatttgttgtaattactgatgcttaagatccttgcataggtctcttttcacattggagtagcaacagagaattcttttttaattcctaaaagcatgaagaatccagacaccaatctccagcttccaaagtgtgtgtatgtatgtatgtatgtatgtatgtatgtatgtatgtatatgtatgtatgcatgtactcatgcagcagtatctgtgtgtgtagatacatcatgtgtgtgcacacacatactcatgtacatcctggaagatatgcctacctttttagtaccctctggtaaggttttataatttattacatcataaacattccttaccgaagttcttcttttatattttatattgtttgttgtttttatgacctcatttttttacctttatgttttccaacaacacaggctaggagtatatatatggacatttgagacctgacccctttatgaaccccagctctgcaactctctttgtttcatttgtttaaatttgtagagttgtggtttattttgctaaaatgataggagtcatacctacctcattaggcttaatgaaataattaaatgtgattattaaataaggtgatgttcaaagagtgtttaatcacagtgtgtggtacactgtattaataaatgttagtgggatgactattttataatataataatagagcattcctcttatattggaatgctattgattatttctctttttaaaaatctgactaaattgttgaacaccttaatacttctaatcatttttcagcttatttttatgagttttctaagtaaatgatcatctgctattaatggtgattttatctttccctttccaatagttatttaagtttcacattttattggcttgtctagaattccaggaacaattgtaaataatgtggataatgccaaccttgttttggtcctggcagtagtagaaatctctttattgtttcattttaaaacaatgttctacaaatatttattgtatgtttctatgtgccaggcactggcctaggtgatagtgactcagtagttcctagctttggaactgaactctaataggaaaaatgcattcatcacataatcatactcacacatatatagaattaccactggttacagcaattgcaaaagaagtatatggtgctatgaaaaggggcatttgacctaattacacttgaatttaaatctaaaaggtgaggcattagctaaacaaaagggggtttggagggggtggcacacggataatttccagcagaaagagcatatgcaaaggccagcagaagggtgcatggtacattccaggaatggaagaagccaggcacagttggagtactgagaatgagacagggtttagtgtggcatgctgctagacaggaaggcagaggccagacaattatggccttacaggctatgttgatttgagtctatcccaagatcaatgggaagtcattcaagtaattaaagtgggagttatgtgaccaaatttttatttatttcaaaaaggttagtccagctgtattgtagagaatggattggaaaggataaggatgttgtgagagcgatcacataggaagctattgcctattccagacaagagcttagaccggaatggtgaccatggtagagatggagtatggtggatgactttgagagacatgtaggagataaaaggatctgtcagtggagtgggtaagcaggagtgtgatggcaagtctgagtcctaagactattttctgagctggtgaatgctaaatgttggtgagggaacccatgagttcatttgtgaacataatgcttttaagatgcctctcgacttccaagtggagatgctaagtagtcagttggatgtgtgagtctgaagtgaagaggagcggtctgaactggaatggtacatttatgcatcatctgtgcatccaaggattgaagccaggggcatggacaagaattttcaggagaatacctatgaggagtgcagagggtctaggacttaagtcttgaggaaattcaacattcagtgtctgggtggaggacactaagccgcaaaagtctatgagaagagatcagcgagatatgataaaaacagaagtctgtggtgtggtggaaaccaaggtcagctgtgttgcttgccatgcagaggcggagaggtgagggttcagcactggtactgggttcaggaatgtgaagccactggggacttaaggaaaggtcatttcagtggaggagcagagatggaaaccagatttgaaagggttgaggaaagaatgataagtgacagagtggagatgaatagaggggattttttttgcagcataaattggccatgttaaagaaaacagaggaggagatgactaagatggccttgcgggttgaggcagatctgtgtgggtgtgggtgaagggtggtgttaatgtcagagacccttgggtacatttaaaaggcaacaagaaagctctagaatgaaagtgaaaggcaaagcaataagttttctaagaagattgaagggggtgaaactccaagcacagtcgtggagattggtcttaaatcattggaagggcagcttctaattgtaataagcagggaaaaggctagtgaggatatgagagtaggtaggtttgtatgcttataaaaggaagttcccatctggttgtttctgtgcttttgtgcatatgaatatttgctgaaagtgattggtaggtgaatgacagatgtttgaggtaatgaggtaattttattatatactgctgattataatatgctattatttaatttaagatatatatatgtatgtatgaatgatactgatgcatgtaaatgcactctattttgcatagtggagtacaagaattcctttctacaaatggtaacgtgggaacaaagattgcattggcccactatgggctcatttgagcatactcccaatagagatgtgttcccgacatggtacattagcaactgccgttttgttttctccaaatcccttcaaatcatgacaggcctcgagctgtagtttcttccagctcctcttgacataattggtcacttccgctcaggctccagtggtttatgatgcccttcctaaggccaaatggctttcaacaatccttaatctttagcagctgtctcctcaattggttcctaaaaagaactcacctatttgaagtgctacaaaacttgcattttaacaccaaacaggatacctttggatccataaaatattatgcttcactctttttcattactcgggactttacagtagtaccccttcagtcaaactagctaacagcagaaagagaaaaaaattaactgttctttccaaatatgatcctaggcctgtgtgtatgtgtgtattttggaaacaaagaacatcgttatatataatatagcattatacgtgcccacactgtatgaagcagacctcttttttcctcgtataggtttaggtatcatcaggttttggtagttttgtgagatgaactggcattttctatacctttaaataattttaaatagtttatatcatagaaatcatctgtttaaaatgtttgaaagtgctagttcctacaactctctaaatcttgtcctgtttttgggattgagggggagcatcatggctccatctttaacattattttcaagtttccccccacttattgttatattcaatccaagttcttataataatttttaaataaattacataatttagattcacttgggacaaaaactatccatttcatgaggatactgaaatttattttctagagttgttcatcgagtctgaagtggctgtaagcctccctgttctcccttttcctgccacaaataatgtgtaatctatttactctttggcctaggactttatacaaattctagtgtgtggagttggggagttcaattgtttattattcacttatgttggactatattatagtccgagaatgttacctgcataatttatgacttttgaaacttactgcagtttcctagactaatagaggatccgtttttgttaatgttccacggatgcttcaagaaagcatagtgtatctatttctagggcccaagactacttgatttttaaagcaacataattttcttacacaaattatttttccttatttattttacaacttggcatattaaatactgattggcacataaaaggctctgactatggattttaaaaaatctctcctggtattcttacactatgtgtgtatgtgtgtgttatgttatttgacatattgaagtagtcaagactgttgtttgcaaatggcagaaacccaaccaagcaaaaagaacatgtcagcttatatattggctctgctgcttctcttggagtctgtgtttttaccctttaaatattaatttatttcttgatgaaggataaaaaatatgtatgtattttgagacagagtctttctctgtgcccaggctggactgcactggtacaatcatagcttgctgcagccccagcctcctgggctgaagtgatcctctcaccccagccccccgagtagctgggactataggcacacccaccacacccagctaatttttgtattttttttttagagatggggtctcactatgttgccacaagctatataggtttttctttttctaaaaaaaaaggcactttcatgataacactgcaaaagtcatatgtgaagtaagggatgttgcctcatgctacaaaaggaatttattcaaaaaatgatgctgacgtttcaacacttgatgtattatgtcctaaattcatagttgtaattattacctaaattttgttataagatgaggtaaacttatttttataatttttccttttttaactttaatttttgaaagtaaatgcttaatcagatcttttaaggtgagaagtgtctaagtaacattgtaggaccaatgtatgggatgggagatattttgtggccatttttcaaaatatactctacctcaataagtatcctaaacacctattaaacttataaattattttcagtaaacttgctttaagacagaaaagtgtgtcatgagtgttgtacaattccacccagaatgggttataatggggctttaaggcccacttattcagaaaatgttccaaaatagtctctgtaataaaaatttctagagaatttctgttataaattaaaatatatttgaaagttaactggatttttctcagatttaaaaaaaatgaaacatactagaaaatgaacacttaaacctctacaaggtaactacgttttgatatttgcaaataaaacctagagttattaagttgtagcaatgccttcttatatctcacgttagccaatgtttattttaaaagttcatagaagatacatgcagatttaatactgcatcctgccatggcagggaacataaaattacaactgaagacagcaggagaaaatttattagaaagaactgaacatcacaaatatatattttagaagtatttttggccaatactacatcctgtaaaatactgtaaaatggttgaattgaaacatggcatttgaaaaaagaaccacaacctagtaacataatggaacacacattcttgcatgaaaatgaatgcatttgcatatttcaaataacatagtcagttgctattacagtttgtttgtgactttttaatcaaaagtttgatttacatcttgttccgtctgattttccaataattttttttgtcccagcggacaaagaatactggttgagaacataggctttggggtcagacagacctgtctggccccaaagggaaaatatgcttgtgaaatttcatattttcacaaggagcagtcttgtactttttggctgtattgcattttagaatccctagagtatgtacaaaagaaagatcactgaattaggaggcagggaatttaatttttaggcttgaatctaccacatttttgctgtcttagtttctctctagacctcagtttccttagtattaaattaataaaatggaggtaataatactattcttttgacctcactgattattgtgaaagcactttgtacactttccaaataggaggtattgttattgtttttcctagcaatagaaacgttacaaattacagtcatagtgaacaggaactcaaatcataattaaaattttgaggagttgtgtgtctgccagatttagcacatatgcagtgatatagagaaagtgttattcttatgaagctgattcaaaaattcctcttaaggaaactattgtgactgtttggaaggaacaccttgatggcttatttgggggaactcctagctttgagtacatttggaatgcagataagtccaagggtggatggggagttgggatgctcttgaatgtttcaaggtaagtagatttgggagagagggagtaaagggactgaatttaaaaggtgaataagggaatatcataaactaggagactttggataatgcaaagttgtttgttcccaggtgtaccctgaaatgcagcctgcagccctatgatagtcaaaagggcagtatgctaagaatgagaagacctaagactctattttcttttttccacaataaattattccatgtcatttgcattttttcctctttctaacctgcaggccatcaagaagccatagcagtgtgcttacatatccagacccagcagacagtcaatgacagcttgtgtgatatggtccaccgtcctccagccatgagccaggcctgtaacacagagccctgtccccccaggtatgtgctgtcttgtgttcctggtatataccgtgtccgggtggtaacaccctccctgcagagaaacccacctaagtgcagacttgtggcttcacccaaggtagatgtgctaagcctgcttcagagctctctttgctcaagttatgctccagccagattcttgcctaggtgctcagatgcagccatgttgcacaggaatgctcttcaggctgacttttgtttgcatcgaacacgaatgaacataaactggcctgctacccataaaaccatgagatcagtggatttgttctctttctcctccctgtttcctccagggcacttcttcccttaatatcccatcagaaagcacaggatttgcattagagttaacattggtacacagtaggtgcttaatccatatttgttgagtgactgtgtaatctcctgtttgatatctagcactcatactgatgtgttattaccttcccattgacttgccttggatctcagattgtggggtataatattataaaccccaatgagtaggtgagggtgatcttcttgatctctttggctgataggtttaccttaaaagttaatctgcttccttgcttaagtcctggtaagatcctgaggaattttatcagaagagaagtagcttgttctcatgttcctgtgtccctggtgctgctggctacagagggtgataactgaacatcattggtttctcacacaagacctttctgaatatagcccccagtcttttcctttctctctcctttacccttattatcttgtgacccctcttctgcgagaagaattagttgccgaaaatgttaagcccattcccagtaacctcctgcctctcctacctcttagtcgtttgccccgctaatgaaatcctttcatttgctaaagcaagttctgctatgtttaggactctcagtgattgagggaggttattgtgtcctcctgccgtattagtctaaggataagtgtcttttatgtttattcagaaaataagttgtgcttctggaattctcttgacccttctgattttaattccatgcaatctgttggctatgatgtttctcctgccttgattgcataagggtggtgaaggtggggattgatacgttaggtccccctagaaatcaggccctccacatcctggagatgggcaccccttccttgagagtcttgttctccagcccgcacagtctcaggaggaggccagtgtgtgcctcatccttggtgaaatcacacccgccatgtaatgtaggatacagtgttttgtatccattaccatatttctcgcttccattgagacctacagaagtactgggagcttgttggcttatgttagagccatctggctgtgcgtggttgaggtgatgcagtagaggcctgtagacttaccttggtgagcaaagcaaggcccagaaacagcactgggaaatctgtttccctgccacctcccactcccacccccaggtttacagcattccagagtaatccacgctagaatgcagattgcagaagagacaataaaggaggggttttaggaaggtttgatgtaactaggagtcaagacatctactttgtcaagtatgtccagacttttccaagaatagcaaatatattggagcagtgttgaatatatattcacttggaatgacccttctatctttagagaaatagcacttgtgtaatggcacgtagtaatccgaattatttatctatgtttctcagttttttctgttctattattggaaccactgaattagatacttttggaaaagctggggtttctgttttcctcccctgctacatcccttccctgaggcagtgaagatggaaacagatgaccaccttcctgtacaggagcaaggcacaggggaaaatacagggagggggcaaaacatagttatatttctcaacatatttccccatgacattggaatcatgtactatatcattttgtaaactgttttcttaaatttaatctggggatggggcacgaggtagatgttaaataaacagcgtctcaagagcacgaatactatgaggacctaaaataaattggtggggcagggaagccggggaggttggtgcaggtcattcctgaggaagttatttaagacataaacacaggcaggaatctgccaggagaggtgtagaggaatgagtgctctgggcagagggaacagtatgtgcaaaggccccaaggaaagaaagagctcagtatgctcaaggaactggagagaaaggaaatcagtgtgtcatcagatgagataggaatgggcaagggccacggtaagcacttggacttcatccagagagtcagtgggaagtcattggagggtttgagcaatgaagtggtacatcagatttacattttaaaaagattactcaaacacagaaatggggagaacaaaatggagacaattagatcaagtataaatcttttaagaaaattatttaaaactagggatccagcccaccacaatttcatttgagcatcctcgatttaaagcctgcctccatgtgaatctgcaaatatcatcgtttcctttttattgtttatatgacactaacaactttttttttttttttttgagacggagtttcgctcttgttgcccaggctggagtgcaatggcacaatcttatggctcgctgcaacttccacctcctgggttcaagcgattctcctgcctcagcctcctgagtagctggggtcacaggtgcctgccaccatgcccagataattttttgtatttttagtagagatggggtttcaccatgttggctaggctggtctcaaactcctgacctcaggtgatccacctgcctcggcctcccaaaatgttgggattacaggcataagccaccgcacctggccaccaacaacattctttatcaaaatagttgaatccctttctatatttgtagccatgaatatcagttcacctctactgtcttttccaaaaatgctcagtgtctccttcagaaatactgctttcccaaccatggcccccatgctccagtattttgcagagcagttttaagagttctacaatccataaatccttttctttctttctttctttttttttttttgagacggagtctcactctgttgcccaggctggagtgcaatggcacagtctcggcccactgcagcctctgcctcctgggttcaagtgattctcctgcctgagcttcctgagtagctgagactacaggcatatgccaccacacccagctaatttttgtatttttcgtagagatgggattttgccatgttggccaggccgatctcaaactgacctcgagtgatccgcccacctcagcctcccaaagtgctgggattacagacgtgagccaccgcacctggcccatgaatccttttctatgtactgttttatttaaaacaatggatgaacctgttcacaacttacacctgcactgtatcaggtgttttgctgtgcaacaatttgaaaatcactgccctaagtctctttttggtgaaaagtagctagtactattcttattaatggcttcacattctttcagaaatgtgctaataaatatataatgaataaaggctcttgttttctgtatatgaaaactgaaatttaggatttttaggtaattgatgacttctccatgagcatacactaaataaattgcatactacaacataaagcccaaacatggagtatttctcatgagatgtcatctagtccaaattctgccttttctggatggccaaatggaggctgtgggagcccacatattatgctactagtagagctggtctcctgatttccagtccctccactagccatcccctttgtctactctagccagtactctctttctagaaagatgactaaaaaaaaatggtttcgaatttacacagacttaaaattgtgactacaatttggctgtgtgattttttttttttcttttttttgagatagggtctctctctgttgctcaggctggagtgcaacggtatgatcacagttcactgcagccttgaacttctggggtcaagtgatcctcctgcctcagcctcccaagttgctgggattacaggaatgagccatgtgcatcactaatttttaaaaatttttaaatgtttttagagattaggtttttctctgtcatctaagctggagtgcagtggtgcagtcatggctcactacagccttgacctcctgggctcaagacatcctctcatctcaaccttccaagcccctaggattataggcatgagtgaccacacccagctagctatgatatattgctagccattaacaaagaagagtaaaaagaagaaaatacaacccaatatgttggggtatattttatttctagatttaaatcttactgcagattgacatgaagctagtcttcaccagagttctgtcctgtttctagccaagtaacaactaaaacagagaaaacgaaaatgataacaacatgaaaggcacttcaaatgagaatgatttgcatatcacaggatgaaaagagaggccctaagaacactgatgaaactctcagttttatttttgtgaaaataactgttccactcttgctctggaagtgaaggtagccataatgtgtcatcatataattttttcagaaaagaaagccaaaatatgaaacaatttacaattcattctctgccattctaagaattagtgcataaagttggcattacaaccacaattatgttcaagataagataacttgattttataatttttaatttaaattttcaagactaaatcaaacattttcccccactttatcatgaaacctgagtttcttttttgagtggaatcacataaagtggccttttatggtttttgttctctgataatatgaacttgagattcttgaccatttacttttcagtacttgatgaatttgtcctaatcatgtgtaactgccactgccttaattcagatatgttttacctgaactgtttcacaagtttctaaatgaactcttgactctcctgtttcctgctctgatccatgtgcacacacgactatgaaagatctttatctttctaagttgcaaaatgactgtgtgtgcctctgcatgaaaccttcaacaacactcctttatctatggattaaaacccacattctctactttggcatgtgtttcttttgccggggctgccataacaaagcaccagaaacagagtggcttaaagaacagaaatttatcatctcccagatctggagaccagaagtccaaaattaaggtgtccgcggcgttgattctttcttagagctgtgagagagccttggttccatggctttctcctggcaggtaacctctggcattctttggcttgtgaatggcattgtccctgtgatttcatattgttttccttctctgtgtctttgtgtccacacttctccttttcataaggacatcacttatattggagtagggcctactctaatgacctcctcttgatcatctgcaaagaacttatttccgaataaggtcacagtcacaagtactgggggttataacttccacatcttttgtgggaaggcaattcaacctataacagcatataaatgcctttgtgaccctggatccaactcttaaaccacatctcctgtcacctctaccacacacacacacacacacagagagagacagagagagacagagagacagagacagacacacacacacacagagagacagagagagacagagagacagagacagacacacacacacacacacactcagactcaccctaaggaacttgctcagcagccacagtaaattatgcaccatgacccacactcctgctcattcatgccatttggacctttgcacacactatgccctctgcctcttagagaccttcgctactatgacattagttaattctctcccataaaagtaatcattggctcacttctcactggtaaaatgaagttcaacagaatgtgagataggatccttacctgagacacttgatagcaaggaactctcaaaagtcaaaagaaaattggaaatggatcagggacatgggataaagcctcagttccacgtctctcaaggaatttcaggtgagttccttagctctctggaccctgtttcttaatatgaataatgaagaaaggtgttggactttatgatcaccgaggtcccctaagctccagtctttcatttttgagtagtgctttcaggttgcatttttcactcatgtcttcaaattatgtctagtccttttgtaacaatccttatgtccatacctgagtagtgtgacgtgcttggggttttagttctaaggatgacagccttggtttgacctgcccaggaggtcaaggcagggttgagtttagtcagtgctcttccattgcccaccaaaccagaacaagatttagcaacaaatctagaaattgtttcttaaatttactgaagaaagcttactggtttattcatgcatcagcctgtgtactgtatcccctttctctcatcactgtgcctcagcaagagttcttacacattctcttcctcagcaatctcttgcccacagagcttccaagctaggaataatagagcagacaacatgtcttggccactttgcaaaattaagagtctgtttttatgtgaaaggaaatactattcctcatttcaaagttgcaaatttaataaacttttcaaaggttgagagttatattggaaaaaaaccagcagagacaaagatttgatgccaaaataaaggtaagtttacaaaaatgttttaggttctagaaactagtggtgtaggaataacaggaacagtgtgttgcataatattttccatacaaatatttactgactccaagggcaatagcagtaaaatattaccccagggtgaaacttaccactgagattgggttgaacagccagtggatctttatttacccaaaggcaaatgtatttgatgtattagcctgggctctccaaggtggggtgttggatgtttatttgcttttatggggttactccccctgatctatcctataactgctgagtgcctgctatttatggagtttgctttttccaggagagagccagcagcttgtagaagcatgctgggttacataatggtcctgctagtctgaggagagccttcttctctaacaggattcaacactgctagggaagaaaggaggaaagcaagaggcaatagtgatgtgtttctgtaccagcttgttacctatttcttgatataaaaaacaattctttattgagttcattgtctgtgaataagaaattgttgcccatttcttaaataaaaacagctccatctccagttccttgtgactataattgatttatctagctatacacttgctcaaaagatgatcatcctgaagtcacatcaataaacttacaaatttaagctgaattgttttaatcatgaaacagaaaccttctgattatttagctatgtagtccaattgtcatccaaatatgacccatgtatctactttcggtgacttcactcacattcaaaacttctggaatttagatattatcaattatagtctaagtaattgatagacttccaattaagatggtgttgtaacatcatattctgttccaaatacagatcaatggtagatgcagtataaaagggggcctatcaaagacacaagtaagaaaacaactacctgggctaggaaaggaatggaaacatgaggtggtgaatggagctgcacttgtggttatttggagcttgaggtcccaaagcaattgtagcaaatgacagttcagtttctaagataaaagaaaaatagttgatgatttggggaaagggaagaaaattaagaaatatggaagtaacgtcagagaatgaagatatgaagtaaactgtttactaaaacttaggaaaaaatatccactcctagtatcaagagaaacaaatgaaaataaatccctacatagatatgaaatagtgaaactacagaaaatcagggacgataagaaaatcttaaaagctaccactcatgaaaaacagattaactacaaacaacttatcaacaactggagtttctggaagacaaaggaataatatcttcagaatactgagggaatatcatgatcaccatagagctaaacttgctgaactattatttcaagtatgtgactgtatacatcagtttctaaccacatgatggacttgatatccttaaaggctttttgctaaatacctctaaaatactgggtaaaatatgtaaaacatatcttgaaatgcagaactaagcttgtaagaaagtaagagaaatcctcagaagacaaaaacaagctgaagcattgccttagtggggacagttgtcagtctcagtaacctacactttttggctttaagatcttttgcctgatagacaagtccttagaccttcagaaagtaaggaatagaatggagattccccatacaaagccagggtctacctcaatggaaaggcaaattcaaaaaatgaaatccatcctgtaaagagagattgcaaggagaactatctgtctcaggtctgcctctgaatggaaggaatcagaaaggctcccctgagaatctaagagctacaagtagccctttatgtaggagtagggtttatattcactctatgtgatccaaaaaattaattcatactggtcttgatagaggtgatgtaaatcctgcaaggaggaatgtatcttctacccagaccttaaaattcccacaaagacataatgagcattagctcataatcaaaattttttaaaaacacatgaagaaacaatgtgtgagagtcagtgggggaaaaaacagaatcagatacacagagcatcgtaaattggaattatcaggtacagaatataaacgtatttatttaaaatgtttacatatataaaacaggaaattaaaaatctacgctatgaacaataaactatcaaaaatacttggaagattgtttagaagaaccaattatcacattgaaccatctgaaactttctatttggtcaaaaatggtcaaatattggcagtttatatggttccactaatagaatatctagaagttaaaaatacagtgattgaaattcaaaagttatgtgctggagtaaacaggtaaaatggaagagagagctgaaaaaattacccagaataaagcatggagaatacataaaatatgtaaaatatccacaaaaggtagatacagaggaaatattgagaaggtttatcatatataaaaatggagtttcaaaaagaaaacaagaggtggcatttttcccctgctctacaggtctgtggaactttaaaccagagggggtgatataggatatcttgcagaagaaatttctaagaagcaaagcattcaagaggtaacttgggtgccttaaaaagcatttagttttatgcattcacaaagagatgatttggaattggaacttatgtttaaaagggaagcaaagcataaaagtttagaaaatttgcagcctgacaatgcaatagaaaagaaaaacccattttctgaggagaaattcaagcctgctgcaaaaatttgtataagtaacaaggagccaaatgttaattgccaagacaatgggggaaatgtctccagggcacgtcagtggttttcatggcagcccctcccatcacaggcccagaggcctaggaggaaaggatggtttcatgctctagtcccagggcctttgctgctttgtgcagtctcaggacttggtgccctgcatcccaggcatggctaaaatgagccaacatacagctcagtccattgcttcagagggtgcaagccccaagccttggtggcttccacgtggtgttgggcctgcaggtgcacagaagcaaaaatcgaggtttgggagcctttgcctagatttcagaggatgtccaggcagaagtttgctgtaagggtggagccttcatggagaacctctgctggggcaatacagaagggaaatgtggggtcagaatccctacacagagtccccactgggacactgcctagtggagctgtgagaagagggccactatcctccagacaccagaatggtagatccactgacagcttgcactgtgttcctgaaaaagctgcagacaacgtcagcccatgaaagcagctgggagggggggctgtaccctgcaaagccacaagggcggagctttccaagaccatgggagcccatctcttgcatcagtgtgacctgtatgcgacacacgaagttaaaaggatatcatttcagagctttcagattttactgcccagctaaattttcgacttgcatgggccctgtagccccttcatttgggccaatttctcccatttggaatggatgtatttacacaatgcctgtacccccattatatctaggaagtaactaacttgattttcattttacaggcttataggcagaggggacttgccttgtctcagatgagactttggacttggacttttaggccaatgctggaatgaattaaagctttggggactgtgggaaggcatgattggttttgaaatgtgaaatgcacatgagatttgcgagaggggatgaaatgatatggttaggctttgtgtccccaccgaaatatcatcttaaattgtaatccccataatccccatgtgtcaagggagagaccaggtggagataattgaatgcagtaatgaaaattaaactcctttctccagaacttaataagtaaaataattcatccaaaaatacccccaaaaatatgctaagaaaagagaatcacatcaacaaatgattggataaagaaaatatggtatatgtacacaatggaatactattcagccataaaaaagaatgaaatcttgtcttttgcagcaacatggatgcaactggaggccattatcttaagtgaaataactcagaagtcgaaagtcaaatttcacatgttctcacttacaggtgggagctaaataatgtgaacccatgaacatagagtgtggaatagaatttggagactcagacaggtgggaagagggtaaagaatgagaaattacctaataggtacaatgtacattattctggtgttggttgcagggaaagtccagactttatcactttgcaatatatccatgtaatgaaattgcacttgtaccccttacatttctacaaattcaattttgaaaaagaagagagaatcatattaaattctcccactttttaagtaaaaaaatagcggtaatacccagtggtgacagattcagaaaaaagttaggaaatgttcttgtagataagcgtctgtcattctgatggatcatgactagtgcattcacttgtgattcctttgcctttaaaaaataatgatattaaaagaaaaaataagtgccttatactgtgaaaaatgataaaaaggacttcatgattctaaaaagaagaaagagacttatcaaagagataataagagggaatatttcagaattaatgaaaaaatatgaaacctaagaattgggagtcacagcaaatcccaaacgggaaaaaaaatacacactcagatacattgttgttaaactttagaactctaaagacaaagaaaatctcaaagtcagagatatagaaaagatccaggaaaggaacaataacaaaaactgccatttttcctcatgagaaataatgaagcattatcttcaaatggctcagaaaaaaaattcactgtcagcctagaattgtatacttattaaaacaacattttagagatgaaatagggatattttcagattgtaatagtatctccttatgcagcaggtgtcaacaaagtagtcttatagtaaggttatatgacaattaaatgagttaatacatatactttaaaaagagcttggcacatcataggtaatcaataaatatttactaatattatgttaagtattctaggtgaacaaaaccaggaaattgcactatcagcaaattttcactaaagacaattttaaagaatgtattcattaagaaggaaaatgatcccagaaggaaggtctgagatataagaatgaatgatgaccgaagtatattgtaaagatatttaatctaaaaaagtttattgactatggaaatcaataatagtttctgatttatcaatttgaaaaaagaaatattgtccaacaaaaccttgtaaaactcagagagattgattaattaaagtgctttaggcccttataccatttgttaagatggaaatgattttggttaagtctagagttgttaaatagggcctttaaaattctaagggtaaacctaaaaataaaatataacagaggggaaaacagaataaaaactataacaagcaaaataaatgctcacaaaaacacaggaaataattagaatgagaagaatggaaaagtcaggaaaaacagaattcttaacaatagtaacagatgaaagtagttcaagatagctgagaaatcctttcatcttgatcaataaaaggatagacatactgaacaactgtagacttttgttataaacatttatagttatgctataaaaaccctggaagataacctaggaaataacattctatacataggacctggcaaagatttcatgacaaagatgccaaaagcaattgtgacaaaaacaaaaattgacaaatgagacgtaattaaactaaagagcttctgcacagcaaaagaaactatcaacagagtaaatagccaacctacagaatcagagaaaatattagcaaactatgcatccagtgaaagctcaatatctagaatctgtaagaaacttaaacaaattcagcaaaaaaccaaaaatccctttaaaaagtgggcaaatgatgtgaacagacactttccaaaagaagacctccatgtggccaacaagcatatgaaaacatgctcaacatcactaatcactagagaaatgcaaatcaaaaccatagcgagataccatctctcaccagtcagatggctattattaaaaagtcaaaaaattacagatgctggtgaggttgcagagaaaagagaacatttatacgctgctggtgggaatgtaaattaattcagctattgtggaaagcagtgtggcaatttctcaaagaacttaaaaaaattaccgtttgacccagcaatttcattattgggtatatatcccaagaattataaatcattctaccataaagacacatgcacacgtatgttcaccgcagcactattcacaatagcaaagacatgaaatcaatgtaaatacgcatcaacagtagactggatttaaaaaaatgtacatatacaccatggaatattatgcagccatagaaaaagaatgagatcgtgtcctttgcagcaacatgaatggaactagagatcattaccttaagtgaactaatgcaggaacagaaaaccaaataccacgtgtcctcatttataagtagaagctaaatattgagaatacatcaacacaaagaagggaacaacagacatcagggtctacttgagggtggaaggttggagaagggagaggattgaaaaagtacctaccaggtactatgcttatttatatgggtgatgaaataatctgtacaccaaatgcccatgacatgcaatttacctatataacaaatctgcacatgtacctaaaataaaatgtttaaaaattatcattacgtatgttaaaagtcaaggatcagtgctaaatgaacagaaatactaatttatgtattgattttgtctttttgcatgttaattgaatgtaaaatttctagaattcaaaaataatctaaaacttgtatcaccttatattaatcagggttcctaggtataagcagtataaactaattgtgcttaacttgagctaataataaacttactagaaagatgctaagtggtccacaaaaataataggctggataactaagtttataaatttttcaggagctaagggagattaaattgaaagaaaacacaaagtcataccaaagtcatgtctggttaggtatttctggacacttgtggccattactgtcacattgtaaagatatttaatctaaaaaagtttattgactatggaaatcaataatagtttctgatttatcaatttgaaaaaagaaatattgtccaacaaaaccttgtaaaactcagagagattgattaattaaagtgctttaggcccttatactatttgttaagatggaaatgattttggttaagtctagagttgttaaataggtgatgcactcaccaccaatgcctggtcccatataccacttccactcggtggtgggccactgctggtcacatctaactatatgactttgcagatagataatgtcccctttatgataagcagcttgtcacatggtcatctgatgggtcatggtcaggtgttccaccatggtcaggtgtttagtatctaaaaacgcctagaactaggctagagctattttataggaggagcattgctaccctttaaaagggcagattttatgttatgtaaactgcatctcaataaagctgtcattttaaaaaaagcatttcacagcgaagacatttaattttttgttatggttacattttcttttgggtgcaagttttttctctggagttggcaatctccttactttttttttgtttgcctaatttcaatgatcccatcattaacttattctcaaaatctctatcagagtttattctctcagtacattcaaatatatattttgttttttacatattctgtttcataactttcttagtgctttagcactgtgtgtttacattgatttctggtcaactgagatgtttcatttgtatgggggaatgtcttacccttatgtctttctttaactggtattgctattttttgtaacaaaggggtgctcaattagatattttgctctattctccagccctctctcaccttcccgcccccaagcccttgcttttttggatgcgctaattcaaattaaaaatgttttttatcatgaatatctgttaacatttacaaatgtttttctgtctctattgaaatgatcatatgaattttttcctatagtttgctatgtcgtagacactgattgattttccaaggttgaaccaattttgccttcctagaataaacccagattggtcaccatgtaacattatttttcactttatcacttgattgctaatattttatttaggatttttaaatctgtttatgagtgacataggcttaaatgagttgggaagttcttcttcttttttttttgagagtttatataaggttggaattgtttatgccttaaatgtttagtagaatttcaccaaggaagccatctgacatggagtttattttagatactttaaataacaaatttaacttaatagatataagactattccgatttctcttcacttgtgtgttagttttgataagttggtttttgtaggaattttttcagttcatgtaaactttcaaatttattgacataatgtttttcattacttattgtactttttttatgccacaatgtcccttcttgaattcctgattttataatgtgtgccttctctcttttttctccatattttatcaataatttattaatcttgttggtcttttgaaggaccaactttttttttttttttagacagagtcttgctctgtcacccaggctggagtgcagtggcctgatctcagctcactgaaagctccgcctcctgggttcaaccagttctcatgcctcagcctaccaagtagctgggattacaggcgtgcaccaccacacccagcaaatttttgtgttttcagtggcgatggggtttcaccatgttggccaggctggtcttgaactcctgacctcaggtgacctgcccacctcagcctcccaaagtgatgggattacaggcatgagccaccgcaccccgccaggaccaactttttgtttcattttctaattcattcattttattctcatgtttattgcttcctttcttctactttttttgggatgtaattgctattctttttttaacctcttgaaatggttacttagattattattgtcaaacttttttaatatatcatttaaggctattgattttcttctaatcatggctttagctaaattccacaaactttgacatttgatatttctattagtgtgcatttaaaaatactatttactttcccttgtgatttcttctttggcccatgcgcaatttagaagattacagcgtactttctaagtatttgggctttatctaatttagttccactgtggtcagaaaatatactgaattagtcacctcacactgccataacaaaataccgtaagggtggcttcgaagacagaactgtattttctcacagtctggaggctggaaagtccaagactaaagggttcagtttttggtgagggctctcttcctgacttgcagacagcagatgtcttgctgtgtcctcacatggtggagagagagcaagctccctggtgtctctttttacaaaggcactaatcccatcatgagggctccactctcatgtccccatctaaccctaattacctctcaaaggtcccatctctaaataccatcatgctggggtttagggcttcaacatttgaatttgttggtgacacaaaccttcagaccacatcacagaccctgtattgttttaatctgttgattaatttgcttcttttttatttagaatttatactttcatttaggattcaggatatataaccacatgcaaaagtttgctttatatatatttgtcagcttttgtgttcagattttttctagctttataatatgcataaaataaaatattttcatcttcttattttggaacatttaagataatatgggaattcacctgtttcttgaaaatttgtaggacttgaccacaaaactagtgaggtccagtccctttcttgaatggaacttttgtaattccttagaaagttatctattttacccatattttcaaatatattattaaatctcctatattcttattaatgtctgccttgttaatatgccaagggtttagcaaagtattttaaatattttaaattttttaattttttttgtccatttttcctatacttcatagctcatgctttttacaagtttatgttttatatttaatctccatacttgtatgattatatcttcattgtgaaatttttccttcataaataaaacttttattcttttgtcctattatatctgcattaaatactacttttcattttatttttatttatacaagtaggaggtgtttataatagaaaattagaaaagagaaaaactgagaatcatttttagattaaatactaattaattttttcagagaaataatattttttccaatatgagtgcttattttaataaaaatcagagaaaaaatcagcaagaataaagaaaataaaaatcctatagttagatatcatcactggcaacattttaatgaataattattcagatttttttctgcatgcatttataaatgcataaaataggattatactctacaaattattttatgaccttttcttttctattaaaaatatatcatgactgtatttctatgttaataactatacatctactttattattttaatggctgctagcattgtgctgtatgaatggacagttattttctgctatattgttaaacatttatatgatttccttccattttgtaaaatgtaattcaatttaatttttgtgtgtgtgctgttattacacactaccctggagccagcatccttttatgaacattttaaacatttaaaaatggtttcctcatgatgtatctctacagtaactagtgaagaattcatgtttgctaattaaatatccacaaattaaaataaccataatgtgtaatttttcagccatcagatgggcagagacttttctcaatgatattctccaatgtggttaggggtgtgggcaactaggtgctctcaaatgcttctggtgggagtgtaaattgggagaatcttccttgaaggcaacttggaaatatgtgtcgaaagcagctgccctggtttttcatttttacagatgttttatgagaaaacctgatttttccaagatcttattggaaaggaatcacattatatatatgttgtaaatccaatcctaacattaaagaattttcttagggatattccaaataatgaagccaggtgccctgaagatttcctgaagtgtgcttttaaacatttaaaatttcttttgacacctatataaatcatcattgccttggggctccattcaaaacagaaccaggattttatttttgatatatagtggtaggacaggatgggaacagatctgctgctttttactctggactttcccaaatgggaaagatctttaaacactttcctgacatttcttgcctttaaatactatatttctgtgttttaattgcgtatattgatggagatgctgtgactgtagaatctgtatacagggtgtgaagtctggaagcccagaggagagcttcacgttgttcatgctctgatggttgcacgttggtttattggactgttcaactttccccacttgttttctgttttaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcaggtagggcagactggccactccagggccctctgtgattatgactgtgagaggccctgcactgcactaacatagagtgggccaagcctgccgcctcaccccctcttgtcttcttagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaaggtaagggccaggctcaactttatagtcccttcttttctgcccctcctttgtttcagcttctaaatatttccacaagatcaggctggaactactgtgagatgagtatgggtcctagggggccacatttaaggaggtgctcactcactctcgggtttgtgcaagttccgtagtccaggcctgcacacaatgattcatttccagtttttactcaatattattcaaagtgttatcatcatcattctcccaaaccagccccttcttttggaactaccaggatcatagtatcccaggataaactcagaatcactttggttcctctcttccttgtgtcctcccatgtggaatcattcattaagccccgtcattccaacattttgaacatcttccatgccttaacttcctctgtgttctgtcacttatgctgttaattttacccttcatcatggcaagcttgaattagtgcagtgagtagaattctagtagatcgtttcagtgctggcagggcttgacccagtctagtaatgaagccttatttttcaggtgggggaaattaaatcccaatagctgaagtaagctgcctaagctccacagctggaaaagtagcagaatccacttgttttgactttattccaagagttctttctgttatattacactgcccacttgatctttctgtattactctcccatctccagactagctaacatcccatagtgttcccatcactgtgtccatcaagtctccagcttgttcagaatcttccataagtctgattgcttgcaaaatcaagtacagtagtcccagtttattcacagggaatacagtccaagaccccagtggatgcctgaaactgtggatcatactgaattttatatatcctatgtttttttttatctgataactgagaagactacttaagtgactaataggcaggtagcatggatggaatgattcatgtcctgggcagatggagcgagatggtgagagatttcatcacactactcagaacgtcatgcaaactaaaacttacaaattgtttatttctggaatgttctatttaatatttttggaccacagttaactgtggaaagcgaaaccgtggataagaagggactattgtatatgttccccagaatagctggtagggcctttcttgcactcatggctctcttactccagtccttattcttcttccagccctttgctccagtcttgctgcatccttaacatctgcaggctgagattttagcacagattccaaaacacataattagttatgttatcagtgtcttgtaaccttcagtcactgctaactggtaggtatcttcttggagtggagacccaaccccaacatcagaactaacctcaagaaataaggaaggacagtgagtgacattcacaacctgctctgagtcctaggttcagtgccaggcatagtcatgacctgctcctctcatatcatcctacgatagccccagaagcagacgttgtctccctttttatagatgagaaaaacagaggttcattcagattaagtaacttgcccaaggacagagatagattcaaacccaggcctgtgtgacccaaaattattacacatgtatacactcctgtcttttatgcaagagaaaaggcttttgagtccaacagacccatgctggtaccccagctctaaagcctaaatctgggtggccttgttaaatacacctaacctctctgagcttccgtttactttcgctaaatgcaatggttcttgtgaggataacataagatatttgacatggcaatgtctagtagagtaggctcttcccattgcccttgatagaaggtccacatttctggctgtaggttggattaacagtatttctgtacatatatccagattgggatttttcctgttttaaccgtgtagttttgttaagtgctagtattttaaaactgtcttaactgaaaacctacaggtcattatcctcaatcaaggccactgaaggtctacataaactttccctgaaacctcagaagaggcccaaggaaagagatgaacccatctctccagggtctacagagcaggagttgccctaggatccagccaccaatacccacttcctctatccaactcacaagcagctggagacagtgccagtggccacagctctccccggaaagttgccatactataggtcaatgacttgagggacaggagtccctcctgcagtcaggtcctaaacaaagagaaaggactgatccaggtgagaccaccaccccaaaggagggtgggaaggacaggtagaaggtctgtctggagagctttgtgtgcaaaagtgggtttgcttaattttcctcctacttgcacaaggaacaatagacggcccaagggagaatcattcttttgggaattcctttgagactaggtcaggcagtgggggctgggcaaaggtgttagagaggtgggtagcctgggtgggctagtgtgtaggcagtatttattccatcacccagctaagccccaagagtgaagtcttaccttgccccattgtcaggagagatgaaggttccagttactgtttccataaagttagggacagaaggaagggccacaattttgtggggagaatcttggcattgtgatgcgtgattctccttgctacacttagtgtggcccaaggactagtcaaattgacatcagcagggaacttataagaaatgaggaatctcaagtcccacccagacctaaggaatcagagtctgcatttcaacaagatccctgggtgttgtaatgatacacttgcagtgtgagaagtgtttccttacctgcctctcattcttgtttgggtgagttagcccttacatgtgtccaaggtaggaatggccctgggtagtgacttctttgatcaagtgctgccctaacctaaagggaggaggcaagaaaagggaagaacagcaaaggggcagatattgaggaggagaaaccagacagcttgtttctggatgcagcgagggagcacctagaaccactgccaagctctaaaataccccactttgcttctgtccttgcttctttcctctaagaacaaacaggccttcacagttatatcctgcctggtggaacaaacggttgtcactggtgtcttagagtggaggctagtggtgacatcaccactttcctccgtgtccgctctctcagtgaataactgaatttacagttgccagttgcgtatcactaaagtaacaccattgcacatctatgtgggcccacttgtgtgtctttgctcttgtggctttcaaatccttggtccaactgtgagctttcctcttctgtgaagttttccacttcctaaagtcacccagcatttccgacttttaaatcacagtgaccctaatttttactgttttgcaatggtagctatttcctgagcatccacatggtcttcccatctggtttatattgtccttgaggccagtggccatgggattgccaacaggtcctccagttgttcagagctctaagcaagtaaatactattcctcaacagtctttgcaaagtcagagaaaatccaaagtggtgttgaaatagtgatctttagaagagctcaggtctgctaacacaggagaggcagatcgttcattggaggggtttttgttgagacaaagaagaaaaggaaacttaagaggaggctacccatgtgagctggtttggactggaggctgtttagtttcataggcaaccattcatcagggcaaagagcaagctcttctgtgctccaagaggtcagcccaaactcaaacaagacactctggcttccagtcatgacctcacatctaggaagcccctatctgggaggaagggcaagcgtatatacacgcacaagaaaacagaggcagcctcagcctgtgacaccaaaagccattggtgaggcttgagcgcagtcaggcacacaacctgttgcacagaaattttagttttctactggatggagctttctcctgttagttaaaatttcttctcatcagagttgcttttttttggcagagactctgataccaaattgccacccttcttaaagcttcctgccaaactagtccttctgccatgggatggctcacttgggggcagccatccattttgtggttctggataaggtccttccacgttgaaactggccactaaccctggacacagaaaggctgagcagccacgccagaatttccattcttcacggagccaggcctctggcttgcagccagaatcttcctcttccccgacactagctctattcatgatatgtttaagctctgtccattcattggcttatgagtttgccttggttccttagatctggaccaagccttaggcagaaaggagccttcagttcttacactgcttttgaagttataagaaaggagcattgactcatatcaggcaatcttcccaaatggtgaatttctgtgatccacataccccttgtagcctgttttgtgtcccacctcttggctgaaatagcctcctttattttctgtactttgatggaacatttgattattttgtttatcttcacctttttccttcatcatgtttcttggtgtttttattttttctacttatctgactatgtcttttctgttggcttctcttcttccaaatctcaaaaagcccaatatttgatccttttccattgctacacttttccactgtggttgattctgtgtcctgaattctttaactcccatggatgattttcaatctccagaaagtctctaaccttctaaccacgtctccagctctccatctagtttatatcctcatcgtgggaaagcaaagggacagcctcttcactctctcccaaccagttctccccacttcctgtctctgtccatgtaccactgtcttccaacacttatgatcatctctgagttcttcacctcctatattgttattcgtatctgccaactcttcaactcttgaactattaatatatctaatatgctaagtaaaaaggaaaatatctctataactgaaaaatgttataaagaacaacccaagatatgtccaggatacatggattttaaaatatggcattccccgattttccatagaactatgaattacaactcgtgaaggaagtagtgtgttgaagtcagttcttactggccagtgagaaccacttatgatctcatcccaacttgtgctcagtcacatagggttgatagctggaaatcagccatgatgggagtatttacaccacagaaactggcaaaaccatcatggctatttcctccaagaacatgttttgaaacatttaccagcacacaagtgcacaaaagcttatttacacacacacacacacacacacacacacacacacagagttatgaatgaaacactttcagcttatcgatggtgcttaggatggaagtgccctcaagaagctcccatctctgagctctttgatacaaagtctaagaaacttggttgggcttccttaagacattttttatctttatcttcataactggtgtttcttggggccaggaaatatcagacctctgggtgaagatacattctatgaatcattatcctacagatttaatttggtcttgatcgaaggttgttgatctaaatgcattaactgtatgttcagatattctttctgtgaataaaagaccagttcagctcttaaggtttattataaaactcttcttttactcatttttattatgtgttattaattatgagttttttattatgaatcactaggcagataacaattctttttgaatttttttatttttaatttttgtgggtatatagtaaatatatattttatggggtacatgagatactttgaaacagttatgcaatgtgtaagaatcacaaaatggagaatggggtatccatcccctcaagcatttatcctttgtataataaacaatccaaattatattattttaattattttaaaaatgcaattgaattgtttttggatatagtctccctgttgtgctagcaaatactaggtcttactgattctttctaactattttttgtactcattaaccatccccacatccctgcccaactaccctacccagcctttgataaccatccttctactctctatctccatgagttcaattattttaatttttagctcccacaaataagtgagaacatgtgatgtttgtctttctgtgcctggcttatttaacttaacataatgaccttcagttccatccatgttgttgcagatgataggatctcattcttttttatggctgaatagtactccattgtgtatatgtaccaccttttctttatccattagtctgctgacggacacttaggttgtttccatatcttggctattgtgaatacggctgtggtatacatgggattatagatagctctttagtatctgattttcctttctttttggtatatacctaggagtgagatttctagatcatatggtagctctatttttagttttttgaggaacctccaaactgttctccatagtagttgttttaattaacattcccaccaacaatgtacaagggttcccttttctccacatccctgccaacatttgttattgcctgtcttttagataacagccattttaactggagtgagatggtatctcattgtagttctgattcgcatttctctggtgatcattgatgttgatcaccttgtcatatgcctgcttgccctttgtttgtcttctttggtaaatgtctattcagatcttttcccatttttaaactggattattagatttttttttcctatagagttgtgtgagccccttatatgttctggttcttaaacctttgtcagatgggtaatcttcagatattttctccaattctgtgggttgtgtctactttgttgattgttttatttgccgtgtagaagctttttaacttcatgtgatcccatttgtccatttttactttgcctgtgctcgtggggtattaatcaagaaatatttgcccagagcagtgtcctgaaaagtttccccaacgttttcttgtagcagtttcttagttgaggtcttaaacttaaggctttaatccattttgatttgatttttgtatatattaagagagaggggtctagttttactcttctgcatatggatatccagttttcccagcatcatttattgaagagattgtcctttccccaatgtatgatcttggcaccattgtcaaaaatgagttcactgtagatctatggatttatctctgggatctctactctgttccattggtctatgtgtctgtttttataccagtactatgctgttttggttactattatctctgtagtataatttgaagtcagataatgtgattcctccagttttgttctttttagtcaggatagcttgggctattctgggtcttttgttgttctttataaattttaggatttttttatttctgtgaaaaatgtcattgatattttgatagggattgcattgaatctgtagatcgctttgggtagtatggacattgcaacagtattgattcttccaacccatgaacatggaatatctttccattttttatagtcctcttcaatttctttcatcaatgttttatagttttcattatagagatctctcacttctttggttaagttgattacttggtatttcattttatttgtagctattgtaaatgggactactttcttgatttttttgattgttcgctgttggcttatagaaatgctactgatatttgtatgttaattttgtatcctgcaactttactgaatttgtttatcagttctaatagttttttggtggagtctttaggtttttccaaatgtaagatcatatcatctgggaacagagataatttgacttcttcgtttccaatttggatgccctttatttcttttcttttcttttttttttttttcacctgattcctctaactaggactactaggactatgttgaataacagtggcgaaagtgagcatccttgtctttttccagatattacaggaaaagccttcagtttttccccattcagtatgatactagctgtgggtctgtcatacatggctttcattgtgttgaggtatgtttcttctatactccttttttttaggatttttgtcatgaagggatgttaaattttatcacgtgcttgtttggcattaattaaaatgatcatatggttttgttcttcattctgttgatatgatgtattacattgattgatttgcatgtgttaagccatccttgcatccctgggataaatcccacttggtcatgatgaatgatcttttactgtgttgttgaaatcactatgctgatattttgttgagaatttttgcatcagtgttcatcaggccctgtagttttctttttctctttttgatgtgtttttgtctggttttggtatcagattaatactggcctgatagaatgagtttggaagtattctatcctccactatctttcagaacagttcgagtaagattggtcttagttctttaaatgttggtagaaaccatcagtgaagtcattggatctcaggcttttctttactgggagacattttattatggctttgatcttgttagcttgttattggtctgttcaggttttggattttttcatggttcaatctgggtaggttgtatgtgtctaggaatttagccatttcttctaaattttctaatttattgatatgtaattgccatagtagcaactaatgatcccttgaattttgcagtatcagttctaatgtcttcttttccatctctgatttaatttattggggtgttctctcttgttttcttagtctggcaagagttttgtcgattttatttatgttttcaaaaaaccaactttttggttcattgatcgtttgtatcgtatttcttctactaattttgggttgttttgctcttgattttctagctaagatgtattgttaggttgtttacttgaagtttttcttcttttttgatgtaggcatttatagctataaatgtccctcttagtgttgctttcactgtatctcataggttttggtatgttgtgcttccattatcatttgttttaagaaaattttcaatttccttcttaatttctttattgacccacttgtcattcaggagcatattgtttaaattccgtgtatttgtacattttccaaaatttctcttgttattgatttctaatttcattccattgtggtcagaaaaggtgcttgatgtcatttcagttttttgagtgttttaagacttctgtagggctgaacatatggtctgtttttgagaataatccatgtgctgaagagaagaatgtgtattctgcagccactgaatggaatgttctgtatctattgccctatagtgtagattaaattggatggttctttgttggttttcggcctggaagatctgtccagtgtttaaagtgggatgttgaagactcaagctatcattgtattgaggcctatatctctatatggctttgataatatttgttttatatatctgagtgctccagtgtttagtgcatatatgtttacaattgtcatatcccgccaggcgtggtagcaagcacctgtaatcccagctacttgggaggttgaggcgagagaatcacttgaacctggaaggtggtggttgtagtgagccaagatcgtgccactgcactccagcctgggcgacagagtaagattccacctcaaaaaaaaaaaaaaaagaaaaaaacattgttatatccccttgctgaactgacccctctataaattaaacaatgacattctttgcctgttcttacagtttttgccttgaaatctattttgtctgatataagcatagcactactgctgtttttggggttccgttggcatggaacatctaactccatccctttattttcagtctatgtgtatctttacaggtgaaatgtgcttcttgtaggtaggcaacagatcaatggctcttgttttttcatccattcagcctttctgtgccttttgattggggagtttagtccatttacattaagtgttactgttgataagtagggactttctcctgccattttgttatttgttttccgtttgttttgcagtcttctctttcttctttccttccttcctgttttctttttagtacaggtgatttttttctggtggtatgacttaatttcttgctttttattttttctgtatccatcgtatggtttttgatttgagattaccatgaggcttgcacatactatcttatatcccattatattaaactgatgacaacttaacacattgtgtaaacaaacacacaaaaagaaaactaatgaaaactctatacttttactttgtcctctcacttattaactttttgtttctctttatgttttattgtgctatcctggcttgaaagttgttgtatttattattttttgattggttcatcatttagactttctacttaagattagttttgacaccacaatcacagtgttataatattccatgattttctgtgtacttactattaccagtgagttttgtaccttcaggtgatttcttcttgcttattaatatccttttatttcagactgaagagctccctttagcatttcttataggacaggtctggtgttaataaaatccctcagcttttgtttgtctgggaagacctttatttctccttaatgcttgaaggatattttcactggatatactattctagggtaaaagttttgttccttcagcactttaaatatgtcatgccactctctcctggcctttaaggtttccactgaaaagtctgtttccagacttattagaaccccattgtgtgttatttgtttcttttctctttttgcttttatggtatttacccttgacctttgggagtttgactattaaattccttgaggtagtcctctttgcactaagtatgcttggtattatataaccttcttgcacttgaatgttaatatctttctctaggtttgggaagttctctgatatccctttgaataatttttctacccctatcgctttctctacctcccctttaagactaataactcttagatttgccccttcagggttattttctaaatcttgtaggcatgcttcattattttttattcttttttcttttgtctcctctaactgtattttaaaataccctgttttcaggctcaccagttctttcttctggttgatcagttctgctgccaagagactctgatacattcttcagtatgtcaattgtattttttaaatctagaatttctgcttgattttaaaaattaatctctttgttaaatttatctgatagaattctgaattccttttctatattgtcttgaatttgtttgagtttcctcaaaatggctattttgaattctctgtcatgtatctctgtcactccaggattggtccctggtgcctgatgtagttcatttggtgaagtcatgttttcctgtagatgtcctttggtgtctgggcattgaataattatgtatttattgtagtcttcacaatctgggctttacagtctatgcctgtccttcttgggaagcctttccaagtattcaaagggacttgggccccaagcccagtaacactgtgcttcatgcacactcatagagatatcactttggtggtcttggataagatccagaagcattctctggattaccaggaagagactcttgttctcttcctttactttctcccaaacaaacagcatctctctgcctctgtctctgtctctctctctctctctgctgagccacctggagctgggattggggtgatgcaagcacccctatggccaccaacactggaactgccctgggtcagacctgaagccagaatagcactgggtttcacccaagacccactgcagccactatctggttactgcctatgttcactcaaggccctagggctacagtcagcaagagttgaagccatccaggcttatgtccttcccttcaggcttatgttcttcccttcagggaggcaagttctttcaggccctgggcatgtccagagatactttctgagagccagggatttaagtcaaaaaccttagaaatctacctggtattctattaccctgtggctaagctgccactgaaaccatacaacaaaatccttccccctcttccctcccctttccacaggcagaggagctctccccatggccatcatcatcagcagtccgtagagagttctgccaggctaccattgctgatcacttaatgcctaggggctcttcagccagcttgtgaatgctgccaaacctgggattcacccttcagggtagtaggctcccacctctggcccagggaaggtgcagaaatgctgtccgaaagcctaggcctgaactcagggacccctgaagcccactagatactctatccactgtgctgagctgttacccgaagccagcatatctcaaagtctcatccaaggcccatggcatactacctggatatcacttttggttattcagggcccaagggctctttagttagcagataattaatgctgccaggacttggtctttctcttcaaggcagtgggttcccttctggcccagggtgtgtctagaaatgtcacccaggagctaggacctggcatgggggcttcacgactctgcccagtgcactgtctgtggctgagcttgtatccaagatgcaagacaaagtacaaagtcctcttgactggtctctctcctctcctcaagcagaaggaaggagttgctttcattgctacaagctgtgctgcttggggttgagggaggggtagtgcaggtacttccccagctgccccatctggtgtgtcactaggtcacacactgccccagtccactggctctaaccccagaacaccatcagacttgcctaagaatctgagtccttcctagactgcctttcaagttcacttaggaccccacagcaccttagcccatggtggtgagactgctgaaactcaggctccggccactggaataggcacttcccctctggctagggctggtccaaatgctgtctctgtgggtatcagctgagttcaacatggtttcacttcccactgtgacagggcagcactgagttcaatgcaaagtcccccagttgctgtgctctccctccctgaagtgcacagattctctctccgtgccatgcagccactgccagggaatggggaaggggtggtgttggtgatttaaggccatcttttctgccttcttcagtgcctctttcagtgataagaaattaaaaacaagtactgtgatggctcacccaatttttagttcttatgaaggtgcttttttgttcacagataattgtttaaatttagttttcctgtggtagtgggagtagggggatgatcaatgtagccttctattctgccatcttgctctgccctttttgctaagcactcttctactggaataatagtgtctttttagactgaatctgacagtttactcttatattatgacccatccaaaatatgcccagtggattcaaattcatgtagttctatctgttccatgtgttttaagttacacacacacaccgcacaggcacacacacacacacacacacataacctgaatacactttattttcctgacccaaagtaactgccagaggggaagacccatttctgcacatgtttgtatcccacttggtgcttggtaaacactttttggctgaagtataaagatttataaaagcttcttctactctaaataggcctatttccatagccttacaaactcactcatttaatcaacatttactgagcattgctatgttgattaccctaggcaccaggaaccagagacaactaagaatagttttcagtgagctcactgtttaaaaaggcaggcagaagaaatgacatttacaaccatgtaaaaaatgcccaataaaggtgttctgtctacagagctacgtgaaaattgaagggaaacgtttaagtctgcctgggtcactggaaagtgttgcataagatgcagctttggagttgcgtcttaagagatgagtgcaaactgtgtggaaatgagacagaggggtgttctagagtgacaagcgtgtatataaaggcacagatttgggagagtttatcagtcttgtgtggcttgagaacaggatgcactgagtaagtgctggtaggtgagatggaaaggagagattacagctggattgtgaaggctttagggtattggatttatccctacagtcattgagagcatgttggaaggtgtttgaatggggaagtaaaatgtaaggttttagacatataattctggctgcactatggataaggtattagaggaagaaggaattgaagcttgaaaaaccttgttagatggtgattggaataaaatcaacaagagagaatgaagaagcagttgggatagagagtagtaagtggttttgaacaatatgtaggagatttaactgacatatttggcaattgaattgacaggacatgagcaaaaaagaggagtgttttgtatttttgtcctgggaagctaatgaatgagacgacattaattttaaaattaattagaaagaagaagcatattcagaaagtgacttgaaagggagagaaaaatggcttattttagacatacatgtagtttgagagtctataaaggtatcagtaaagaattacagctcagaaaagatctacattaaagttataattgcgtgaatcatcaacacatatgtggtagttgaaaccatggaagatgactaccatgatatctaaaagtatattattgacagtagtccctttaaaaattatttgaaggcttctagtgaagcaaaatcatggtagtagcatagttactattcccaaatccctcattaaaaaacaaaaagcagagcaattaggaatgcagaaggaaaggaaaaacaacagaggtaattttaacaaaagtaatataagtaggtgaggccaaaccacacagtgcagacactgttcagaaatggcagaattagcagctgggcagcgataaaaaagaggagagacagggccaagagttgtggaacacagatgtcacgaataaatagcatgacaagaaaatgatcctactctgagtagaaccctcagcaaataggtctgagaccaatcagccaaattgaggaaggactccagagtgtgattggttccagagtgtgattggatgcaagaaagattgtgcagaaccactaaagggcttaagaagtgcccaagaaaagttgtcagaattataatccaagtggagaaggaacacaagaggtaaaggaaagagatgttcagatccttgggagttggggagtccagagatacaaatcccagaattgtggccaaattgttgcatataatacttccttttaacaccagaggaggaagctcttaacagtgaagataactatcctgaaatattccctcctgcttacactctctttccctaaaagtacagaaaacaatctaattcatttaataagaacatctgcaaacctccaaaaagatacagtaagataaaagtatcaatagcataccaacataatgaaaatttggcctttaaacagatgaaaatatactcagtgttacaaaatgagctaagagaaacaaaaagaaaactgtagaaacaaatcagaaatagaaaattcaagaaatgagatgaataaataacaggagaatgtaaaatgatagctgacggtttagaaaagaatttttaaaactaagggtaaatttctcagaatgtagactaaacactagaagaaactcaagaatgactgggcagagaaagtgtaataagcaaaataaaaggagggaaatgacaagaatcaaagagaaataaaaaaagattcaagtgcagataatatatataaaagacaaggaaataaaattcaatgaatatagagtcccaggaaaagaaaaccaccaaaaatcataacagaacaaaacttaatggctcaaattgccatattgaaagggcactctatatacctgggaaaactgacccagaatggtcaatatcaagacatactcagctgggtgcagtggctcaagcctgtaatcccaacactttgggaggccaaggtgggtggatcacttgaggccaggagttcaagaccagcctggccaacatggtgaaaccctgtctgtactaaaaaatatacaaaaattagctgggcttaatggcacactcctgtaatctcagttactcgggaggctgaggcaggagaatcacttgaacccaggaggcagagtttgcaatgagctgagattgtgccaacagagcaagaatccatctcaaaaaaaggacatattctactaaaagataaaaatatatttgtgcatctatgcaaaagaatcaagtcatttattagggaaagaaaatcaaactgacgctagacttctcaacaataccacttcatactagaaaacagtggagccacatatttaagatactgaaggaaagaaagtgtgagccaaagattttatatcctgccaaactgactttcaagtttaaaggccacaggcaaatagttttgaagatgcaagaactcaatctatattgttcccatgagcaattcctgaggaatccacgagatgtctatagaggaaaccatgacaagctttggcataaagttgctgctttgtgaatgataattaatggcactgattatgacatctcctctctctgtgagttgtggacattctctgatggcatgcttactttaacttagcagacacacagtcacagaagactttgctccagaaaaaagggtttacaaaccatccttccattcaggatggggagaaaaagtcaaatatgtatcattaaaaatgtcttctgagtagccattggcagttatttaaccacttttatatgaacaaaagtaactcacatagtagtttaataaaaagctgacattcatttttattatgtgagaaactcctagatgatgttttgacttgttaaaaaagtgataatatggtaatggtaatttaaaaatatttattcaaaagcttacaaaaagcttttgtctatactgaaaaataataataattagggctttctgttaaaagatgtcactaaaggcatttttaaaaattccattttcctcctttgaaacccaacaaaaaacccactaaaagaatgaaagagaaggaacactgtgtcttcaatgaacaatgaaatggccacaatcccaaactataaattaagaaacacacctgccaaagaccataaaatctggaccagaatgagggggaaggctgagagctgacaaatatttcctcaggcgccgagcagggtatagatttccctaggagtaaatgtggcagtcctgaaaggcctgttctagttctttgatgacagagactagatcctggatcatgaagtacctcggaaaaaaaactgaggatgtcccttgcagaaccatgatgggagacatagctgagggagaaggcatatttttatgcctccttgccaaggaaggctgccagagatgaagtggtatgaaagaaggaggggggaggggcagcaattgttggattattacacagtaagccagttatttaagaggctcttttatttgtctcatcaactattcaaattcgaaaatctgaaaggagatgtgggtagaggaaataagagatttggtgacagaatgttgaagacaacaaatggatgtaaagtctcctagctcgtttctcccacccgtgttactcacaaacagccagctgtattcaaagcaccagcataatatctatgcaccaaaactagggggaaaaatcaaaagggagggaggaagtcatgggatgggggaatggagcataaagcaagagtcacatggataacataagattttccccagagaaaagttgagacagataggttctatacttccaaggaagttatagtcttgatgtctagggaaaaagtggctttaaagtgaggtttgagttcaaaaaagagactataagacaacagaaggagatggaaagacaactgcaacagtcaggaaaaaagaaaaatttttaaatggcagatacaaaaatagcaaacacaaaacttacattacaagcaacaacttaagaaaataaaggaaatgactggaaataaagggagatgggatacagactggaataagtcatataaaattatatggaaaagaacaaagatgtaaaattggtttttagtggccataagggatatggaagacggacaaaggagatcaaacataaacacaattggtatttgttgagaagaacaaaacacatggaacagaaaagtattcagagacaaaataaggggaattaattccctttaataaaagcttttatctgcaagtcataatagcacagcatgcgccactaagcctgtgtaagatgctgaacctcgtggataaagcaaaaccccctttgaacagaaagtcaaccaaataaactaaaaattctcatcttcataggagcattcaatgcaagaggacaatggagcaggatctacacaattctaaagaaaagcaagcatgactcaaggatttcctcttcatcctgtgttcttcatgtagagagacagcagagaggcagtcagagaatactgtctgataagcccttgaaaaagctgtagggccaagatgagatacagagatgactcaaaacagagaatccaggaatgcatagatcctggtaaaaaaggtgggagatgagtaataaattcatttgtgtaggattaagactaatcaactaacaattatattatagaacataacataaatatcagaaatcttgacattatctaaataataaaatgaaaactaattgagatttggagagatgaggtagatgatatagtttggctgtgtccccacccaaatctcatcttgaattgtagttcccataattcccatgtgttgtgggagggactcagttggagataattgaatcatgggggcagtttccctcatactgttctcgtggtggtaaatgagtctcacgagatctgatggttttataaggggtttcccttttcgcttggctctcattctctcttgcctgctgccatgtaagacgtccctttgcccttcctttgtcttctgccatgattgtgaggcttccctagccacgtggaactgagtctattaaacctctttcctttataacttacccagtcttgggtatgtctttattaacaacataagattggactaatacagtagaggaaatgtaagtgtgcttatttcctcatccttcttagtagcaagtcaataaatactctcctaagtcaaattgtcattaaaaataactatccaaatctcttgttggtttatttaatcttctttattaactttagagtgttctttcgggaattaatcatggtttaaaaaatatcaaacattcaacaactctaattttactttaatgtctttttttctaatatatctaataaaattgcattaaatttttaagttgaaattgcatgtatacacactgattattactattcatgttactctatatatggcagtttgggtgattttttaaaaactttcctttttatacatttgtatttcttggatacttggtaatgagtatcataaaatcaaaatcagccatggctggcaagatggccaaataggaacagctctggtctgcagctcccagtgagatcaacacagaaggcaggtgatttctgtatgtccaacagaggtactggctcatctcattgggactggttagacagagggtgcagcccatggagggccagctgaagcatggtggggtgtctccttacctgggaagtgcaagaggtcagggaactccctcccctagccaagggaagccgtgagggactgtgctgtgaggaatggtgcaatctagcccaggtactacacttttcccatggtctttacaacccacaaaccaggagattcccccgggtgcctacaccaccagggcccatgggtttcaagcacgaaactggacagccatttgggcagacatcaagctagctgcaggaggtttttttcatacctcagtggtgcctgtaacaccagtgagacagaaccgttcacttccctggaaagggggctgaagccaggcctagctcagcagatcccacccccacagagcccagcaagctaagatctactggcttgaaattctcgctgccagtacagcagtgcgaagttgacctgggatgctccagcttggtgggggaaggggcgtccaccattactgaggcttgagtaggcagcttacccctcacagtgtaaacaaagcctctgggaagttcaaactgggtggagcccaccacagcttggcaaagccactgtagccagactgcttctctagattcctcccttctggcagggcatctctgaaagcaaggcagcagccacagtcagggtcttatagataaaactcccatctccctgggacagagtacctgggggaaggggcagctgtgggtgcagcttcagcagacttaaatgttcctgcctgctggctctgaagagagcagcagatctcccagcacagtgctcaagctctgctaagggatagactgtctcctcaagtgggtccctgacccctgcacctcctgatggggagacacctctcagtaggggctgacagacacttcatacaggagagttctggctggcatctggcaggtgcccctctgggatgaagcttccagaggaaggaacaggcagcaatctttgctgttctgcagcatctgctggtgatactcaggcaaaccaggcctggagtggacatccagcaaactccagcagacctgcagcagaggagcctgactattagaaggaaaattaacaaacagagaggaataacatcaacatcaacaaaaaggatgtccacacagaaaccccggaaaccccacttgaaggtcatcaaaagaccatcaaagaccagaggtagataaattcacaaagatgtggaaaaaccagcacaaaaaggctgaaaattccaaaaaccagaacacctcttcacctgcaaagtgtcacaactccttgccagcaagggaacaaaactggacagagaaggaatttgacaaattgacagaagtaggcttcagaaggtcagtaataacaaactcctccaagttaaaggagcatgttctaacccaatgcaaggaagctaagaaccttgaaaaagggttagaggaattgctaactagaataaccagtttagagaagaacaaaaatgacctaatggagctgaaaaaaacagcacgagaacttcatgaagcatacacaagtatcaatagccaaattgctcaagcagaacaaggatatcagagattgaagatgaacttaatgaaataagcatgaagagaagattagagaaaaaagaatgaaaaggaaaaaacaaagcctccaagaaatatgggactatgtggaaagaccaaacctacgtttgtttggtgtacctgaaagtgaggggagaatggaaccaagttggaaaacactcttcaggatattatcaaggagaacttctccaacatagcaagaaaggccaacattcaaattcaggaaatacagagaataccacaaagatactcctctagaagaacaaccccaagacacataatcgtcagatttaccatgattgaaatgaaggaaaaaatgttaagggcagccagagagaaagattgggttacccacaaagggaagcccatcagactaacagtggatctctctgcagaaaccctacaagccagaatagaatggggccaatattcaacattcttaaagaaaagaattttcaacccagaatttcatatccagccaacctaagcttcataagcgaaggagaaataaaatcctttacaggcaagcaaatgctgagagattttgtcaccaccaggcctgccttacaagagctcctgaaggaagcactaaacatggaaaggaacaaccggtaccagccactgcaaaaacataccaaattgtaaagactgtcaacactatgaagaaactgcatcaactaacagtcaaaataaccagctagcatcatcatgacaggattaaattcacacataacaatgttaacattaaatgtaaatgggctaaatgccccaattaaaagacagagactggcaaattggatcaagagttaagacccataggtgtgctgtattcaggagacccatctcatgtgcaaagacacacataagctcaaaataaagggatggaggaatatttaccaagcaaatggaaagcaaaaaaaaaaaaaaaaaaagcaggggttgcagtcctagtctctgataaaacagactttaaaccaacaaagatcaaaaaatacaaagaagggtattacataatggtaaagagatcaatgcaacaagaagagctaactgtcctaaatatacatgcacccaatacaggagcacccagattcataaagcaagttcttagagacctacaaagagacttggactcccacacaataatagtgggagactttaacaccctactgtcaacattagacagatcaacagacagaaaattaacaaggatattcaggacttgaactcagctctggaccaagtggacctaatagacgtctacagaactctccaccccaaatcaacagaatatacattcttctcagcaccatatcacacttattctgaaattgaccacatacttggaagtaaaacactcctcagcaaatacaaaagagtggaaattttaacaaacagtctctcagaccacagtgcagtcaaattagaactcacgattaagacactcactcaaaactgcacaactacatggaaactgaagaacctgctcctgaatgactactgggtgaataacaaaattaaggcagaaataaatacgttatttgaaaccaataagaacaaagacacaatgtaccagaatctctgggacacagctaaagcagtgtttagagagaaatttatagcactaaatggccataggagaaagcagaaaagtctaaaattgacaccctaacatcacaattaaaagaactagagaagcaagagcaaacaaattcaaaagctagcagaagacaagaaataactaagatcagagcagaactgagagagatagagacatgaaaaactcttcaaaaatatcaatgaatcccagagctggtattttgaaaagattcgcaaaatacatagacagctagccagactaataaagaagaaaagaggacacaatcaaatagacacaataaaaaatgataaaatcaccattgatcccacagaaatacaaactatcatcagagaatactataaacacctctacgcaaataagctagaaaatttagaagaaatggataaattcctggacacatacaccctcccaagactaaaccaggaagaagtcaaattcctgaatagaccaataacaagttctgaaattgagacagtaattaatagcctaccaaccacaaaaagcccaggatcagacagattcacagctgaattccaccagaggtacaaagaggagcttggtaccattccttctgaaactattccaaacaatagaaaaagaaggactcctccctaactcattttatgaggacagcatcatcctgataccaaaacctggcagaaacacaacaaaaaaaaagaaaatttcaggccaatatccctgatgaacatcaatgcgaaaatcttcaataaaatattggcaaactgaatccagcagcacatcaaaaagattatccaccacgatcaagtcagcttcctccctgggatgcaaggctggttcaacatacgaaaatcaataaacataatccatcacataaacagaaccaattacaaaaaccacatgattatctcaatagatgcagaaaaggcctttgataaaattcaacaccccttcatgctaaaaactctcaataaactaggtattgatgaaatgtatctcaaaataataagagctatttatgacaaacccacagccaatatactgaatgggcaaaagctggaagcattccctttgaaaactggcacaggacaaggatgccctctctcaccactcttatttaacatagtattggaaattctggccagggcaaccaggcaagagaaagtaataaatggtattcaaataggaagagaggaagtcaaattgtctctgtttgcagatgacataattatatatttagaaaaccccatcatcttagcccaaaatctccttatgctgataagcaacttcagcaaagtctcaggatacaaaatcaatgtgcaaaaatcacaagcattcctatacaacaataatagacaaacagaaagtcaaatcatgagtgagctcccattcacaattgctacaaagagaataaagtacctaggaatacagcttacaaggatgtgaaggacctcttcaaggagaactacatacaaaccactgctcaaggaaataagagaggacacaaacaaatggaaaaacattccatgttcatggatatgaagaatcaatattgtgaaaatggccatactgctgaaagtaatttatagattcaatggtatctccatcaagctacctttgactttcttcacagaattagaaaaaagtactttaaatttcatatggaaccaaaaaagagcctgtatagccaagaaaatcctaagcaaaaagaacaaagctggaggcatcatgctacctgacttcaaactatactacaaggctacagaaaccaaaacagtatggtactggtaccaaaacagatatatagaccaatggaacagaacagaggcctcagaaatcatgccacacatctacaaccatctgatctttgacaaacatgacagaaacaagcaatggggaaaagattccctatttaataaatggtattgggataactggctatccatatgcggaaaactgaaactggaccccttccttacaccttatacaaaaattaactcaagatgtattaaagacttaaacataagacctaaaaccataaaaaccctataagaaaaactaggcagtgccattcaggacatagacatgggcaaagacttcatgactaaaataccaaaaacaatggcaacaaaagccaaaattgacaaatgggatctaattaaactgaagagcttctgcacagcaaaagaaactatcatcagactaacaggcaacctacagaatgggagaaaaattttgcaatctatccatctgtcaaagggctaatatccagaatctacaaggaacttaaacaaatttacaagaaaaaaccccatcaaaaagtgggtgaaggatatgaacagatacttctccaaaggagacatttatgcggccaacaaacatatggaaaaaagctcattagagaaatgcaaatcaaaaccacaatgagataccatctcacaccagttagaatggcgatcattaagaagccaggaaacaacagatgctggagaggatatggagaaataggaatgcttttacactgttggtgggagtgtaaattagttcaaccattgtggaagtcagtgtggcaattcctcaaggatctagaatcagaaataccatttgatccagcaatcccataactgggtatatacccaaaggattggaaatcattctactatgacacatgcacacatatgtttattgcaacactgttcacaatagcaaagacttggaaccaacccaaatgcccatcaataatagactggataaagaaaatgtggaacaccatggagtactatgcagccacaaaaaaggatgagttcatgtcctttgtcgggacatggatggaactggagaccatcattctcagcaaactaacacaggaacagaaaaccaaacactgcacgttctcactcttaagtgggagttgaacaatgagaacacatggacgcaggaaggggaacatcacacactggggcctgtcagggggtggggggctagggaagggatagcattagaagaaatacctaatgtagatgacgggttgatgggtgcagcaaaccaccatggcacatgtggacctgtataacaaacctgcacattctacacatgtatcccagaacttaaagtataataattttaaaaaggccggccgtggcttctcacgcctataatcccagcactttgggaggccgaggcaggtggatcacgaggtcaggagtttgagaccagcctggccaagatgataaaaccccatctctactaaaaatacaaaaagtagcagggtgcagtggtgggcgcctgaaatcccagctacttgggaggctgaggcaggagaatcgcttgaatctgagaggcagagattccagtgagctgagatcatgccactgcactctatctagcctgggtgacagagcaagaatccatctcaaaaaacaaacaaacaaacaatggacatgcccataggcagatgaatggataaagaaaatatggtactgtatatacatacaatgaaatattttacagccttaaaaatgtaggaaactctgccatttgttgcaagatggatgaacctagaggacattatgctaagtgaaataagccagttagggaaaaacaaatgttgcatgattccattacataaggtatctaaaattgtcaaactcatagaagcatagaatacaatagtggtttccccatactgggggaatggggaaaatggggagttgttaaatggttataaagtttcaattatactagctgaataagttctagagatctgcggaaaaacatagtgcctataggcacagttaacaatagatagtgtgcaattcaaaatttattaagaaggtagatcttatgtgaagtgttctagtcataaataaacaaaacaaaacaaacaggcaacaaaaaacaaaagggaacttcggaaagtgttggatatgtctgttactccgattgtggtaatggtgtcatatggtgtttgcattaagcccaaacccatcacattgtacacattagacatgtgtagttctttgtatatcaattatacctcaacaaaactattaaaagggtcaaattttaaaaatgaaaataaaaaatgaatggctaaaaaataaattagatattaattgcaatgccaaaaaaatcccacgataataaattactggaaattactatctccaaaagaaagagtgagatggaaggagggggagggcggtagagaggacatgactgaaggaaaaagagaaagaaagaaaggaagagaagggaggggagggaaggggaggagaggaggaagaaactctccatgacataaaagatgttcaagcctaggaaatggctttcttcttggcacatccgtactgaaaatttcctcttgtttcacccttggagactttgctgttgttggctgggtctgcctgctcatgctccatttgactctgttgcacaactctcatttcagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtagtaagtatgcggtgtccgcgcttcaccaagatatgctgattctgttcattttgtcccgatgtctttattttccatacgtcaacagatttctaatctgtgggtaaggcaactcaagctgtactcagtgttgttttcggcagcgatcagtagaacgtggaagaccaagatatagttctaagaaaagtctgttttaagaaatgtccgcccacttaacaaatgcatcttttaggcttcctcatttggatttatgtcctctactttaccataattccttctgcttagagttcaggagtgttccatgtagaagttaagccaaaatacctcctggttcactttgctaggattgcatttggacttaattaaaagtagaagagctacgtatttttaagcattcaagtattttttcttgtgtataatctaaaattggcaaggataaaaacatgaaagaactttgatttaaaaatggcagtttgtacacctcaattaattatgaataatgagcttactataaagagttcatattatggcttcattatagccaaagctaatatgcatgtagcattcatctgtattttcagtgtacatgatagaatatatttttacacatgaatatgtatgtttcatataagagttatgtgggccaggcgcagtggctcacgcctgtaatcctagcactttgagagactgaggtgggtggatcatgaggtcaggagatcaagaccatcctggctaacatggttaaaccccgtctctactaaaaatacaaaaaattagccgggcttggtggcacactcctgtagtcccagctactcgagaggctgaggcaggagaatcacttgaacctgggaggcggaggttgcagtgagtcgagatcgcaccattgcactccagcctgggcgacagagtgtgagactctgtctcaaaaaaaaaaaaaaaaaaagaaagaaagaaaaaaagagttgtgtgttaaaacatgtaagccgagggcggccatgacagccatgacagcaattgaaaagcaggcagcagagtggtggtgaggaggttgggaagggaggtagggaacaggcatagtggaaataacagctttggagttcatttaccactttttcactatctttaattactcacctgtgaaataacatttattatatcagttaccctcctgaacgtttggtaaggaaaaaaattaaaaatgaactattcttattttaatgctgcttaggagaggaaaacatatatatatatatgtcttttatatatatgttttatatatatgttatatatatatgatatataacatatatataaaacttcaatttaccaacacctttcctggagaaactcacaaaacaaaataagacaaataattaagttttttttaagtagtgacatttattgagcaattactatgtggagttctttgcatgcattatctcatttagtcccctgaacaacattgtgaggcagatactatctccatctggagatgagaaacccaagccatagaaaaggcatgagacttgcctaaggctccctggctgccagctgaactgcttgaccacaagtctgtctgattctttagcccacgtttttagctgcctctctatgctgattcatggacaacattaacatttttttcctgaggaacacatttccaaaatcttgagtccaaaaacttgagattccaagttgtaaagtctcctggaattcaggagtgtctgtagcatatggcgtactatcatgcttcgttcaagttgcctctctatctgatttttattaattgcggatggttgcatagcagtgtggctagactgtaaaaactgccttagaggagagtgaaattaaagtgatactggcagcttcctctaaaataataacagaatagcatgtggaaatacaacgtggttattatggcatccaatgtggtacaagatgaaattataaattattttggcatgcattgaggagcagagaaaattacaagttgtagggagaaagaaaaaacacaagaaaaaaagacagtaatattttttctttactccaccccactcctgcctgccaaacatgtaggtcatgaaggtagacaagagacaggaatgcatgctcccagcacagccaacgcaccctgagttgggcccccacttcagctgtagcctcgcctcactccataatctttgatcactagcccttgcttgctgaaatgtaggttctgcttctacactttcacatagcatcctcttcaccaccatatgacagagcaagagatgaggttggcattctcttatcctctctacaccgtttccctgctgtcttcacacacttagcacgtagattgccccgtctcataccttcaaaggcaccatgtgcagaccctacaagacactcttcacccttcttcaggacacaccaccaccaggaccatgatttctctccaacgtttcctaacatccaagacaaccaatatctgtgatgatgacctttctaacacctgatatcccaatttcccaacctcatcaattccactgaccccatcaccttggcatggtaaccccttagacttcctcactacttggcactcagaattagcttcttgttctgccttaccctcaactcactcctgcttatttagttagtgcctcaccatgacctctggttcttccatatctccttattatccccagtttctgctcttgcactagaaaccttagccggcattccttaggtctccacttaaccaactctatcgccaaatctttatacctttcattaacctcctgtactgacccctgctcagcttcaaccctggtattacctttcaagtgatttgtttgttggtgggttggttccctagcctgagccaccaggatttcctaaagaaaataatatcaccgtgctaatttgatatgtttcatatttatgctattttagaggggcaataatggctttgtgccctattttctaagaatgccctagaaattcaccatagcaactatttcctaactactgtactgacccatttctctatcaatgaacttgtctttcattccattaggaatatcaaggctaaagtggcataatgtcgtgattttcctctctgtttcacctcaaatctaccccctctcctcctcagattagaaatgtatgatctactccatccattatggaagggggtccgtagacaagaaaatcaggcccagtagtgctgtgaactttattttctaccaaggtttcaattctagaaaatgtggcctaatcggtgccttgggtttaagtaaaacccatcctctttggaggggtaatttttcttggctctgacccttttggtgtgcagcaggtccaagtcaggtgggaaagatgtcttctgctccccctagaggccaacagcataccctatagtccaatgacacccaccgcctgcttctccccaaacaatccctgcacagtccccttgttcaaattctttctgtccccatagctagtgactgaagttcttcctgctcctgaagggtcaacacaaaccctaccttccccagtaagctttctcagtcgcacttaatgtctgaaggataatatgacattgtggttgagctaactcacctgagttcaaatcctagttcttccagtacctcatcatgtgacactgagcaagttatttaacctatgtgggtctcagttttctcatctgtaaaatgagaatagtctttatacctacctcacgggaccattctgagaatcatgaattaatacctataaagtgcttcgaatcaatgccaggcacacactaaaagctcaaaaatattgattatttttaaggtctttttatctcatttctattatagatttaacacaggataaaatgtaataagtaagttgtgttgtatattctggcctattagggtatgagcttgtatggggtaggtacacagcacctctggatattctgttttgtctttttctatataatcccccaacatgtttatcagaatgaattgtattcatggacattctttttaaatatgttagatgtggttcattctcaaagtgctgttagaaatctacctatcttggtttccaatcaggcatctgtagaaaagaaggataacagaaatatgtagtgtttgattttagattttttaaattatgacttttagggttcctgagctttggtaaagaagaatttttatttttccccaaagtactgagatcaggatggattagggaagaggaacccaggcatgccctattttattgaaatgtcaagaaaaatatgcctcagccccttcccagggctatctcaaatctactctcatctctcccgcctgtggtctctctccttgtactggcacacagcctgcgtctttttttttttttttttttttttgagacggagtctcgctctcgcctaggctggagtgcagtggcgcgatctcagctcactgcaagctctgcctcccgggttcacgccattctcctgcctcagcctcctgagtagctgggactacaggcacctgctaccatgcccggctaatttttttgtatttttagtagagacggggtttcaccatgttagccaggatggtcttgatctcctgaccttgtgatccacccaccttggcctcccaaagtgctgggattacaggcgtgagccactgcacctggccagcctgcgtctttagttctccagcctcctacacacctcttggactttaccattagaatatggtctcccctgctctaactcctcctctagctttgctagttctggctgcttccagtaacacccatccctgcttgtcatagctacagtcgtagagacccagccaggcagaggcctacctcaccagcaccctcttgggctggcggcacttcctgcagggtcccaggacgtacgtgttactttttcttttactcattcattgccttaattcattcaacaaacagaaggcagtggtcagtgacactgggtggttagaggtcaggaagaaattcacagaggaggaactcttgagcagacttctgaatgacatgtctgttcatcgggcccacatgtgggtagatacagaagaatgtgaggaaggagagcagtgtggataaaagtagggggtgtcaaatggagtggtaagtttgggggaacttcagcagattccataggactagaacataggttcaagagagagcttgcaaagttagctatagagactcttgaactccatgtgaaggagttaaaattgtatccaagaaggaagtgacttggtcaggttttattttagttcatttactctaagagctatatagatatattggggaaatatgagagtatggctgggagtctagtgaaggggatatgacaatatcttggtgagagagcatgagagtagaagcaatggggatgaattctaatgatgtttcacatgtgtcctctaaattcccgatgcctgatgagagttgggagctataggacagagacggtggtgggtttgtgaatattgaacagctggcttcggtagtagggtggtgagtggggagaggtagctatcatttgttgtggtcgcctatttccatagtgtaaatactcccattgtagctgttttccagctaccaatgtgatgtcattgaatgcagagttgggaatagttgctagcagtctcattgacttgtgtttcagggagaggcagggccagcacaccactggacaggaggaaatctagatcagtggtctacagccattttggcaccagggaccagtttcatggaagacagtttttccacggaccagtcgtaggggatggttttgggatgattctagcacattaaatgtattgtgtactttctttatattattattacattgtaatgtgtaatggaatagttatataactcaccatgatgtagaatcagtgagagtcctgagcttgttttcctgcaactagatggtcccatccggggttgatgagagacagagacacatcattaggcattagattctcataaggagcccgcaacctagatccctcacgtgcacagttcacagtagggtttgtgttcctatgagaatctaatgccaccactcatctgacaggaggcggagttcaggcagtaatggcagtgatggggaacggctgtaaatacagatgaagcttcgctcactggccttactcacctcctgctgtgaggcctgattcctaacagggggttcggtggttggggacccatgatctagatgattccctggtttctggcttgagtaaattggcagaagttgacgccattaacttggggaatataagaagaggagaataattgggatgggatagggtagggggcatataacatgttgagatcaggggtccccaacccccaagccatggacggatactggtccatagcctgttgggaactgagctgcacaataggaggtgagcgggaggcaagcaggcattaccacctgagctctgccttctgtcagatcagcagcggcattagcttctcatgggaacacaaaccctattgtgaactgcgcatgcgagggatctaggttgcagctccttatgaaaatctaatgcctgatgatctgaggtggaacagtttcatcccaaaaccatctagcccccaatccccaccccgacaactggtttgtggaaaaactgttttctatgaaaccagtacctggtgccagaaaggttggggactgctggtttagattatgatcatttaaacttgagggacctggaagagatttccagtaagaagtggataattaggtctgaagttccagaaagagatctaggctagacagataaacttgaaggcattaacctagagttgttagttaaaactacaaaatcatccaaggaaaagcatagagcaagagagatagtggctgtgcattggcacctgaggggtagaaacagccagctgggtactggcaatggtggtcagaaaggaccagaaaaaaaaaggtaaaaaaaaaatcttggggaggagagacttcttcatgaagtgagtgattaaagttaccacatgccctaagacggtcaagtaagaatactgaagagaaggcactgaatttgtcactagggggcccttggttgtctcttccaagtaacatttaatgtggtgttgggagcagaagccagactgaaattggtggaagagtaacacagaagcaacctgaatttactgtagccgggcctccatgggcctcaggggcctccactgctcatttcagaatccacccacagcatccctggtggcctcctctcagcccactgtgttcagagaagcctgaagagaatccaaagtatctgcccaggttcttggtacagcttcaaatgagcttctcagatctttactcctattgggaggagtggaaaccagcaccagcccagcagccatattcagggctggttcctgagaggccagggttccagcagggtaataggaaggtattgatgctgtgtcatggccagagcaaatgctgccaagaccatgcagaaatatccagccagatggcttggggtagaaacctggcctggcaccaggacttgaagccatgccagggatatgactggagtaaaggcaggacccagtaagcaaggagctgaggtcattgccatagatggccttgggcacccagaactggccttgactgggtgtggcagactgcacaaagacccagagagaggagttacagaagaaagctcatttcattttctagaatgtggcatttctcacatttagcacagtgggagaggtggagggatgggttaatgctcttgcacagcccagcagccccttcaggagggtgctgcagttggtacctggccactgtctgcagagtgcatgatgcccctgcctaatcaggcttggccagtgttgctgttttggggcatctccagatgagagaggaaggtcaccccaaaccagaccggtttcttgcccaagaactatgtttgatgatgccacgttccaggcattgctctcaaggaactcacaggagccccaagaaaggaagtggctcaaactgtggaacctggcagcctggcagagcccatgaattccgatctctggctggaatccccgtttactccccaggcacacctgccagtcaaaatgccccataccccagtgtgagcaatggccaaagcagagttgggaaagggaccatctggggccacaaggcctgccttccagtaaatgggcatgcagccacagggagcagctgggcttcttctgtgttcaccccaccatttgggcaggctcttcaccaaggctatgccctgcccaccacctgaggcttcatggcctcccttagaaggagtcagaatcccatcaactttaagccccaagctcagctgagggacatgtggtaccagtggaaatgagcatcactggaacccactttcctgctggtcccagggcaccaggatgctttgtgggtttcatgttagaatcaggtcatccccagcttgagctgtttagccagacgtttccccatgtgtgcttccgcaccatcccagtgagagcaagaacattcaagcttccacccgatctgtagcagccactgctaccttgaaacaatcgatctccacatattccttagttgtattaattcaaaagtttgactgaacacagtttatgctctgcttgcaaagaagtgagttacaaaaccatccatgtgcacatccatcttttatattgtccaccactgaaaggcccatagccagacagtgtccacctggatctttttaaataaaaatgatacttacacgggtaggcataccttgccttgttacaataggctacttctaagtattcataacatgcaatccaattagtaaaaatagaagcaggtgagtaataaaaaaaggagaacaaacaacgttaatatgtgattgtgtcttgaattttatattccttttacatgtaggcactaatttggctccaaacttgctttaacagccatcttgaaaaaggcaaccttgccaattgcagtttaggaattcattagataggaaatgagctaattactcagagtaaagtataatgatttctgatgctaaaaccagaaagaaatcctcccatgatcctcttgcagaagacactggatattgtgaagactagaatgtgctcatagacaacacagatgctgcttcctattttcccttccctcttgaccagcagcttcctgtcaaattgtctttcagtgaaagaaactgggtcaggaatgcctttctctagtgctttggcttaattcatggtacatgctggggtaatggtcctcgaactttgctgcacatttcagtcaactggggaactttaaaaaattctgatgtcctggctgcaccccgtaagtcagaatttctggggatgggacccaggatactgagattagtgaatactaacaataacaggtgattctaacaaatagcaaaatttgagagccattttttttagagcatctgtggtcagagttgatattgaacctgcacataccagtatggacatggtcagaaatatggtcagaaaaaaaagaattagtaaacagcctctgctggaaccccatgagcatttctcacctgctcaggccactctgccagtaaccgcctgacttgtccataatcgaacaactatggggttaacacttcgtaccatagtaggcctccaagaccctattccagtgctatggccagacacattctgttgattgagcccttgctgtgaagatttagtattttgaacaccatctatattatctatagtaatggattgactataaatttaccagggagtcttccatacatgtttttcagcttttgattgttgaacagtagaaagttcaaaattgtattctagccaaattaggggaaatttacatggcttaactggctgggccatttgacatactttgtagatactctgtctcccaaaaagtaaaagtatgtatgtggcagttcatccagctccacttagagatgatgtgacagagcattttcaagcagaaccctggacccatcctgagatcaataggcctgacctaccaattgcatctgtatggaatttgtatacaaacaaattatgtatgtccttcactgagaacattctctaccacagaaattatgggttcacctccattgtttccctgaacctgttgacaccacgaaaccccagtaggcagccagacttcaaagggctcatgaggcgtgcaagaggacttcagttattctcagttctcagggtaccagtaaacacactgtagccagcgccaagggcctgagaaggctatgaaagagaagtctcaatctgcttcttctcccagcgtgtgctacaacaaggaggacctgtaactggggtcccccaaggtaaattaggtccccattgcatgaccttctaaatccagaggtattcttgatgttagtccagtatctcttctgccactcactagtgcttccaagccatccatcctacactccacaatctgctcaggaacctaaatacatcatcaaagaggatccagacttccacccatatcactgtccttctcccatgcctacctcagaatcaccccagaacacattgagccttctctcaggtgaaacaagggagagaaatacttctcttggggacaggatctgagaagtattgtctttgggcctagcccattaagaggagccgatcgatgcccaggaacaagtcaaagccaaccccatctctgttccctcttagtcttccctgctgtgcattggctgcacctgcccttgtcaccagatcagtggtggcagcagttatatatgagagctcattatgtgcccgctactgtgctgtgcacttgatataaacaatctgacttaatttttacttccctcccattgaaagcactaacattattcacatttcacaggtgaggaaactgaggctcagagagatgaaagaatttgtccaagtggcagagctaagattcaaactcaggtttatctgacttcaaactgcctatgccacctgttcttttttgatcacggctacccattgcttcttcagacccccatgccaatttaatcgacatatttgggttatattctgcagctggccaacctcagcctcctttcagacccttcaaatacatttgctcacattcccactctcacttcctccctcagatttggggtacccatggctctaagccagagggcctctctgccagatagtagagacctgacatatcagacccttattgatggaaacatgtacccagaggctgggtatttatggagccattatatgagcatggcctagaacaaatattcctcaaatctagaaataactattccctacatttcaccaaatcatttaacctcatgcctccccaaaccagggttttatcaaatcacttacacattttcatgcacctcattcacacttgcattctttgccactaaagtactagatagttgtgaaatttaccccaatctgtggatgtataatgttattcatggttttattcttgaatgttttaaaatagtaaaaaagatacgtttgttagcctgtatcagccttgaaagattactgtcaaaaagtctgtatttttgagatgtttattcgtattttcttttctttctttttttttttcttggagaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaagtaagtaaaataaaaatgcagtattcatttttgcactaccttcttaatggctattccagttttcttgaaaatattttcaaattcctctcctaagcatgtgtttccaacaggattctttaggaaagaaactaaaaaatgttaagatgtgtttttcacatatacgttggaatttttaaattcaaccgccatatcatcccaatcactgtcgtagaggtgtgatatgactggatccagcaagaataagtttaagcatatatacactccccctttactcagcacttggcatttaaaaataaaatcaatataaggccattttaaaagtaagcttattaatagtaatcctacattatgttggaactgcaaatcagaatttacagagctcttccatgtctaggagatgtggtatcttatttgagctcacatcagccccatgagattggcagggcaggggttaacctttctgatgaggtaattgagaagcagaatcccatgactacttcatggccaatcagaaccaagggccgtatctcttgaatacccaccagtggtatttgagtatcacacaaatacgtagccttgtcaaaagcttgggtatctgaagtagttttctattatcatgcaatttttaaatgtcatacaatccaaaaataagaatcatagtgttttgagatgttcaaaacacagtattaagtcacatattattctgatctctatgccagtgtaaaaatgtcacatttcctttattttacataacagatactaatttacttttgcattctttattgccttcaaatcttgctgtttgtatacaaagtactatagacattgtgccttcttttgattcacatgtaagagctccagctctaccttatctgcctttagagatcgttaagagacacaaataacacagcagatgtgaaactgttttgcatatcacaaggtactttcaaaatgcaagttttacttttatcatgtcctttgtgcattgagcctcgtatgtgaaacatcagaaaaaacttaggtaaaattcagttttttaaaataataaactattaggctatatcttaaaaaggtagaaaaaatctaatttttgaatttttaatgctagaactatgaacacaagagtacaatgaaattttagaagtagaataaaccttaaaacatagcagttctcagagcttttggttttagactctttaaaatttaaaaatgattgaggagcctaaagagcttttgtaaatgtgagttgtatctattgctgtttacctcactagaaattaaaaccaagaaacattgaaaatatctccattaatctatttagaaaaaataatgggcctataacatgttcatacaaataacatattttttgaaaaccctccccctgccaccaaaattactgataacagtggaattgctttccatctttgcagatctctttaatgtctggtataataaaagaagacagctggattctttttccacatctgttgtgaaatgttgttttagttaaagtatatggagaaaataaatgtgtgctatacaaatgtgttagctggaagagaaagaatattttaatatcttttcagataattgtggatactctttaattctacactaaaactagacaaagggtcatttctcaaaggttagttgaaatgtgcaatctgaaactatattaatgaaatgttggtactctgtttaatgaaatctgctgtttttttcttgcattttgaatagactttttacccatacaagattttttaacaccatacattggtcatttggaaaatattggctcactgagtgatacaggccttccaaatgttggtgcatttcattatgcaatgtaaaaaaaatacacatttaaaaaaatcaccgtgtatctcataaaaaaaaaagtctttaagttttgggaagctgtcagacttacagtggtggataccagttttccaaaattctaattttcacatcaaacctttttcatcattggcaacaaatactgtcagttgtgtcattgaattggccagctcatttaaaaaatatatatatatatatctaccaaatacccaactttaaatcatagtgtggacttttttgtcatagtttattggtcattctttcaagtaaaaatcatattccatgaaagaagccaccagttcttcagcatgcagtggaagtgctttgtgtgtacttcccattgtgtcgtatgggatatgaaaaacgtatggacccaagggtcaagatttagtaagattaataccttttactacttcattaaagacatttctttttttttcttttctttattgagacagtctcgctttgtcacccaggctggagtgcagtggtggcatctcagcttactgcaacctctgcctcctcgtttcaagtgattctcctgcttcagcctcccaagtaactgggattacaggtgaacaccaccacccccagctaattgtatttttagtagagatagggtttcaccatgttggccaggttggtcttgaactcctgacctcaagtgatccacccacctcggcctcccaaagtgctgggattacaggcatgagtcgccacgcctggccgttaaggacattcttaagggaaactggcattttttttttttctgcaagtaaaacatagtagtcaagaatacagtaattactggtacacttcaatatcactgtcttggttcatgctaaggtgccagcagtcttaccaacactgcctttgcactctcagtgcaaaggtcaataccgtttttaaaaaggctaattaatggcttcgtattattataaaactagctttgacttcatagacttctggggggttcatggactatgctttgaagactgctaacttggttcaataatccattttataaattgtaaggaaagagaggctgacaaggttgaagtgatctgttgacctatggccatataagtactacaatgatatagaggagcctggtcagtttaaataaatatttatttgagttcattttaaatagattgacttgatggaatggcgttaacataagtttatcaggctgagacccctggagcttgtataaagaagttttgacatggtacatcctccttagatgtgtttctgcatcctttaaagatcagccattcaaaacagaagcaatttcatatgtctaataaaaggttttgtttttaatttttaagataataagatccattttcatttctatttttcctccaaaacctacccaattaatttgttcaatttatgtttaattccctttacataacaaatgttctcatctttaaatatactttctgaatcttacaaatcttttcagttgaagtaattgagaaatggaattatgttcctgaaagcctcattcaatgagagaaactgtgtaggcatggagtactgttcggatgacaattgagtaagaaatctcaactaggaagagaagtttgtgggtgtatcaattagagatggtgcctatagaaagatcaactttgttattacttcaagttaagagtaagattacgcagcagaggccaaggtcatatgtgttacagaattcaacctggtggttctccagcccaaggacagatccaggctaggtacccagtggccccacctgtcatgtaaggttcacgcatgctcagctatttctgatctcaatgatttctcactggactgttacctgaaacctacaaaacaaaggcattatttgagaattcctaaatcatgcaaacatatatatgaaataatttaagaaaatgatttaatatgtttatttttcatgtgtagtcactggttagacttttgcttttaaccaactatttctcctccatcaggatttgacactgaaaatcttgccttactaacagcgaggtctgccatactcttgttgctctgagacactttcgctgttttgacttctgccagcttttgtatatttcttatgtgtgctgcagcagggcttgtatgctcttggtactattgctctgtgccattatttcatactattctaatcattcatacatttagtcatcaaagatttttgagaacttgctatataaaagtctaagcagtgagtatgcacagctgtgaataagatttggttcctgcccttgaaaagatcacagtctagtgggaagaaatagatatttcatcaaataaatatatgaaccagagaagaaggagcccagaggagacagaagataactctaggagtattggggaaaactttacaggggaaattacatttgatccaggactcagtgggcgggtctgagtttgccagaaaggaggaagggcatttcaaatgaagtgaacaacatatgcaaaagctcacagtaatgaaagatcatggaatgttctggaaacagttaaggttcattatgactgaagcatagagcgaacgacatgaagtgacaggaaataaagaagtggcacagttcatttcatgatgaaacatacagtatttagagggcagaatagtccatattgctaagatctatgaagtgagatggggcaggggaaaaatagtatataaaccactgatccgggtgatttagaagcagattcaaattattaagaataaaataaaataaaagaacaagcactcttcccttcctaacaaaggttcttctcacctttagatatattttctgaatctctgaattattatctaattggttaggctacacctgaccaactctgattctcaaagcggtatttacacacaggattttaggaatatcagtaattgggaaaccataatgaactcatgcaggttagccctaattcttaacagcatggtccaaatccagtgtatgccacagacttagcatgatgacctcaatcgacttcttcatacaggaataatgagaccataatccattgcaaagcagccttagccaaagcccaatcacctccagcatgaaaatccaaacagaaaatccacacctgcagtttgttaggaaggattcgggcagaaaaggagtgtttaacatccagcaaatgaataggtttgctaggttgtctttttttaaaatgtggcagattaagcattgagttcaccagaaaagtcttttctcatgtaaagtgggatgggaagactggatctctaagcactgttgagctctaacgttgctgttaacctatagcaagaggaaacactccaccctcctggtctatatagttctctgcttataggcaggatgctggacaaaattatcctttgtgagctttgccagcccaaagcctgtaatggtgcagtcttctttctctgcaactcactgtagccctaggtcagttaaattgttatatgaatgtgtcgtctttctaactgttctacagaataattttggatggaactgggaagatacagatacagaatcctacaaggaaagaacaaggcatatatgaatgttctgtagctaatcatcttggttcagatgtggaaagttcttctgtgctgtatgcaggtaatgcccactgttgaaatctagaatgcctggttctttattttttatttttatttatttatttatttattttttttttttgagacagagtctcgctctgtcgcccaggctggagtgcagtggcgtgatctcggctcactgtaagctccgcctcccgggttcacgccattctccagcctcagcctcccgagtagctggggactacaggcgcccgccaccacgcccggctaattttttgtatttttagtagagacggggtttcaccatgttagccaggatggtctcgatctcctgacctcgtgatccacccgccttggcctcccagagtgctgggattacaggcgtgagccaccgcgcctggctgtttatttgtttttaacattaaattctagagcagcagttctcattagcagctgtcagaatcatctggagtgcttgttaaaatacagattgctggactccacccctagaagttctggcttagtaggtttgggttggagtctgagaatcagcattttcaacatgtgcccaggttatgccaatgctgccggtctgaggaccacactgaaaacagctgctcaggaactcactttctaagaatcaggaaataatgagatggagtttaactggcagtgttgatattaatgaactttgcattttttaaagttccatcagtcaacaaaaaagaataattatcttttatagattgcaattacctcccagtggcatacctgccaatcctgagaaacacctccaggaagttgtaactataaagtagtgtgagtcttcttgggaggtggacaatgtcatttggatattaaaatatgcttttattataaagaaacatttttaatacttagtactgccattgtccagctcaggcacaaagtatgcttcctgagtgagtgaataaattaatctggcaactaaatatcaaaatccaaagaaaataaacattttaaaatggacgtttgattctttatgaccttgtttgtattatttttgcatgcaaattttatacatgtatttgcttcgtattaattaaacgttaactttgcatttttcttgcagacagttctgctccacttgtaataacctcatatggtctcataaagtgggaagtcagacattttctctcttgagactttctgcagtgtagagatgtaaataatgttttaaataggtctccttgcaattgatggtctttaaatagtcttttctattttagattgaaatgagtttatttaagtagggtcagacagggcctctctgaaccacacattgggtgagggaactgcagttggaagagatcttctaacccaatcatttttttaatgggattcaaactgaagtccagagagggaagattttgcccaagcacacatatagcttattagaagaggctcaacaagaatcgtggcctcctacctgtctcatctttctccagtacagctttgaatgagctctgaaccgtggttacatcctggcatccacatgtcagcctggctgtggcaccatattcagaaaaactttataaggattaggtaccacatttatattgaaaatgcctgtgtacatctccttctgcacccctacaccttgtgcttatcgaaagaggagatacttctcatcttgtacccaggtatttctcatcttgtacccaggtgcagaccacagagtggacacttggtaaatgtttacattggaaaaaacctcttattacgctgggcccaatgagggacaacagaatggatcaggaccttctgtcctgtcttcatcaaccccctcccccagtatctcacatccctccttccagaaaaagagtcaggtagtcccaagccccagtgtgttttggccctacattaattcattcatggctgcactgcagagacatcattcctgctctgcctgtcttctttgcttcttatgagcttctgaattcctttttttttcaaattatcaaagaggaatttatcctcaattttagttataaaaccaaaatatcctcatagtctatacatactgttgttgcaatgtacctttgaattcatcgaaccatctatccattcatccatctgtccgtatgtccactgagcacctccaggtatgtatgtgcacatccccacggtgcaccttgagggatacagagagaaccaggactccactcctgccctcaaagggctcaacaaagcttaccaaatgcaatatgttttaccaaagagcaaaagcctgaacctaacatagtttcctgctccctttgaattaagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtaagtgtggtcatttcagtgggaggccatttcagtgggaggtaagtgtggccatcccagtgttgccaggaaacaccagctggcattttggtattcgagacctcagcctgataggcttaaaaaaaagattttccagcacactgacagtggatctaactctcaagggtgaggtcatactggctcatgagaccgatgtataaaacagaatgccaagttacttgtttccagtgtggactgtgactgccatgcacactggaatgttcatattggcaagaccagaacactctgtccctatgggtagatctacaaaagaggccaacttttagtcagagggttacttggtgaatacaaagtcagaggaggggatttgtgggaaattgtaagacatgtcctctagatagacaaaagctacacttggcaaagccagatcggggagctagaatgtcccctggcctaggctctcttctggattgtccctgggtaagtgtcagcagcctgttcctcagtggctctttctcccgtgtttacaactgcagacaaacctcctttctaatgttcacactctttctttaacagaattgacactttcagtctgactttgccttaatctagggccatcctgtctcattaagccatggattcttaagtcttcatctgggcccatgcatctctgaactgtagataaatattatatgctgcatatacatgtacattttacaggggccaggagaggtgggagtgagggggttttgtgaatagcgttttattgcttccttagagaaacttatgaactcctccaaattgagatatactcttttaagatgactttgcgtatgcctttgatttccctagcttccaagttctaattagatacctgtagttgcagccacctaagatgagtcttgcctaggctgtgaccctgattgcctagggtgacagaggagcttttgctgctgctcttagaaatgcagtgagggtgcatgtaatgagggatcccaggacacacttatccagctttcaggctctccctccactgtcatgatcagttacttgccatgtttccaaagctgcacctttggctctacaaacagtggaaatttgctaacccccaagatattgtttttcaccccttggaaatccctgcagtgtttggcctatgcagacttttgaaaaattgctccaggctcccaactgactccacccacaaatatgtgagttttctggcaaaatacacccaccattacagaaagggccggcattctctggccatagcaaggagaaaagcagaacggaactctgcagatgccaagccacagatgtctaaagtttctacagccctatacctgcagaggattctgaaaaatagatctgacttctattaagagaaacctcagctttcaacatgacttctaaatttttcacttccacaatacttgaaaatcaggctttcagggagatgagccattaaaaggattggagtgcattatttgctatcggaagtcaaagactggattgggtggaaactgcaagtaaagcctccagcaaagaccattaaactcatctagttttattctcatccaggcccagtcagacatgggctatctctgaccctccccagccccacagccctcctgccctgtgctgtggggccatgggtctgcagcactgctgcctagatggagctcagcactgggagtactcatctctccccttcctccctcacctttcagctcttactaggaattgtcccatttggcctttctttatctggcagtcttcccccatggactcagaccccagaactcctgatgagttctttccttttaaaaataaacctgcctccaaatgcaccacaatcattttgagttatttgccattttaaacaaacctgtagtgaacttacagtgttttcttatgggcagaagccatacctaatggagttttctagggaaattcatcttttttaagacagatggtgaagttgatgaagggtcagaaaacttgagttttacagacagtcttgtcactagctagtatgtaaccataggtgagtcatatatctttcttccctcatctctaaagcagggaatatattatattaatagaagaagagactgtggttatcatccaattcagtttttcatcttatagatgagtacattaaaacataatttacaaaattgaactctgctttacaaattacatttttatattgcaaattgggatttctgtaaatcagtggcatatataatttttttatttgtttagttgccttagactatttcccactaattgtaatgaacttatttttatagaccccataacacatattcatagcttctagagaagttcatctttttttatagccaaacatgttttgtcaacccatgtggtatggatatcaatagggattatccctagtcattcttagagatatttcttttaactatattgaataacagaacctaaaagtccacatatttgcctatttctaaaggttaaaacttctaacttgcgagagttatttgccttgctctttaaaaaaaagtttttttctgtccatttgggtgggggtaatttaaagcgcaccttttttgccaccttctggtaagaaagaaaagctcatctggggaaaatcaccagaaaatatcagttgctgcatgttttattttctttcaggttaatgcatagtaagaacattacttatcctgtaattttctgttgtgtattacatgttgtttatgttattccttaagctcatcagagatgcagctgacgtgagtcccttctctaaagtgttttgttgtgtgtcacgctcctctttagtctgtaaggaactctcttggcccacagatggtaatgagtttgagctagatggtgattcccaaatgaagggcactggcaaagccatcaatggcccagccctaagcttagaaaatttcttaaacacaaggtgcactggacaactgcttcttagagcaaactcaaactgcctggaaagattagagatgcttctaaactaaaactaagctaaagaataaaaacatctttgaatgctattagaggacactggtgtacatctcctttaggaggaaaaattctacaactgtggatggcacctgacatcccaccaggcagctaggtacatgtaggttatacaaaagactcttaaacaataaatgcagaagcaaataaatcaagtttaacacattcccaaatgaatctagtcatgtggatgactaaaggagagtttttcccaggaatgcaaattttttaacacttaaaaatatctactttaaacagatcatcacaggttgaatcctctctggaaggatgtttttgttggtttgtttctgtttttttgttttttcgttttttttttttttttttttttttttttgacacagaacctcactctgttgcccaggttggagggcagtggtgcaatctcagctcactgcaatctctgcctcccaggttcaaacgattctcctacctcagcctcccaaatagctgggattacaggtacaagccaccatgcctggctattttttttttttttttttgcatttttagtagagacgggggtttcaccatgttgcccaggctggtctcgaactcctgacctcaagtaatccacccacctcagcctcccaaagtgttgggattacaggcatgagccacggcatccggccctggaaggagtttttgtatagtatattagttgtcaacatatgtggaagggaggaagcaagcaggattagacagagggcaaaggagaactgtgatgcaggcccacaaagtctcaccaagcccccttgaaacatatgtgacttattagagttgtcccaggctgacccacagtggccaggccttcatgcccctgcctcctgcagtcactggctgtgggcctctctggaaggggcatatgtgctcttgggtcggcggagacagattgtgaagggactaacaaccagaggctaccaggagcagggacactgagttcctccttgaaggttgatttgggtggagcatctccatctctaccacagagatttaaggagataaaatttaggatcatcttaatagatgtagacaaagcatctgataaacttcaacacgaaaatgatatgaaaacctcttggcaaaccagtaatagaagggataatctctaccttgatttgcctgtcagaaacctattgtaagcatcatactcactttaatggtgagactcaaacagtcccattaaagtcaggaaaaaacatacgatgccctttatcactatatctgttcaacactgcgttagcactagccagtgcaataagataaaataaatagaaaaattagaactagaaaattagaaaccaagactagataactagaaaaattatacaaaactagaaatataaaaactagaaaataactacaaaaatttcttcttatttatagataatataattatccccatttaaaagcaaagaaaatatacaaagttttggatctctacattcagaataatttcaataaaaaaagcaatcctgtaggattgctagaacaaactgatcctataattaatatgaaagcacatatggctgagaatagcccaaacattttttaagaataacaaggtgggtgagatttgctctatcaaatataaagacttagcataaagcttgagggcttacagcagtgtaagagggatagacaaataaatggaacagaatgcggagcccacagcagattcaagcatacagtatatggaaactaaaatttaatagcagtagaattaaaaaccaataaaggacagactagtaagtaaattgttataggataattgtttataaatataaaaaactcaaccaaaaataaattctaattgatttaagtgcctaaaatatgaacatatttttaaaaatcataaaatataagagatgtctttatgactttggaatggaaaagatacaaaaaatacaagtcataaagtaaaacatctattgtatagtgatgatggggttgcacaactctgtgaatatattagaactacagagttatacttttaaagggtgaactttttggtttattaattatatttcaataagctgttataaaaaacattgacacactttgctgttaagatataaaagttctgatccctgaaagacattgtcaataaatttaaaagtcaagccacatttctggcagaaaatatttgttatatagtaccagaatatagaaatagcttctctgaatcaatacaaataaaccactcaatataaaaatgagcagtccgggcgcggtggctcatgcctgtaatcccagcactttgggaggccgaggcaggcagatcatgaggtcaggaaatcgagaccatcctggctaacatggtgaaaccctgtctctactaaaaatacaaaaaattagctgggcgtggtggtgggtgcctgtagtcccagctacttgggaggctgaggcaggagaatggtgtgaacccaggaggcggaggttgcagtgagcagagattgcaccactgcactccagcctgggcaacagagcgagactctgcctcaaaaaaaaaaaaaaaaaaaaaaaaaaagagcaaaagatatgaacaggcaattgtcagaaagtgaaaccctaatagccaataatggcatatgaaaatgttctcatttccacactggtagggaaaatgtcctcactgctaaggaaattaaaatagaagtgagattccatttcatatctattgggcaaaagttggcactaccaagggttggcaagagcatggagaaataggacatcatacactgctggtcacagtgtatatgtaatgaaccaatttagagaacaattttgtaaaatctgatcaagtcaaagatgctcaaaaccagacatttcacttgtggatatagccctgtttttgcaaagagagtttcaagagtgcattgtaacattgtttgtaaaagcagagagagagaaggatacataccagtgtcaggattgttggttctcctgggagacaaaagaagaaaagtttggggatagaactttagctctagctgtaatcctttattgcttaaaaaaggtctgaagcggctgggcacagtggctcacacctgtaatcccagcactttgggaagtcgaggcaggtggatcacctgaggtcagaagtttgagaccagcctggccaatatgatgaaaccctgtctctactaaaaatacaaaaaattagccaggtgtggtggcacatgcctgtaatcccagctacttgggaggctgaggcaggagaatcgcttgaacctgggaggcagaggctgcagtgagctgagattgtgccattgctctccagcccgggcaacaagaataagactccgtctcaaaaaacaaaacaaaacaaaacaaaactgaagcaaatatagcaaatattaatgtccattaatttttaagcaaatatagcaactattaatgtccattaattttggagaatggacttttttttgacatgtggttatcagttacattgttttgttgttgttgttgttcacctcctagccctgtttcctgtaagaccttggacctatcacatagtttccttgctccttggttttctgttataaaatgaggaattatgatgggatgaccaggaagactgtttccagtcctgaaattctatcttggaccattggtcctttgcaggaatctgggacaaaataaaagtaaatgtagaaaaagtgcttgaactaagatacctggccagtcaggacttagaactgagtgccaagagtcctcacctagtattgggagggaatctaggaagaaaaaaaaaaaacaaaaaaactctctcaaaatacgtagacacaatgtcctttacaaaggagttcttggagctgcaatatcagcccatgaaaaatccagttacctatatgatgacttgaaaactatagttgtagtaaaaagaaaggaactaaataggctgacacctgtaatcccagcactttgggaagccaaggtgggcggatcacctgaggtcaggggttgaccagcctggccaacatggtaaaaccgtgtctccactaaaaatacaaaaattagctgggcatagtggtgcatgcctgtaatcccagttactcgggaggctgaggttcaagaattgcttgaacccgagaggcggaggttgcagtgagccgagatagtgccactgcactccagcctgggcgacagagcgagactccatttcgaaaaaaggaaaaaaagaaaggaatcaaataataaaagagtctgtaaatcaatgaaaccagaatttgataaatttgaaaaagcctcttacttacgtaaaagctaatgttgaaggtaaaacaagttcactggggggaaagtaagtagaaagggtactttgaggggatttgaacagccttagatggaaatgactcaggtcttgttcatgtcctcatggcctcagaacgcacagctctttctagatgtctggatgccagccacagccctgtgtttcccagccttgatcaggccccttcttgcctccaaaaagggatgaagaataaacagggaaagagattttccctgagataactagataagatcttactgaaataaaatcttgagaattaaatatggaaggaccttaggaatccatgagtccagccctgttttgcacacaaggtccccagagaagaggcttgaccaaagtaacaggcctagacaatggcaaggccaagttccgaacccagttactgcctctgaagctagtgccctttctgttctgaatgctgcttttgtgtgttttcttgtctcataaaaagtaacacatctcattataaaatatttggaaagcatagcaaagtatcatgaggcaaaaaaaaattcccataatcctgtcaaagacacaaccattatttctattttgttatattcctgtaaccctttctctaagtcatggaattttctcatgttattaaaaattcataaatatcatttaatagccacaccagtgtatcattgtgtgaatgtagcataaataaacccttctcttgtttttggaaacttaaaccatttgtacttctttacagttccatacagcagtgtaagaaaccttcttatgcatataactttttgtgtcatttggattatttttttaaaaaagagtaacaggaatggaattgttaggtcacaggacattcaacatttttgtaactaaatagggcattaaaattaaaatgtctagaattctaaatacattatcgccaaattgccagctaggaagtctgaatctactagcggggtatttttaaaccctacccgccccctgtcattgttgctgctcattgataggagagaatgagaaaaggtaggtagaagttacagtttcctgattaattccacacggtgcatgcacaaacaaatgatgggaagtgagcatctcactgggtcaaagcagggcacttggtgctccaagaggtatgtggaggcaaggaggccctttgatatctatgggaggatggtcagtttcagaagaaacatatcacataaacttaaaaggattttcttaatcgggattttttttaagggataaaatgctgtggaatatacctaagaattttattgatgtctaggcgaattattaactttctttactgggtttaacaattaccctttcaggggaggatcttgagaaaatatttgtggtgcagcaggattatgtggttaaattcctaaacatggtctcattgctctgacaattattttcccctatcaactgctagtttatattatatagggtggaatttaatggtagtgattctcatatgtctttaagtcataaatccctttggccaaaaaaaaaaaagaactatctctccagaaaaatgtatttacccaccagtttttgcatatacttttcagaagacttaaaaagaaatctaagattatctgcttgctcttgttttatgaactggacattttggtgcttttgactatattctaaattacagtgaatttatttcccctgatctgtggtttttgaaatatatcctctcttctatactgttatctctttttaaaactcatatacaatctttgaaatagctaaaattgtcattttgaaatgtatatttaaaatgtctttccctactcaaaaaggctccccttccccttttttccttcctctgtctatgatacagaaatcttcccactatcctctcttaaccctatattcagtcaaacagccaatcatagatggttggaaattccatccatcttttcttcccttcaacaagcattcactaagcatttactaagcccagtctagttccttagcatgcagagatgaatacaatctggtttctgcagctatatagacaaaggaattatgatatgatgtcataatgcaaaaatagaagtgtttgtgaagtgtatcagacacattaaggagagactaattaaggcttctaactaaggagtcagaaaaggtttattaaaaagatgaattgcaaccagcccacttgtaacaaaaaggaagggcattttaatcaaagcagcatatatgcaaaagcacggaaacatgaaagcaccctgcttacttgcaacatcacaagcagatctgtgtgacttaaagcagaggatgtgaaggggagtgggaagaggtaggtttggaagtgtaagtgtggaccagaatgtgaagggctttaatgtcatgctgaaaccgatggacttcattttattggcaaagaggagacaagaaacattttgagcagggtaatggtgtgaaccaatctgtatttcaaaatggatgaaaaattagaggagaaagaagctgcagaaagctgtaaattgaacgcaactaaattgcatcaatggtcattgattggattattggaccccaaaaagcctgccagtcactcaagatattaagctgacgttacatgtatctgatttatccaggagtcagcagacatatctggcatttagcaacggatgcgtcattaattgagggtgtgggacacaggtgtcccgaggctagggctagggtgttgacaagtagagtcatgcatggagggcagccatattgcaaagagctgaggagtatgtgctaataggcagcatgtcaataaataacatgttggaaaaccatcaaagctcatcatcaaaaataacaataacttgagctcctaatgtgtattggcttcaacagcatacaaagtggatattatatttgttttgcagataaggaagcaaactcagatacacacagttacttgtctttgtttatgtacctaatgagtgtgtataccaagatttaaacccaatcctgtgtgactccaaaggagctagacagagaatgaaactgtgtttgagacagcagaataggcaccacgcaggaggtctgaccagagagaagactgtcaaagcgaggtgtgaggcagaacctaggaagtgctgcagcctggtgacagagtgtcattggcttaggggtgggcaacaggctcaacctccagggctcaacctcacctgaggactgccccatggtatgagatccagggagagtacactgggagcctggcctcttgctgggccacaagatgccagccagtatcaggccaaaggttggcccattgtgctcaaccaggcacatgaccttgacacatgcttctgccatcactgcagcagtgggaaagaatgtggcaaattatgcactgtctggtagtgactatggactccctcacctcacccttaatatatttgccccaaatctctttggacttgtatttggattattgatttagcagattaaaaagactcatttataaaacaattatctgctctttaaagattcactgaagctctattttgagtgcttcttgaaaaaatgattttctttgcattttttatcaatctcagtttctcatgtggtgaaaacatgggcctgtatacaatcaagaagtagaaagaaatctagaataagttagctggatatgcaatacgaaaaaacaggaggggctcttcaaacacctatcaaatttcagacttcattgcaaaaaaccttgtgctttggcttatgggtctacatgtattgagtgtcgccatgtcttgaagcattcaagtacagccttgatggtccagtcctattgttaacaacactgctttcatccccaaaatctataccccatccctgtcttcagtgccaccagtacatttctctgtcctgaaaactccacagtcactcagccccatgttaatgtttaacctatcacatggtaacaacagactgacccaaaaggccccatatattgtcatcatgtagttccacattgtgtgcccacccattccctatcctccaaacaaccatgcacctttcttccatgcaccatcattagaccaatgggtaaaccaatggttttcagactatagattccatggagccttgtcaaggacccagccttccccttctaccctacctgttccccgtcccccaacatataacccaaccaaaagacctctatgctttgcaattttatgaatcggactttcttataaaaaaaattttaaagaacttgttctgatactaatgtttgaaagtcatggattcctgtgaccatggcagattcctactgccaaaagaacatatgaacactccataatgatatcttatttaagatttcaaatagatttcacctccataatctctcttttttctttcttttcttttcttttctttttttttttttttttttggcttagagacagtgcttcattcttgcccaagctggagtgccactgcagtgccatgcagtggcatgatcatagctcactgcagcctcaaactcctgtgctaaggcgatcctcctgccttagccccttgagactacagccatgcaccaccacatctgactaatttttttttttcttgtagagacagaggtctcgctgtgctgccaaggctggtttagaactcctaggctcaagcaaccctcctacctcagcctcccaaagtactgagattacaggtgggagccacggtgcctggcctcccactttttcttggttaccatatttctgatattaagactcatttagctcccctaagttttaacattaataaaatggccctggatcagtcctgttgagcctgtgagatggtgcactaaacacctgtacaatccacagggcaggagcctcgtatcctcctctgctcttggacagaagctctttcctcagtgatcttctgaagtccaggcttctaaagaaatgagttgctttaattccatgagtctctgagtggtgcctcctggctggcctgtgttcccttggctcctcgtattggtgtcagagcaggagccagagtggctagtccggagtttcccaaacctgtatgagatttgatagcaattgggaagcttttcataccaggcagtaaaagtgaagggttttgaatgccctataccactcaaatctacttatactgtaagaaatgcctttgcttgctctctgccctccaagactctctgcttttggttctgtgtgctgagacccccaggcagcagcagagagcacaggacaagtgtgcagcatggaacagcatccattataaaacacagggaaccgtcagaagcccctgaatgacccactagttcattccggctgctatgacctaactatgccttcacagcaagaccgagaggcccacagcacccacacagggtggggactgagggaaagggaattttgttggaattcaacccccggaaataagaaagcatgcaagcttctgagtacagtctgagaaaaccatgcaggaccttgttaatggaagaaaaacactcctttatgggaagagccccataggacctgtgtagaattttggcctctctagtaacatcccaacttatataaccctgttttttttcttttcattcatttatttcccctagttattaattcaatacccagttattcattttgatgactgacacatactacagtcaggtcattttattattttggttaatgtcagttcaggcctggacaccacaacatctccccagccctgccctgagagattctgatttaattcatcggcagtatgtcctgagaaccaaggatttttaaagcttcgccagaagattctaatgtgcagccaaggttaagaaccactgatttagccagtaaatggggccaaagaggtccctggaaattatctcaaatatcctctcaaaatgagagactcttcctcaggaattagtgggtaaccagaggtcaactagaaccaggagtaaaccaggagtaaaccaggagtgaaccaggagtgagtaatcaggagtaaactagaattaaccaggagtgagtaaacaggagtaaactcaaattaggagtgaaccaggagtgggtaactgggagtgaactaaaagcgggggctaaatggtagaacccagctccatgctctgggctcattctgaaggtagaatcaggcatgccaacaattgatgcctcagtgttcaaaggttcacacaggagaaatcagctgtcaatgtccaagaggatcaaggaagtgattttgagatgcgtctttaagaatgaggagaaatgttccaggtggtgaaagggaatagcaaatgatctgcaatggcgagaacagcacatagaacagctttacagccagtgtggtgtgtttggagaacagtgcagttcccgggctggaggatagctgttcttagcagtgactcccctaaattgaaaaggcttttgtgcttttctcctccaagaacaggaaaggctatagagctaagaaaactgactcttactccctaccattcctgaggagaaaagaccccccagaaatagagtgagaggtgcagctcagaagaaccaaaggcaagagttagtggtttaaggaaagaggaaatggagtcctggggaatcaacacggccttgagatgtcaccccaagacaccagcagcccacacatagtcctctggggttttgctggtgatagcagtggaatccacttggagattttggtgcatgatctccaaataactaatatttttaactggctaatagctatttgttcatctatatcccaatgttatcttgatagattaccagaattgctgattatcaggaagggcctcaggaatgtccatggttctccctttgagctgctgtttaggagttcctcctatcccctttactggaatcagtagtttacaccacttgcatagctccagcatgtatcgctatgcttgatttgcaccaactcttgactttcttcttcaaggaactactgaaggtttttggttttgatataataattttcactggcactttctagcctataaataagactctggaggacaatatccagcagtgaactgtgtggtgctcatgagatatgtctggtggcgttaaagaactgcccaggctcgcgcaaagcagaagcccagggtacgtgagagatgagaatgaccacaccaggaagaggacttgttgacactcttctccatgtcagaagaaacacagttcaaaacctttagggaaggacttttaatgatggagttgggaatagatactatgacccagatgatttctaaatcctcagaaatcaaattgattggggaacagattatgtcaatctaaacatgagtttactagagaaaagaaagtacttaaacagctattcaagagaattctgtaaatagtaaaagccagagccctctatttggagacagttctggatatggcatcaatgatggatagtccattgtatccaaaaagcatacataacgtatttttcaaaaagaacaaaagggtatgcagttaactcagaagaggaacgttccttacaaaatttactctgctgcacagattggccctgcagttaagaagagtgcattcattattctagtagctttgagatactttctctgacactgaacccttgaactcttatttctttctttcatttattagtgatgactccctttgtctatcctgtgtttgatttgccttttataaattggcaacatcatttcttcatgattccccagagataactgatggtagcttaaatcttcatttgtcgtatatgaaaaagtaatgcagaattctgagtgagttttgagtagctggaagaaacaaacatgagaaaaaaatataggtataatatatatttatttaaagatccagcatttcagggcagtctgaacaggccagggatttatagtgtggaatatttcatgggcctttcaaggatgaaggaaatttgtttttaaacactgactagtttaaagacacccccgaggtgcaaactttttgcaacacatgtttcacagcccctccggctctgaacttttttccacaacatttgtcttccaaaacaatttcagcattgtggaaacagaatgttgaatatatcagagctgcaagtcttgggggaaatagcctgtctttaaggttagataaataagtttaaactatttctgacgttttatagctgttgcaacagagcaaatgtgttattttgaaacaccataaagagcagtggtgcgaagaaatctgtctgaatttcctctggcctgttcagttctttgaaaatgtttacacgtgtaacgatgcttctaggtgctgaacagacctgtggggtaggagagggagttggagttcactatgggacttacggagtttgaggtgcctgtgggacatgttgtgccaatgggagatgtccaggagtcttgaattcaagggagagattaagactggataggtagatgtgggagttttcagcataggaattatcactatatttcccaaagtagatgaaatggcccctgggacagtgtgtagtgtgaaggaaggacttggtcctgtactctggtgtggtcctgtgctcttcatttcaaacttcctatttctgacattttcttttggaatgtaactttgtcagtttgttctgagaagcttgcgctggcatggctgtttggccatcttggttgttttcataccttagtttttagtctagactcccatggtcacgtggaacagagaaccacctcgaactggcttaagaaaaaatggaggaactattggctaataaaaccgaaaagttctggagtgtagacactctggacataattttagatacatctggattcaggaacttaaatgatttagtcaagaatccaccccttagccaggcacaatgatgcatacctatagttccagctattcaggaggctgagatgggaggatccctggagcccagaagtttgaagcttccgtatgctatgatcatgcctgtgcatagccactgcactccagcccagtgagaccccatcactaaaaaaataaaaatccatctctctctggctctgttttttttctgtgttttgaggtggttggtgggcaagggttgagggaagaccatgtatgttagcagatcataaaacatcataagcagtttattttttgttctaagtgagatggaagccattagaggattctaagcaaaggagtgtcatgatctgagctaccttttagaagaaatactatggctattgtgttgaaaatagactgtaaaaaatcagagagtaaaaggaaggcaagggtggaaatagggagatgagataagtattccaggtgagcaaagccatccctaaattccctgccctggactccacttccctctccagctattgccttagttcttgatttccatttatagcaaagtgcctcaagagtagtttatacttgctgtcttcaatttcatttctcttcattctctcttgaatccactccaaccaaacattctccataccattaccttcatagctattgtcaaggtcaccaacagcttaccatgtaagtgtgaattgctaacttcagttgtcaggtttgtttgtttgttttttgagacagattctcactctgttgcccaggctggagtgcagtggtgtgatcttggctcactgcaacctctacctcctgggttcaagcaattctcctgcctcagcctcccgagaagctgggattacaggctaaatgttttttgtatttttagtagagacagggtttcaccatgttgcccaggctggcctcgaactcctgaccgcaggtgatctgcccacctcggcctcccacaatgctgagattacaggtgtgagccaccacaccaggccccgtggtgagttcttaggccttaccttacttgctcgtttgactacactagcattggacagttgctacgccctccttctctgctttgaggaaaccactttgttttctacctaccatagtatctgttcctgtgtagcctcctttgtcccacctcttgtccctgatctctaagttgaactacccgaggcctcagtcctcagacgttttctcttctctatatatactctctccctattggtcccatacctgcagaaggactcaaatatgacatctgtatgctggaaactgttaaatttatattttcagcacagacctttcccctaagctctagattaacatgtccacatgcctgctcagcatctctccgtggatatgtaatagttatttcaaacttaacatgtccaaaactgctctcctgagttctgctcccaaacttacttctctcatagtgtccctcatctcagtgaatgacaaggcagttatttaatttgcttgagccacaaatcctggagtcggtttttactcgctttcctctctcacactaccccacccccatcaaattttgtctgctctaccttcagaataggcccagaatctgaccgtctcttaccacgttcattgccactacactggtccaagtcaccgtcatctctaggctggattatcttgacaggttcctcactggtctccctgcctctgcccttgccccctgcaatcaacatagctgtcaaagcagtcctttagaaacacaagtcagctcatgccattcttcaaaatctttggaatagaaaccaaagccttacgatgacctatcaggctatgacctgagccccacctgccacttctctgaccttgtcacctactgctcttttcctggctcacatccctgcagccacatgctcttttactttcctccaaaattggaggaatgtgtcctggaccagtctgatgaagcctatggtactacttctgaaataatattttcaaaggtataaaataaaatatactgcatttaaagaaaaccaattataataaaaatataggtatcaaaatattaataaaccaaatgtgtgatcgaataatatatgtacttcattactaatgcatcaaattcaaaatctagcattgggtccaatagttaccatatttttgaagtagtgttggcataaaaaatattttgagagagctggtcacacttgtaatgtgatacgaaaatatctgtgacttccattggtgagagagttaaagatactactaccttggtctgtgcttacattcataattgatagaagtgctacatttcaactagagttggtgaaaaggtcaccgactcctgaatcctatctgtggacccacgtgagtctcatggtccccgggttgaggaccccgtttcagggccaaggtacttgctgttccctctgccggaaatgctctccctggagatctccacacagcttgtttagcctggctgaaggcctctggtaaaccttgtttcaatgtagaattgacagcaccgcttaccagcttcttaccgtggaggaataatgaataagccaatgtatctgagattgtttagggtctttcactgtaagaggctttatgtcttgagaaaacctcactaatttggactgattgtaagaggcaagtctgaattaataaacatccctgaattgtaaaatgctttcaagtctatgaattgcttttagaaatgttcagtcatttaagcgagaattgcttagggtcttaaaggcaaccactttaatttataaatgtcgatttatactcacataacaattgtgtatatgttgtggaggccagtgaagtatttgaaggaatttctgaaatgatttgcacttttgccctcaaatatgtaaggagatttttttctcttcctagctagtatagcccttctctaaattaccatagattccaaaataatagtgtctgagtttatgaggattttactatacagtcagtgctttattatctttgctgcttggaagagagcattggtatgaataaccaaaaaagtcacgctgatgtatctttgggatagaatatggttttcttctagtaaatgcattccctagtttattcatttatgcattcagcaaacattcacacatctaatctttgccaggcctatactcatgatctgctgtggagaactgagattaatgcagtaataatgctataaaagaattctggtcatagagagtgaataatgagagtgaattaaataatatatgaaagaatagatggatgaatgaatgaattgatctcacacatatcttagagctaaaagggaccccaagagaaaatttaacaagaagttaaatcaaagttgtttctgagctccattattaactttttaaaagttggggataggtgatccaggtaatacattcaatcaaaaaacaaggcactataccatgaaaagtctggctcctgctcctgttcccatgctttcctacatctgcactctatgttcctccttgcaggtatcttccctttctctccagtctacatgaggtacagcttctgtgctccagtggcatccagtattttacctttattgcacgctcttatctctttgaattgcagctggctgttttgatgcatgggcccactctagattaaggtccgtgaggaacttagtttaccattatatccttagcattgccacagagtcttacatagagtaggcactccataaacatttttcaagtgaatgaaataatggcaatagttgtattgcatttcaaaacataagatatgtagccaaagctgtactcagaataaaattaacagctttaaatgatttactttaaaataagcaaattaaatgttaaactcaaagactgagaaattttcttgtaggctagaaatagaaggaaatttatataccaaaaaaagcatcatgcttaagaaagaaacattagtaatattcccattaaagttggaaacaagacaaatatgcctgctgtcttagaccactggggctgctataagaaaaatgctatagactgagtagcttataaacaacagaaaatttgtttcttacagttctggaggatgggaagtccaagattaagcttttcatgttgaaggaggtccaagatcaagatgtggtggggagggacacaaatattcagtctaacgtacctgctatagtggttattattcagcattgttctggagacactaatacaataagacaagaaaaagaaatcagaagtatacatattggaaaggaagagaaaattgtcattatgtgcaaatgatataattatttaccttaaaaaacaagaaaatcaattagaaaaactattcaaaataataaagttcagtaagatgactagaaacaagataaatatgcagatgcttatagctttcctaagtgttggcaataaacaactatgaaatacattttttaaaatcttgtttactgcaacaacaaagaactataacatgcattggaataaatatattaagagatgtataacatctacctatgttgtggttaagaaaggttctgaatcaaattgtattggtataaatctcagctccaatgtttaatagctgtgacctttcagaaagcttaaactttctgtatgtgtatatgtgtagaagaaaatgctaaaaaagatatatgcacatgtgattagcattccttcagctatttagggctagcctagtttttataacaatatttaaaacaaatctctcggtgtattggttttctattgctgctgtaacaaattaacacaaacttagaagcttaaaacaatacccatatattatgtcacctatgttgcacagaattgctgaactgactgttacacttagagtatctaaggccaagatcaaggtggtggcatggctgcattcctttttggaggctctgggaataaatctgcttccaagcttcttcaggttattggctgaatcccttatcattttagaactgaagttcccattttcttgatagctgtcagctgaaggccactctcagcttttagaggccacctgcactccccagctcaggtcccttttatctttaaaactagcaatggtgggttaggttgctctgacactttgaatctctctgaactcctcttctgcctcatctctcctactttctctttctccatatgtccctgacagcttctgtccttctcttctgattttagggacttatagaattacaatgggcccaaccagatatctccccattttaaggccaactgattagtaaccttaattacatctgcaaattccttcacaccagtgcctagattgacatttgattgagtaatgaaaggatgagaatcttggggcaatgtctttagaattctgcctaccatacttggatcatacaaagccacaggattaaggacaaaaagtcccaagggcaaccatctcagactccaattttgaaaacttcaaatagtatatctgaacataatgaagttcctactcttctttcagattcctttcacagacgacacagttgaaatctaaagggctttgcccaaggctacagaactaataactattgagaatgaaaacaaagcctcaccccaacccagccaagatagtgctccccctatgcatttccacctcctctttgaatagaaatttagtctttttttcaccttgagttttcaggcaatacttcagtgccaatatcagtcttaggtttctacaagtaaatttaagcatttctagataacagtttcctccaaagccacacaatgacttccttaagagacttgaataatcagcttgatgtaatggacagaactggacctgaagtcaaaaggcttaccaggttcctcaattgtgagatacagctaacaatgactgcctcccaggaaataggaataactatgagaattcaagtgtcaccatgttcatggagcacgcattttgcctactgtaaggtgtgttgcacatgtcatgataatagcggtcgcatctattttttaagtcagaaaaccataccatggcttctccattctcactaaccagagcactgtaagaggagaaaacatcccccaaaacagttgtctagagcaatcttggcatcatctgaagctattccagctcttaagagccagatgaggtcaggtgcagtgggaggctgaggcgggggatcgcttgagcccaggagttcaagacgaccctgaggaacatgatgaaaccctgtctttacaaaaattacaaaaattagctgggtgtgatggcttgcacctgtagtcccagctacttggaggctgaggaagggagggtcacttgagcccaggaggttgcagtgagccaagattgtgccactgcactccaggctaggtgacagagggagcctccatctcaaaaagaaaaagcaaagaagaagaagaagaaccaaatgaaatttctctattcctctgaatcttaaattccaaagcccagcaaaatgctaagccttctgaagacttggggaaagaaattctttcaattcctcatgttcccctctgtgtccaggctcctgcaatgttgcttacagtccctgcatctcactgcattgacccggaattgaaactcagcacttacttttgctccctgaagttatcctcctttacaaagaattaatgaactctgtttccctggatgttgtatattcttcctgagggaggaatgtttcattgcttatgcacagcaaacaacttaaagacctctaggaaatatttatgttttccaaagacttccttgtgacaacctaccccctgggagtttctcactgtgtctctacctccacattcccccagcttcaccgactccttctttccaaccacactcccactaccctacccaccttcaaaattctctcccttcccaatacagagcaatcctactccttggtttccattccataacttatatgtgtaaaccagtcacatgccctgtagaccaaagccctttgctttaagaggatcctccatctgccatagagtagctatagaaatagaaatagccatttttcctattatatatgattaaacccatatgctgacttacggtcaaaacagtgaatggtatttgtcaagtggttctgtggccctgttcttaaaggaattgcctttgtcatatttgtttttgttccaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctgggtaagtgtcaaattcttattgctccttaagtgcctcctgtaatatgcacaaagtaggccccagttttgttgattttggagttgagtgaacgagatggacatcagatggttttaaccattgctgccactgcctgcttaaaaacgagcactaaattctaacaccctattttaccaccccgtattcccagcacctaacacagatgttagtgtttgtgtgtgtgtgtgtgtgattttttttttttaaacggagtcttgctccgtcaccaggctggagtgcagtggcacaatctcggctcactgcaacctctgcctcctgggttcaagtgattctcctgcctcagccttctgagtagctgggacaataggcgcacaccaccatgcccagctaatttttgtatttttagtagagatggggtttcaccatgttggccaggatggtctcaatctcttgacctcgtgatctgcccgccttggcctcccaaagtgctggggttacaggcatgaaccactgcgcccggtcagatgttagtgttaagtaatggtttcatgaaggaatgaaattgaaccattggcaaaattagtataagagtatagaatccattgctaaaccaagaggaaaaaacatgaaagagatttctccatagctttccttggggcagttagaggagcccagagatataaagagatagggggtgccaatgcagggagttggaatagctgtcatgcacaaagcattttgatgagcgttaattcttgtgatacttatgatagcacagtgttgtgggtggtattttttaatctcattgtatttatgaggagccttgggctcataaagagtttgaactagtgcccaaatatgtagtctgctcttttggtgctctccctgctacccctcatggactcttagtactgacaaaggcagtggtgtgccaccacgtggctctttccaaaaagcctctgtgtgatcttccaaaatcttcgaatggaagagttgcaacagattggctaggctaaccctgtctggttcttgaatgatttatccatgctccctgagaaaccccagccttgtttctttcttctgcccatttccactcatgaatctgcatgcttgtctcactcctacctggcatacctcttctctcaggaatcccctcaagccaagcagctcatgactttggtaacttgatggagaggtcaaatcatggcattcctccaccatcctctgctcttatgtgcaagcttcacaaccttcctaaaagcccgtactcctcaccatgcaaacctagggaacattgcccgttctcttgctcccagcattcctcttaagaggcagagctctatccaaccaatctgcttcctccagtcccttttggaattctgctgaatacatttttttcatcttgcaatttaggctagaaaccctggaaacatgcagagatgccacatgctagcacagtgagtaactctaaactctataacaccccacacgtccatacttatacacacctcccagacctgtggtcatgagcttgagtatccaggagcacagtattattatagaggactcattttctaatagctgtctttaagaacacccaagctggaccaataattagataatgtctaactggtaaaagtgctacttttttttttcctcagaacgaagatggccagagagtagaatcgtatttctgcaaggacataaaaagtacattctccaggcaaccaacactagaaccaacagcaatgacccaacaggagaacccccgcctcaaggtctgggattttgaccttttcagatttgctatgtgtgaggcatgtgtaaggaaaaggatttagctaaaagaccatctgtatttttcactttgcaatatgtaaaattatttctaggcatttggccagcctttttcttgaccctcagtctttagtggttcaacttattctttccatattgaaacactttttagaaaaatccactcctgaggaagcctacagagctcatatctcaaatgtgcactattatttgtgataatatagatattgatttccagtttcaaaactattgccaatttggtaaatattaatagatattaatagtctgctatgagtattggaattgattttttaattgttcttttttcaagacatagttttccatacacaccaactttgttatgcatcagtgcttaatcaggagaacctaatctaagtattacaagcttataaaactctgcagaaggccaagggatcaaggcagagttaagaaaatcagaaatgctagaaacgcaggaaaccattactggtcatctcagctccttgtagctcaaaaatgggtaaatcgcagaaggacacaaactctttttttaattattttgttattttattttgtttattttgtttatttatttatttgagacagaatctcgctctgcctcccaggctggagtgcagtggcgtgatctcagctcactgcaagctccgcctcccaggttcatgccattctcctgcctcagcctcccaagtagctgggactacagccacccgccaccacgcccggctaattttttgtatttttagtggagacgaggtttcaccgtgttagccaggatgatctcgatctcctgacctcgtgatccgcccaccttggcctcccaaagtgctgagattacaggcgtgagccactgtgcccggccacaaagaaactccttttaaacctcatgttgtactcgttatataggaacaataatggccacgtcattttcaccttttaaatcttgagaagtgcctctcatttgcataatgtatcatgcagaatataactctaccggtagagattttaagaaatgtagtttctaggctttcacctcctgaggtgcaagagagagcacagaaggggaaaacagtgttgagctgccaatcagcaatccatcacgttacttatgacatcattctcttatagtatttgtatgacacatttcttctcctcttttaaacataatactaacattattgtatacccaaatatccatttattggacattcaacaaatattgcccagtgcttactcctcccaggtctggggttgcagatgacctcctccttgagaagctcacagtctgaagagggaggcagtcacgtaaacagatactgtaaagcactgggacaagttccataataaaaagatgaccaaagtacaatggtagcactgaggaaggggccctacctctctctagagaagtcaactgagttttcatgtaggtcatgatgtttgttctgggaagaggaaagaggaaattccagtcagagaaaccatggtgtgttgcatgtggcatggaacatgaagatcaaaagaactgcctaaaataaattaatgaaaaacaaaaaggatatgtgtgaggctgaagctattggtgaaggtgaagcctttggaatagtcaaactcttggtttattgggactacttgcattgttctgccacctcctacacagacacacacaaacacatgcccaaatatacaatcacacacacacacattgtggaatgtcccagcccttcaaaggatccttagcttagcatttcaaagagactcctttattaatttaacaaatactgcttgcatggctaatatttcacataccctgtcctagtgttggacagggtggtgtttatggtcttgacattccagtaggaaagatgcacaagaaaccagtaaacaaataagtatttaagatatttctcagtggtaagggctatgagatacacagtgataggaggaagccactttagtgaagacagtcgggatgggccttctaagaggttatatttgagcccagacctaaaggatgaggtgaaaccatttgtgcagaaaaatgagaaagaagcaaagaccataaaattggaataaggttaatgtggcctcagaatggaaataagattcatgtgactagggtacagttgagggagagggagagggatatgagatgaggttggagagtggctgaggaccaaatcattcagagctttgaggtccaaggtaaagactcaagagtttactcctaaaacatgggaggtcattgaggagtcttatatggtagtgatatggcatgatctgcttttcaaatgcatttgtgtcaaaaagcactaagtagaaaacaaaaacaaattatcaaattggactgaccgcatcaaaattttaaagatctccttatcaaagacaccaataagaataatgaatacataagccatagactgggaaaaatattggcagaacatatgtctgatgaagaacttatatctagaatatataaagaactcccacaagttatcaatgaatatcccccaccacacacacatacacacacacacacacacacacacacacacacacacacagtgggcaacagacttgaacagacgtttcacaaaagatgatatatagatggcatcagggaaatggaaattaaaacctcagtgacatacaatttcatacccagtagggtagctaaaaacaaaaagactgacaatgccaaattttggcaagagtgtgaagcaactgaaacgctcatgcattgcttagtgtgtaaaatgtttagaccactttggaagacgatttagcagctcctaaaaaagttaagcgcacacctaccctcgacctagcagtttcactcacaggtatttacccgaaaaaaaaaatgttcacaaaaagctttgttcatgaatgttcaacttattgataatagtcattgacaggagaatagattaaaaactatggtagatttatacaatgggaacattattcagcaatagaagaaatgaaatgaactactgatatgcacaatgatatgagtgaatctcaaaaaccttatgctaagcaacgtaggaaaccaaaggccgggcgcagtggctcacacctgtaatcccagcactttgggaggcagaagcgggtggaccacaaggtcaggggttcgagaccagcctggccaacatgatgaaaccccatctctactgaaaatacaaaaatgagcccggcgcggtggtgcacacctgtaatcccagcttctcaggaggctgaggcaggagaatcgcttgaacctggggaggcagaggcagcactgagctgagatcatgccaccacactccagcctgggtgacagagtgagactctgtctcaaaaaaaaaaaaaaaaaaagaaaccaaatacacaagagtacatattatatgaagtacaagaataagtaaaactaatgtatactgatagaaatggacgagttgctgcctgggaggggagagcaattgattggaaagagacaagagggggatgatgaaaatattacatcccttgctttggatcatggttacgtaagtgcttacaattgtgaaaccttgtaaaactgcacacctgagatataatcaatttattgtgtatgaattatacctcaattaaaaaaacacacacattttaaaagaaatgcacatgtcctgccttgaactgccaaggtgtctttgtgaaatgtggcataatagagtcagacacacttgggatccagtccggctaacaggtgacagaccttgggcaaggtactcagtttcattcagtttccacctctgcaaataaaaatatcaacttcacaagatgatcttgaaaattaaatgaaaaattgattataaagtgtctaactcagttcctgtcacctgggaggttctcagtaaacgtatctacttttaaaaaattatttttaaataaactgtattcctgagtgtccaactaaaaatgtattttacatttttgctttgcaaatgatgccatgtacaacttaaaacgaacttcaaaaatcagaaggaaaaagtggaaaacaagtgaaagaaatcactctgctatgtgagagagcctgtggacacagctggtagctattaattacttgtaattattacaggaaaatctggcaccttctgtgatcacacacaaatccatcatcatcatgtcctacctcatcttttgctgagtgtcagcagggaagggaaaggctgtttggaatagggattaaaatttttaaaaagctgggattactggaggtggtcggcttctactcttgtaaaggaaactcctacatttatctcttcagatgtctctgtgacaaattatttatgcagtcacaggatcaatctgaagtttagattaagaattaatggaaaaataagaacagaactcaaatgcatctttaaccttactgcttaatccctagtccctgttcctcctgctaaatcatctttcatttctctgcctgatccacttttgagaaattgaacccgttagggcatcccctagagaggccctcctctcttgtcctgttggctgtggttagagaacactgaggaggcagcccactgctgagagtgcctcctctctctctgggatttttctggcagacccagctggccgatgatagtccctctccagactgtggtccaaggaccccattctggccgccattctcaccagttattacagtaaattagttgagggaaaataagatttagaggactcccttgcactatgagatggctttctctccatatgctacttaaagaaccaaaaaacatctcatggtggtttttggccatgtcttctccagctcgtcgtcatttctcttttggggctggcatgatattttgttttctttctgcagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtaagtgaagtcactctttgtatctcatcaacaccaagtttttgtttgttttgaaaggtgcagtgatttggacataataattcaatagctaagttttttttatcacttactgtatactaggcatcctgctaagtgctttacatggatcacagtgtcctgtgaggtagatgttgttaatttcctgtttcgtagatggggaaactcccctaggccatacagttataaggaccaggattcaaatggtgatagtctgattttagagcccctgctctcaatcactaaccaaacctgcttcctgcacacacaatcctgtcagttctttaagactttagtgaggctaatttcttgggtttacttaggagataattcagtgggccagaatcaccagaggcactagtgaaaaacacagttctctagacttgatccctggaggtaaaaccattaataagctttctaagcaataggtaatacaaatcagtaatttttaaatgtccaaaatcaaattcatggtctccagcaaacttactccatccccagtatttcagatcttgatgactacatcctagatgcccctctttctctcacttccatccattcttgtccatttccactgttaccactaaagtccaagccgtcattttttcttacatggactactccaggagtcttctggttcttatctccctctctggagtactttgtccactctctaagaataaagatatttgaaacaaattcatcatgatggttctcttagtttcattaggtttctacctctgcaaataaaaatatcgacttcacaagatgatcttgaaaattaaatgaaaaattgattataaagtgtctaactcagtacctgtcacctgggaggttctcagtaaatatatctacttttaaaaaattatttttaaataagctgtaatcctgagtgtccaactaaaaatatattttacatttttgctttgcaaatgatgccatgtgcaatttacacatttatcttaggacaaaggccaaaattcccagcactggggttgtgactatcttgtacatctttttatctcatgtttgaaacagtgcctagcaatagtaggtgcttagtaaatatttgctgactgactgagtaaatgagtggaagaattgaagtcccttcatatttgggccttgggctatctcttttatcgcttgtctctcccacactggttatttgatctccttccatgctggtctttttttgtcccttagatatactattctgtttcctgactcagaggctttgtgcatacttctccctctgcctaggacactgtcccctctctcttcacttaatcatttctgttcatctatatatacctcaatacatgctcagggaaaccatccctgaacttagccctccaaagtaaatcacgccttatgttatatgatttttatatgtccttatcattcttcataattcttaccacaattgtctgtcttgctctcccactagaccgtaaattctatggggagtaaatccacaggtattttgctcaataatttattcctagcacttagcacaatgtctgctgcatcatatactccctataaatatttatgaaatcaatgaatgaatgattacaacacagaccctagcagatagttgaccaaatagtaccaaaatccatagtaaaaacaattaacaaataaaaaagcatttgttgagtacaaaccaatgaagaagatactaacattttactgatgagaaactggagaaatgtttaatgttatatagctcactgcccttgggcagatgtccacactagatccagtctctaagagtgccttggaggagagtgggaggcagggtcacagtgtaaagcaaaataggttccttaggacatgttcttaggagggttatcaatattgcaggcaccctaactgataggtcttccagtaccctttgtaattctcaaaaggaagatctcatgttaaggtcatccctcagaaagcagcaaactcatgcttcagtaacttggagtaacctgattgagaaagctgttttatggcatttcttgattttcaaaacgcggagagaatccacattgggaaatctgtcagcagtcttgtttctcgaatattctaaaacctttgcacactcctaggataaacagtcccacactttcatacctagaagagaccatagagatcatctaatcccagatccctctacatcaaggcttctcatcatttctgtgccacagctccctctggtggtttggagaagcctgtggataccgtctcagaaccaggtttttgaatatgtaaaataaaatacatttgattacaatggaaaccaattatattgaagttcacttagtgaaatatttttaaagatctgatatatcgccgggcgcagtggctcacgcctgtaatctcagcactttgggaggccgaggcgggcggatcacgaggtcaggagatcaagaacatcttggctaacacggtgaaaccccgtccctactaaaaatacaaaaaaatcagccggccatggtggcaggcacctgtagtcccagctactcgggaggctgaggcaggagaatggcgtgaacccgggaggcaatggttggagtgagccgaggttgcgccactgcactccagcctgggcgacagaatgagactccgtctcacaacaaacaaacaaacatacaagatctgatatagatttacttctctattaacacaaaaaataacaagatatagttgtgctttaattttaatatggtgatgaatataaatgatattttgagatacctgtcataatgtaatgtgtaaatatctatgatttctattggtaacaaaatcacaggtattattaatgctactgtacttgtggcctatgtttctataattgaaggaaatattaaatttcagttagagcttagtgacaatgaagacggaattctttttccatccaagtatgtggtttccttggataaccatggacatcatgttagaaacccctgctctgcagtctcccaacagcatctttgtcccaacagacaaagcactcaatatctcaaaggtgtccagctccaagttcagtctcctataatcattaaagcatgaactttagagtcagataaatctagaatccaatcccagctctgctggcaggttagtcatgtggtcatagctaagttattcagttcagtggacatccgtttcttttctacaagaatgggaataacatgagaattatacaagctaacatgtaagtatcttgcagggtaaacaacacttagatgctggaaatatattttcttcattttagtttcagtgagttgaactccaccttttggaaatttcctcctaaatttgccccagctttaccctctagggccacacaagtaacagctcttcataaacctgaagacagctgtaccccattcctaaagtagtcatctctacatgatgacactgtttctcccgagttaaagaaggtctgagaaaaaggctgggagtcatctgtgctgcttcccattcccatagagacatgtgacagcctaagatagccatggtgttgggatcagctttttcctttgatgagacgccccctctaagatctggcataccagtccttactaaagtcctgtagtttttgttcctaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccgggtaaagctaacacatctagtttgtggacagcactatctgtccacacagatagtgtgataataatcaccttgtttccaataaactacttttggggcggggggcaggaatctgactggtctctgaaatgaatgtatgtctttgacctcaaggtttacatttagaaatcatagtatctctgtcttccagtacaaaagtgaaccaagtttgggttctttgaatgcagtgatgccataacagaagctccaagttagaccagtttagggcagtaagaataaaagtagccttcaggaaaatgaggaggggaacattagtggtatctgcacaaaagcctcagaatcttcatcccaaatgccacctttgataatgttataataaaaatacttaggaaaaagtttaatgtgtaggaacccataaataaaaatataacacattattgaaacacataaaagttgagcaaataaaagacttattatactcctgaatggaaaatctcagtactacgaagatgtcgatttccttaaatgaatatatgcacgtaatacaattcctattaacatcatagtagaactttttgtggaattaaagataattctggcattcacatgggagataatatgacaataaagacataaatttttattttaaaaaagtattggaggtatagagagactttcctcatcctatgtcagagcatgatgcaaaactgtcatgagtaaaatagtacagcattagtgcagaagagacacaggttatggtgtataatcagagctcagaaacggaccagattgactttaacatttaaaggcagttaatcataggagaaaacattgttttaaaaatagaagatataaaactacaaaatatttttcaaagaaactaaagaagatctaaataaatggaaagctgtaagacttattattactagtaacacaatactcttgaaatttatctacaaattcaatgtgatcgctatcaaaattttatctggtttctttgcagacattgacagtctgatcctaaaattcatgtggatatagaagagacacagaataaccaaaacaattttgaaaaggaacaaagttgcaggactcagacttctgatttcaaaacttaccaaaaagctacagtaatcaagatagtatggtactgacataggatggacatatagatcaatgaaattgaattgagtccagagataaacccatatatatatatctcaattgtttttgtataaggttgagaaaccattcaatgggggaagaatagtcttttaaacaagtgatgcaggacaacttccaaaaaaggaagttggaccctttacaccacatacgaaaaaataaaatgaatcagagaactaaatttaagagctcaatatataaaactattggaaaaaaatataggtgtaaattttcatggcttggattaggaaatggcttcttagatataacaacaaaagcataagcaacaacaacaaaaatagataaattggactgcatcaaaattaaaaacttgtgctgcaaaggaaaccatcaagaaagtaaacagacaacctatagaatgggagaaaatgcttaaaaattgtatatcaaaaaggagattatctctaaaatatgtaaagaatacttacaactcaataataaaaacacaaataaactatcagcaagatatgcaaatggccaataagcacacgaagggatgctttccattagtcattaaaaaatgcaagtcaaaaccacaataagatacaagtttaggctcactgggatggcattagtgaaagagatagtgacaaatgttgatgaggatgtggagaaattggaaccttcatgctgctgatgggaatgtaaaatggtacagacactttagaaaacaccctagcggttcctcaaaatgttagattagatctattatatgacccagaaattccacccctaggtatgtatccaaaagaaatgaaacattcaggatctatatcctagggcaaaaaaatacaaataagaaacggaggccgggcgcggtgactcacacctgtaatcccagcactttgggaggctgaggcaggaggatcatgaggtcatcctcgctaacatggtgaaaccctgtctctactaaaaatacaaaaaattagctgggcgtggtggcgggtgcctgtagtcccggctacttgggaggctgaggcaggagaatggtgtgaacccgggaggcagggcttacagtgagctgagaccacgccactgcactccagcctgggcgacagagcgagactctgtctcaaaaaaaaagaaaaaaagaaatggaacatatgtccacacaaaaacttgtacatgaatatttgttggagaattattaataataaccacaatgtcattaagtagaaacaacccaaataacaacaccccataataataaaaaaaatggaaacaattggtgagtagatgagctgtggtatgcttgcacaattgaatatttgaccatcaaaaggaatgaaggactgatatatgctacaatagagctaaaccttgaaaacattatggtaattgaaggaagacagatgcaaaggaccactctgcatggcaccatttatacaaagtgtccagaacagggaaatttgtagagacaaaaagtagactaatggttgccgaggcttggggaaagaagcaatcagaggaattaggagtgactgttaaaggtatggggtttctttggggatgatgatcatgttctaaaattgattatggtaaaggttatacaactctaaattccgttaacattcgatggcaaattgtatagtttgtaaattgtatctcaataaagtggttagccaaaaaaagaaaaaaggcagtataagacaaatcggctagctaatgtaagaaaaataagtaaaatcagagcacagactcagaacatacaccaaaataaattctaacttgattaaagagctaagtgtatcagtaagtaaatgcaagtagaactatcatgacagtaaagacctttttaagcataaaataaattataaggacaaattaataggtattattataaataagtaaaaattttaagaactgaatgtcaaaattttaaaatttttttcctgtaattgaacccaccttagcacacaagtcttcatttttgctcacagcagaaaaacccaaacttggcagacatttatggttttaagcatagtcatttccggacttaaacccaattgattcaagatttgccctgtcattttttccttctccccagaggtggtctaagttttgtgggagaaaggagggtgatatggttaggctttgtgtccccacccagatctcatcttgaattataatccccataatcctcaatatccccacatgtcaagggagagaccaggtggaggtaattgagtcatgggggcagtttcccccatgctgttcttgtgacagtgagtgagttctcacaagatctgatggttttataagaggcttttccccctttggcacttctccttcctgctgccttgtgaagaaagttccttgcttcctctttgccttccatcatgattttaagtttcctgaggcctcctcagccatgcagatatgtgagtcaattaaacctctttcctttgtaaattactcagtctcaggtatttctttatagaagtgtaaaaatgaactaatatagtaaattggtacagcagagagagggatgttgctataaagatacccaaaaatgtggaagcgactttggaactgggtaacaggcacagactggaacagtttggagggctcagaagaagacaggaagatttgggagagtttggaacttcctagagatctgttgaagggttttgaccaaaatgctgatagtggtgtggacaataaagtccaggctgagatggtctcaggtggagatgaggaacttcttgggaactagagcaaaggtgactcttgctatgctttagcaaagagaatggaggcattttgcccctgtcctagagatctgtggaatgttgaacttgagagagatgatttagggtatctggtagaagaaatttctaagcatcaaagcattcaagaggtgacttggatgctcttaaaagcattcagttttatgcattcacaaagagatgacttggaattggaacttatgtttcaaagggaagcagagcataaaagtttggaaaatttgcagcctgaggatgcaatggaaaagaaaaacccattttctgaggagctgaggagaaattcaagctggctgcagaaatttgcataaggaatgaggagcaaaatgccaatacaatggggaacatgtctccagggcacgtcagtggtcttcacagcagcccctcccatcacataccctgaggcataggagaaaaaagtggtttcctgggctgagcccaggaacttgctgctttgtgcagtccgagcacttggagccctgtgtctcagccatggctaaaaggaaccaacatacaactcaggccattgcttcagagggcgcaagccccaacccttggcagcttacacatggtgttgggcctgcaggtgcacagaagtcaagaattgaggtttgagaacctctgcctagatttcagaggaatgtatggaaaaccctagatgtccagacagaagtttgctgcaggagtagggtcctcataaagaacctctgttacagcagtgcagaagggaaatgtggggttggagcctccacacagagtctccactggtgcattgcctagtggagctgtgagaagaggaccaccatccttctgaccccagaatggtagatctactgacagcttgtgctgtgtgcctggaaaagccacagtcacttaacaccagcccatgaaagcagccaggagtgaggactgtaccctgcaaagccacagaggaggagctgcttaaggccatgggagcccacctcttacatcagcatgatggaagacacggggtcatgtctggatgtgagacatggggtcaaaggagatcatatcggaactttaagatttgactgccccattggattttggccttgtatggggcctatagtcccattattttggccaacttctcccatttggaatgggtgtatttatccactgcctgtacctccactgtatctaggaagtaactaacttacttttcatgttacaggctcataggcagaagagacttgccttatttcagatgagactttggacttggacttttgggttaatgctggaatgaattaagactttgggggactgttgggaaggcatgaatgcttttgaaatgtgaaagggacatgagatttgggaggggccacgggcagaatgatatggttaggctttttgtcctcacccaaatctcatcttgaattttaatccccacaatccccacatgtcaagggagagaccaggtggaggcagttggatcatggcgacagtttccctcatgctattctcatgatagtgagtgagttctcacaagatctgattgttttataaagggggctcttctcccttcacttggcacttctcctctttgccgcttgtgaagaaggtgccttgtttccccttcaccttctgacatgattgtaagtcttctgaggcttccccagccatgctgactgtgagtcaattaaacctctttcctttgtaaattacccagtctcgggtatgtctttagagcagtgtgaaaatggactaatacagaggggatggtaagcttaggcagtttcttcctgactctgaaaaagaggtgtctggtccacagagctgtaccctaatcctctttaactcccccctggggacagttggttacagtccccttgtaataggtcttcagctatcctgcctcagtacatgatcttagtacacacagcatggatgagcttgcaggatttacactgcactgtgcttttttgttccagtgtcctggacgttgcatgggccgtgctgtgaggatgcagcagcgtcacacagcttgtcaacacaacagctctgactccaactgtgatgacagaaagaggtaggggccccaccccagagcagcacacattctctcctgactcactcaggacaatgattataactgcctgaaaatggaatcctttctagtttctaccaactctcataattgacagttttcaattatgatttatttagtgtcatcttcaatagtatatattatactgaaatactagttaatgtgcactatttataactataaattgtttggatgttaaacaataaagggacaccactctatgtggtaaaaggggaaaaggatatcattgagaaaacggagatacttctccctctatatactaagttaatcaagcctaataatattccatttaggcttacagattaaatcttcttaatgcttttaatgaactgctttatttctctgtttagaaaatgttttgattaggatattgtcacagtggttggcagatagtaaaataaactttaatcttgttgaggaggttaaataagggtggagtttgctttcctccttttataaaagtctgagctggtagatggtttagggatagaagagcttttttcatggggtcatccagagatccagatgccctccatctggcagctctaccatccaagagaacagcaccccagccagcagaaagtggggagagagcctagaaggcacactaatcgggggcttgggagttctattatatcactcacttactgtgtgaccctggactgcctagccacctaatctgcaaagtgggatattatcatccatgtgaacttatgtttagaaagttttaatgatttagcttagtgtgaaacacgaggcagcctgggtcatggaagatgctcaatatctggctatttcttccttttccatgtcctgagtcttgctggagaaaatgagatgaccttgacagttggctgggttaccattttgagccttcagtaaggtttggcaatgtagggtcagttgcatttcctattccccacaaagtgatttcaagccaaaaccattctcctcaaatggaaaatgtttggaacggctgctctcattctcaacagacaacctaagtttcctattttcctgagaagatacagaccacacacagattgatatgcatcatcccaggtgctttactttgcattcacaaagatatacttaaagcacaaatacatacatgggtcacatacatatttttctgaaacttgctttttctacctaagaatatattatagataattcccatcaagtaaagattaactttattctttttaattttgtacttaatactctattctactcaatattctatctaaattttgtacttaatattctgttgctaatggacattggatagtttcaaactttttgctattataaactaagcttcagtaaatatcctggaacatatatctttgggtacaaagggtaatatttttatagagtagatttttagataatggaattgaattggtaggaatgctcattttgatgctatcaaattgccatcaaaatttctatgccagcaatatgtgagagttgcccccttttcatcaacatgatataggtttgcagtcttttaaaatttttgccaatctgatggatgaaaatttatctcattgtaatgtgtactttcctgattacttttttatatgattttttattccttatattttttttcttgaactcatcttcattttttcttttctgccaccattacccttggccaaaccaccatcgtatctcacctggtatactgtcacagctgtccaactggtcccccttcatccatccatgctcctttccaacccagtctccacagtacagccagagtgagttttcccagatgcaaatctgatcctaccaccaccacaacccatctccctgctagactaaaattactttagaggttttacttgctcttaggaagattgaccaaatcctcaatgtgacctataaaataccacatgcttggctgggcatggtggctcacacttgtaatcctagtactttgggaggctgaggcaggcagatcacttgaagtcaggagtttgagaccagcctgccaacatagtgaaaccctgtctctactaaaaatacaaaattagctgggcatggttgcacatgcctgtgatcccagctatttgggaggctgaggcaggagaattgcttgaacctgggaggtggaggctgcagtgagccaagatcacaccactgtactccagcctgggcaacagagcaagactctatctcaaaaaaacaaaccaaaaaacaaacaaaaaaacgtgctcaagtcctacttttcttcacagcctcatccattatctcatgctgtctcactcttcatgttccagccacactgtccttctgtcagtttctcagatatgtcacatactttccaatcaaaggtagcaaaaaataagaggcagaaaatgtaatacggaagataaagagtatagaaggatctatcaagaggctcaaaatctgattaaattgggttttagaccaagagatatgaaagtgaaattaaagggtagacttttttttaataatggaagaaaattcctagagctgggggtgagtcagagtggcagggagtcaagttaccattcattttctcttttatttctgtttcctccaggattggctgttctgtttttataacctgatgcttttctttcatggtgttaatattttttcctcagatatctggtggtttatggatgagggatgaagttggttagtatagagagctgtcgagggtttcttctgcagtgttttagcccccttttccccacagacctcttctgctggattggtttatgaccatgggctctctgtaggtaggtgaggtgttagatctcacttttgagtgggtggacagggagcaatggagaccccccatttgccatagtagggcctcaggaaatgttagagagtgttgtagaaggagtagcattagtggcgtgggcagaggatcagtggtgggcaggctgtctgctagtgtttactatatgccctgggaaggttttgggagctgtggcttccattgaaaagttgtagagggaatgggaattgtcagggtggagctagcccagacttatggcaaggtgacaacatggggacctatagaatgctgaggacacagaaagttggtttctcaaagtggcgatttctaacttctgaaatcagaatcacctaggaaatttctgtaaaataaagatgcttgggcctcacctcaggcagtgaatcagaaccttcatgagattgcctggccatctacagcattttaaagctgtgtgcttctgcctgcttcgaataaccaggcaggcttgggatctactgccgtcagaatcagcagttccatctggctgatggtgaaaggagttacttgaggcagaagtggagccagactgaatagaagtgagaaattgaaaaaagctagtagaaacagggttcctttatgatttctgctaccatttctacactcatgcttcatgtagaaaaacacatgaaccccagttatgtgcatagtgcaggtgcccagactgcattcacctggctcaggtgtctctgtcctgagtcctgtccctggccaggaggaagttacgccctctactggacagaccttgctttttatttattatgattttttctactgtatccttagtgagcagcctcttagctttcctgggcttcagcttctgtgttggtccatagctccctgtgcccctctcattctttgtatttagaaagctcaatagtcctgtctgacttcccactggccctgcctttcatcaaagcaaaaggggctgttttacaatcctttgggctagaagcaaaagtcaacttggcatgatttatgcaaaaaagggtgagggatttattaataagacaagaccacccaaaacttgtgcacaataatttggtattcttttaaatatattatttgaatatttgttcaagtttcttcagtggaaggctgatctctatatagggatggttgaggagtactcagtctcttctctgttgttcaaagtgactcaatttttggtccctaagattcatacctactggggaaaacaaaagcagctaacaggacacccacctcttccatatatcgtatgaacagtttggtaggacagcactgtgttaagtaaaccctttgatagagtctcctcctactggctaatgataggattacttccaactacgtgcaatactctcagagttcttggatatcacaaatttctccattttattacatttcccataaaacactccttatggatttatgtgccctgataaggaacctttaatgggataacaaaaatatctcatagaatccaaagggagaacagggagcatgcagtcagacctcaggaaggactacaactaagaaatgggaagtcattgttttttttctcttctctcatctctgcagttctgtgtgtttctgcttcattatttgctctttatgaaaactggtttttttctatatttctggccgatgtggaagaatatagccacctaatactccacacttcaggtttgcatgcctggttctagcaacctccaaatcctaagagaaatacatttcttcaaccagctcaagttagggccctcttccagtcatctttggaactgggaagacactctcaagcagtgcaaatatgtcttcaggagccctgccttagggaacaagggcagataccccaaagtgggcccactaagtttggctctatcctctttagcatgtgtcttttcaaaaatcagagggtattaactttccattctgttttaaaaggcaaggaaatcagagatagattcttattctcatatggtcttcagtagtttctgactgcaagtcttggtgtgacctaaatgtaaaaaagagtacttcttttagcagacaaggttgctcacatagaaagtcatacaccgcagtatgttttgagcgcttacaaacagaaaattgaagtcttgttaatgaatttgaggtggcttattgtagatcattatagtaaataattctcttccttgccaaaattgatttcttccagctagtcaggatgtgtgtgccttgacttggtgttggaagtcagtggaaacacatggtttgcttgccatgccctcttcatcagagcacatctaagcaggcgcactccaccccaggtggtggagaatgttgtcactgtcgttctagcctgtatggcataaaagcagaggaatgtcttggtcttagactctccatccaacctttaatacgtagtatagagtaaggtaaaaaggcttggtcccagcaaaaagttacaccctgcctctcctattttttgtttttccgttttgttttatttttcacttcagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagtacgtacacctcccaggtatctccactgccccagaggccttgatggcatcagatcctgatgctaccatcacggcaccaaaccctgctagtgattacctcatcagtgtcccaactgaggggctattcagaatggatttggtagcttgggacatcaggggatgaactcctttatgtgggtgcagctgcatgttctctagagaaaaggcagttggattagtagcatgccagcatcattggttactgcctttccgacaagcactgtcagtctctccacacacttctcttctgcctggtagtcttacgtgctaagacaaagattccatggatgggcttgggtaggtatgctgatgtcctgaagttatatgtaaaaactgtaggtttatttttctagggagtaggtgtgtagcattcataagtttttcaaggagtccatgaccctgcaaaagttaagcattgctgctctgagaactcaaaggagcagcatgggccagagggactgggagggtccagagagcagcaagaggtcacttggctgagctgaaagggaatccaatgcacttctgactctcatgcaaaacaatggccctaacccaaagctggtttcttcacctcactctgtgatctcaatttatggcttttcataaagtcaaataatttttaattaggtctctaataagctatatgttacagatatttgtttcttttttgcaggagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttat

SEQ ID NO: 37962 - DNA, 835790 bp, Homo sapiens
ctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtgaggcgaggacggcctcctagggacacgagggcggcccggcggcccggatccgcgggccgaggctgcctgggtgtgttggcgtcgggctgagcctggggagggtcgagatggggccccagccgaggactgggatgcgggaggaccgcggtaaggagggtagggggcgggttcaggactgtcggccgcctcccggacaccgcagttctcccaggtggccgctcctcgcggatagggcgggcggggtcggcgcccttacctgggggtggggtagtggctttggcggccgcctcctccagctgtgccctcctgacattgctgcctcggcggctgccgcccgctgctacgctgtggctgctgctggattcgcagtcccagccgccctgcgtccggtgggcgagtggttagggtattttcttacccacacgcaggcttctgtactcgaccatttctctccctcgcccttcctcttcctccgccgagcactttgctcggctcctgctgttgatgcttgtggttttgcagtttgggatgggatgcgttccgggcagatccctacctgtagggaatgccccgcttcaaagttgacctcctgagccatgacaaacacctccccccaacccccacccaccttgtgagtgctcagtgtcctgataactgagtcaaagtttctgagactgggctagtactttgcactggtcgccaacggtacagggctgggcagtgcgtcagcatgtggaaaggggccaccggctagcgggaggtggccgggtgcatgggagctgaactgacgggtttcagatactaggcagtgtgtccaggtccttggatctctcagatagggttatattagaatatgtaccaaaacttgggtggtcacttgcaaaattggtttcatgcaagtaaactgaaatgccagccttattacactaatggtaaggagaacttttgcttgcctgacagatttcagcgcagtttggaaaatgattttaaggcctttatttttggcactggaggggtttagggatttttaatacatttaaatttcctcgtgcatagtgggaggtaagtagttgcttgttaaaattctgaaaacacagtttcatgaaaaccttctgacttttcttacagtagtgtttatatttggcatcttccgtagaatatccattagttatgatgtcagaagatacggatgtgaagtttgctttttgtgatcacattggaagtggattttgttcatggaaaatactggttcacaagctcctagtactagaaaactggcctgtgattcattttctcagtagagcgtcccttatgaaattgacaatgagatttctaaggagaaagactagttgaactttatgtatacattatcatcaaattgtattaaatgtacacctgcctgaggggttagctctagactttgagttagactggtgtctatactaaatcagttcaataaatgcgctgatattatgtattattcatttggagagaagtagataaagcagggcagagtttatattttaacatattatgtagcctacatttgctctgatgtgtattattattattattattattattattattattatttttgagacgaagtttcgctcttgatgcccaggctggagtgcaacagcgcgatctcggctcaccacaacctccgcctcccgggttcaagcgattctcctgcctcagctttttgtgtagctgggactacaggcatgcgccgccacgcctggctaattttgtatttttagtacagactgggtttctccatgttggtcaggctggtggaactgctgacctcaggtgatctgcccgcctcagcctcccaaagtgctgggattacaggcgttagccacagcgcccggcctctgatgtgtactagtaagtcatatggggagaagtagatgaaatagggtagagcttatatgtgaacatattatataacctacattgtcctctagaaagctggaaacaagttagtaagtctcagtactattggggcatatggtgaatatacaaaccaacctaaaaaagtgtgactgtaaatagatgaagtttgtttgtttcttttaaagagacaaggtctcgctctggcgcccaggctggagtgcagtggctcagtcctagctcactgcagccacgaagttctggtctcaagagatcctcccacctcagcctcctgagtagctgggaccacaggcacatgccaccaaacctggctaattttttgttttatttttgtagagtcaagggtctcaccatgttgctcaggctagtctccaactcctggcctcaggcagtccttgcgcctcagcctctcgaagtgctgggattacaggcctgagccaacggtgcttgtcccattttttttttttttcacctgagttatttgatgggaatttctatatattacagttgcgatgttctgagaatttttgtttctttgataattgtttcatgatttagatgttttctttttacgctggtagttatgatttttttttcctttgaatgaaagaattttattaggcatgtgaaacaggagttttcatgtgatcagctctccagttctaaatttgtgacttttaaaaaacttgaatttttttctttgccttaacccaaacttgaatttgctcagccattgtatatttatttgaactctcagatgatacagcattgaagcagaaagtccttttatccatgcttttggagtaatcaaaagaaggaattctgttgtgccaagtaaaaatatgtgtgggagatagctaggcttcaagagattgactttgaagagagtagtggctaagtagcaaaaatttcctatattgaaggtgtagaagtgggcctgcattccaacctaccattgtcttcaagtggggtatggatcattatgactggttagagggggtttggagaatgaagttgttgctgtaagcctatgggattcccaggcacagagcttgcttatgtcttaattttaatgagttctatatttttataactcttgacttatataaatgggtcagccgttgagtctgaggatgaccagcagcccaaggctattccaggtgctggtatttctttttttttttttttctctttctgttttttttttttttttttttttttttaattatactttaagttttagggtacatgtgcacattgtgcaggttagttacatatgtatacatgtgccatgctgggaattgaacaatgagatcacatggacacaggaaggggaatatcacactctggggactgtggtggggaggggggaggggggagggatagcattgggagatatacctaatgctagatgatgagttagtgggtgcagcgcaccaggtgctggtatttcaaagatggctcaggggtttcttgtggagatgatctgatgagcattttgccattacaaacagtggaggcggagaaagtacggacttgagcctgagttatggtaaaacatactcatttttaaaggagagttttaatgctgatattatagagaaagacattgtttgactcctagactttcagaacgggaaataattttgactttatagtcagtatttgaattgggtataagtatgtgaacatcagtggaccctaataaggaagagttaatgaattaagaagagcttgcatctctgaacatcttctttttatacttcgtttacttcccatattgctcttattcaacagatgggatggcataattgggtatacgaagtttatgcgcatgctaactcttttttgttatcttttggtgttttttggtgtactttttggggattttcctgggaaagttctaggcatatattcagttgatttagagttagatttgggctaagattattagtatacttgaaattctgagccttcttattttctaaatagcttttaaagtagaaaacatttgccagtgctgttgggcttaaaaaaaaaaaaaacccaacaacaacacaattctttataaatactcatgaaaaatctggttacaggctgtgttgtgatagacatagtacagccaaaaatatatttaagaaaattctcacccagtttagtaagcttaaataagaggaaaataagacagtttttttttttaataaaaggctgattttcccagaatatgaagcctaacaactgtttgctgtgttattttccctgttgcctgttctaaattcagcaagaactatgcatccctagtccatggtaaaagcttagttccagtaggtgattcttagtaatggaagtctcattgagggatgcaagggaatttgattgggaaacatcaggcatggaacatttactttttactgctctaattttctgtgtatctgggtattcagtggggtgggaacatgagcacaaatactagaattatctggattttttttttatactatggatttcctcctcttaccccctacctgccccccaacccattgctaagtgagccattgatagtaggagtgtgttatatccttcaggtatgtagggctgaacaaatgctaaaaaccttggcacttggctgatattccataaaccaaattcctgctctgtgtaatttgccttctggtgatatcagtttgttactcccatttttgaagaaaaatatgaattgtggtgaagagacatctgtaaccaagagtaagatttatcaaattatgtagtatacatgaaggacaccaggagattgtttacctgaacatttattaaactcatttgactgtgacccacaataaaaaatacattttactacttgattccgcaagcgcacacacacacaaagttgaaagtttggtgaaataatatttatcttttcagggccctactgagttagctataatggcttgcaagaccagttgtgcatatttcttcctatctagctctttgtccagtgacatcatgttggtagctcaaaattggtcatggtgggaatatttacaccaggaaattcagcaaatggtattcttagggcttccctcctcataggtagttgttaaacatttatagcaccccactgcttataacacacattgatatattctgttatttcatttcattttaaaaatgctgggttttgacttccaaattaattttacacccagctaatggattatagcctacatttaacaacaaatacaactagtttagcctaccctcttaactttgtaagtgaaggaacatactaagagcctcaaggccaaggtcagatagtgagttattagcaaagccagggctctggactcaatctggagttgtttctggtgggcttctttcctaacctcacttagtgtgtataagggattgtgttaatcagtttgaataaagatggaccttgaccctgaggactttatgcttaggtgggggattaaatatggaaacaacagtgataatgaaaggcagaaagtaatgggtggtaaaaagataaagataaggaactataagagtttagagaggagggagagattacttttatttttgtttgtttgtttgtttttcgtttttgacccaggctggagtacagtggtacaatctcggctcactgcaacctctgcctcccaggttcaagtgattctcctgcgtcagcctccctgagtagctgggattacaggcgccaactgccacaccaggctaatttttgtatttttagtacagacggggtttcgccatgttggcccggctggttttgaacttctgacctcaggtgatccatccgcctcagcctcccaaagtgctgggattacaggcgtgagccaccgtgcccggtctacttttagttttaaggataaaagaagaggtgacatttgaactacttttttttttttttttaatttggagacagcatctcactcccgttactcaaactgagtgctgtggtgccatcacagctcactgcatccttgatttcctggcctctaacagttcttctgcctcagcccccaagtggctgggactatataggcacacaccaacatgcttggctaatttttcattacttgtagagacggggtctcattatgttgcccaggctgttcttgaacttctggactgaaactgtcctcctgcctcggcctcccaaagtgctgggattacagttgtgagccaccacgcccggcccctgaactatgctttgaagaatgggtaggatttggacatgtggaaataggacaactagtatgagagaaaggcctttctgggccaggggccagggtgatcaaaggcatacaagcatagacagggaaaaatgagtagtgaaagagctaggcaagaaagagtccgttagcaccagatggttaagagcctagaatgccagttttcctttctgcttttcagtttatctttcatttttgactctggagtaatctagtacttcttaacattgaacaggatttatatgttatgattaaaatatgatccagagagcacataagtatccttagagtagaagctgaagggaaaaattattagtgttagagaagcaaccttgagtttaccaatcctaaaagtgttggaaagtgaaaaatattttatttgtaaggagagacagtgttttttttttgtttgttttttgtttttcttcattagcgtcaaattggctgtagtagaacaggaagcagttttgaaagtctttacaagggccttctaaaatgtgatttctaaatgactggatcttaatttttggaggcaggtttagttcaggcagaagggtagtttatacagatctgcagctaagctgagtagcttttagaatttagggcagcaaagcagggtattttatacaaaatccacttgtaaggaattgatggcttctttattccaagaattttcttagatttcagcatttatgtctttgacagcctgtatgactgaagatgttttgaagtcttggatggaacttgccttgtttcacaggggaattgggtagctagaaatgaaggtataaatgccagtaagttgtgtctgttaatcaagttgaagtactggtggcagttctcaagcttttctgtctgctgatgatttcacacttactgcttctaattaaatagtgtgtagtcgatttgaagaagccttgcttctctttgacccaccagttctgtaaaggtaaaagccttcttagagtgttgcccaggtaacaacacatacagagactgcttaatagctcatcatggaagtgtgtggaaaattttggaaatgttggtaaagaagttgctatagtaaataactacttggttggtaaaaagctgggctacttctggatagttgataaagagtttttgagatgagccgtggttctaaaataaatatgaattgtgtcattgccacacgattttcttcagttatgtaagctcctaatatgtaaatgttgtcctaccattttagaaggtgtcagcagtttcatgtgacctgttccacaatatagcacaccccaaacaccacgataagagttcaaatatggcatggcccagatgcctcacaccagttaaatgataaagctaatcatgtcagcacagtgtttctgttaaagttttttccccctcttttttgaggcatgttagttttcacgaattgaggttattagaatctttccagattttctgccaccattttttttgtgtgtgtggtaaaaagtataatgatggtgcccttaattaaattatgtaaacatttgtaaagatatacacgcatacacatagtgtgcatatatgtatgtgtagacatacatacatatatatttacatatcattagttcttggaatttgtggtgaaaatacacccacctggcaaatggttgaaaacaagtgttctagctctttgaagactaccatgtgagtattcacaaatatgaaagtaatgcaaacccaaagggagtttttgtatgcccaatttcaagaaaggagcacattttaaaaggcaagtatggaattcattcatataccagtgaggaatttctcaacttctcctttaccccacacatacacccgtttaccattctcattattagcagtaagcaaaattagaagactttaagaatcagacttctactacaagtgatgcaaataaatattatttttagaaaaaatacaaacctgtggttttgagttatgaaggtttaagagacacatatcactagttttttttataaactacatggagtgttttctgtgcttcaagatgtcgtaattgtcattgtgaggccttttgctgagagcattgtataaaggaatagttgttagaatggttattaggtgtttctttgaatagtttatttttctgtagtcaatttatcttgcatacattgatggccgggggtggtggcccacacctgtaatcccagcactttaggaggccaaggcaggcagatcacttgaggctaggagtttgagcctagcctggccaagatggtgaaaccccacctctgctaaaaatacaaaaattagccgaatgtggtggtgtgtgcctgtagtcccagctacttgggaggctgaggcacaagaatcccttgaacctgggagatggaggttgcagtgagccaagatcgtgccactgcactccagcctgagctacagagtgagactcggtctcaaaaaaaaaaaaaaaaaaaaaaaaaattgaatagagtatactactttagtgaaaaattgaccattgaaaaatcaaccattgaagggaggttatatatatattggcagacagtagggtttctgaagttgttttagaataattttgttattgagcagctgttttatcaccagacctcattcatttattattgcttttttccatttttttttaaatctcatgaactgtattctttcattttaaatctctcatatttgccctgaagtcagtggtcatatttggactaatgttttgatttgctgttgtctgcgcaaagatctattaccaagttgcatgatcaagttggtattgaatggtaattcagttaatgtcttcttctctccattccttttttccttctgtattctagaagttaccttaacactagtgtgagattcctggcaaagttaatggggaaatgaaattaaatattactgttattcaaatcctagggtgacctttttgccaacactaatgaacatagaaaatttttcagcatgaattatgcagcttaaattttcactgaggctaggcctcttaagtttaaaaaattaaaagttaaaaaaatatttatggggtacaagtgcagatttcttacatgtatagattcttacatgtatagatgtggtgaagtctgggcttttagtatacccatcacctgaatatccaccattctgtatgtccatgtgtacccattgtttagctgtcacatataagtgagaacatgcggcatttgactttctgtttctgagttattttacatatgataatgtaggcctcttaagttaaaaaacattctgacatgcattttatagttcttgtcaacattatcaatagctttgatagatgaaacaggtttctcctgttgcagttggtatcacacacaataaattagccatccctaccatttgaaaatataaaggtgttttttttttttgacacggagtcttgctctgtcgcccaggctggagtgcagtggcatgatcttggctcactgcagcctctgacctctgcctcccaggttcaagcaattctcctgcctcagcctcctgagtagctgggaccacaggcacgtgccatcatgtctggttaattgttgtatttttagtagtattttcactatgttggccaggctggtctcaaactcctgaactcgtgatctgccagccttggcctcccaaagtgctgggattacaggcgtgagtgactgtgcctggcccagataaagtttttttaaaagataatctagtaatagtaggaaagagaaaccagtttatcagttaatctaatacttcctattttgaatataaatttcattgtgttgcatggtaacttcattatgttccactgagtatttacttttctaaagacagacctttaacaatttttcctttttttcatgttttggagacagggtatctctctgttgcccaggctggagtgcagtggcacggtcatagctcattgcagcctcaaacttctggtctcaaagcgattctccaaccttcgtctcaggagtagctggtgggactataggactgtacccaccacactctgctaattttttaaatgggagtctccctatgttgcccaggcaggtctcagactcctgggtttaagcaatcctcctgcctcagcccttccaagcattggaattacagatgtgagccactaaaccctgcacaatttttcaacttttgggaatttcacttagaggaggataatagtagcttttagacatttttatcagttatccaagggtggaaaaaaatacttaaaatgcaagtaactacaaacatttttggttttgtgggagacagtgtagatagaacatagaaccttaattcttgatctagtgctgctgtgaaattcagagagaataagtaatttagacacaacttctttctcctctttgcacattaaccatgagctaatattgagtgtttacatggggtagttattacataagaaaatgtacattatctcgctaatcttcacagtaaccatatgaggtaggaacgattataatatcatctccagtttgcaggtgaggaagcaggattagagaacttcagtaacttacctaagatcacatagccaggcgccgtggctcatgcctgtaatcccagcactttggaagtccgaggcgggcagatcacgaggtcaggagattgagaccatcctggccacatggtgaaaccccatctctactaaaaatacaaaaattaaccaggcgtggtggcatgtgcctgtaatcccagctgctcgggaggctgaggtaggagaatcgcttgaaccagggaggctgaggttgcagtgagccgagattgcgccactgcactccagcctggacagagtgagacgctgtttcaaaaaaaaaaaaaaaaaaaaaaatcacgtagcttgtgagaggcagttatctcttgcttctaaatctgtctcacagtgactctctactactactctgtattgacaatctttaaatgggatggtacttgttttgcacatttcataggatagttatgagaatcaaaaaagataagatgtacaaaagaacacacagatgtctctggtgtattcattttattggataatatttgagacaccaaagaaatctttgaaatcttgtacacatatttgtttgtaatcagtaatgctataaaataagttgaacagatgaatatttgaaaagttatctataaagacatattttgtgtgggttcaagggatctgtgagtgaaaggtagaggaatgcagaaatgtagggatgtattataaaaagtggatcagatgatctctagcagcctgaattctttctgcaatgaggagtatatgtaaataacaggtgacctataagatccttccaacatcaataatctatgagtctttgttatgggttacttattttctgttagaatatcctcaaattagcgagatatgcccaaaagagctttttaattttattttagcttagatcatcaataatcaccattctttctttgtccatttctaaaattgtttatatttaaggtatacagcatgttttgctatacatatacaaaacatatacagatacaaaatcatgaaatgatttttatgttttgatacacagatacaaaatcatgaaatgattactacagttaagcaaattaacctatccatctccttctataatttttaaaattgtggtataagcatctaaaatctgtcttagcaaattttatatatactatacaatatgaataattatagacttcgcgctatacattagctctctagacttattcatcctacataactgcgagtttgtaccctttgacctacttattcccatttcgtccccctcctttcccctggtaactgtggctatactcttgtttctgcgtattcagctttaaaaaaaaaaaaaaaaaaggatttcgctgggtgtggtggctcacgcctgtaatcccagcactttgggaggccgaggcaggcagatcacgaggtcaggagttcgagaccagcctgaccaaaatggtgaaaacccgtctctactaaaaatacaaaaattagccaggcatggtggcatgtgcctgtaatcccagctatttaggaggctgaggcagcagaatcgttttaacccgggaggcggaggttgcagtgagctgagattacaccactgcactccagcctgggcgacagagtgagactccatctaaataaataaataaataaaaagtaaaaaaaaggatttcatatataaatgagatcatgtagtgtctttctttttgtgtctggcttatttcatttaacatagtgtcctccaggttcatctatgttgtttcaaatgacagtatctcctttttttttttttaaggctgaataatattcccttgtgtgtgtgtgtgtgtgtgtgtgtgtgtgtgtgtgtgtgtatatatgccacaaattctttatctgttcatcttaggacagacacttaggttgtttccataatctaggctattgtgaataatgctgcaatgaatatgtgaaagcatatatctctatgaggtgctgatttcagtttctttgggtgtatacccagcagagggattgctggatcataggcagttctatttttaatgttttgaggaacttctataccattttccgtaatgtctgtgtagcaatttacattttcaacaacagtgtacaagggtttccttttctccacactttggccaacacttttgtctttttgataatagccatccaaacaggtgtgaggtgatagctcattgtggtttcgatttgcttttccctgataattagtgatgttttcagtgctttttcatatacctgttggccctttgtatgtcttctttggaaaaatgtctctttaggttctttgcccattttttaattgggttatttcgttttgttttgttttttgctgttgagttgtgagagttccttatgtattttggatattaaccctttaccagatacatagtttgcaaatattttctcccagtccataggctgccttttcattttgttgtttgttttggagaagctttttagtttgatgtagtcctacttatttatttttgcttttgttgtttgagcttttggtgtagtatccaccaatatcattgccaaggccgaacaatatcagggagcttttcccttgtgttttcttctaggggttttaaggttttattatagatattagtgtttacttctttaagctattttagcaaacattctttaaatgtcagttgcacttagattgaatataaatatataattatctgagtaagatgcagctatggtgttttgctttttcccctccaagttaaaaagattttttttttttttttaagatggagtctcactcttgttgcccaggctggagtgcaatggcatggtctcggttcaccgtaacctctgcctcccaggttccagtgattctcctgcctcagcctcccgagtagctgggattacaggcgtgcaccaccatgcccggctagttttgtatttttagtagagatggcgtttctccatgttggtcaggctggtctcaaactcccaacctcaggtaatctgcccacctcagcctcccaaagtgctgggattacaggcgtgagccacagcacccggctgttaaaaagattttttagaggatggggtgggtgaagtggcttactattacattattacatacttggttcttaatgcatttcttatgacttcctctcaaatttggatttcctgagtgtgcattttgagaagaaacttaatatcattatatatatgaaaggtcattttaattttatgtagtaagtttatggctttttatacagttggtttcattctctgtcgtttttttttcaacaagtatttatttataaggtagaatatgggttttgtgctggagaagcagagatgagagattgttgaagagctgacagtcttattggggaaacagatgaatagagagtggcaaggaaggggcaccacaaggtgtgtcttcagaaggatatgtaaactgatctgggtttcaagtaaggctgtctggaatatctgagttgagtttatagaaagcaagagggatattttagatataggtatgaaactttgaaatagtaagtctttacctatctagactcagtggcagtacctcatctctctgaaacattacaaaagcccccaaatagttgtcagtttaataagaaattctttataaataaagctctttaggctgtcgctgagagcttatttttactttatatatgatacttaaggtttctaaggttgtagtagattaaggaggaataatttacaagcagcaagatgctgcaataaacatactgataacaagacagatttctgacaacatgatagcaatgaagaaattggaaaaaaaatacacacacacacacacacacacacacacacacacacacaactgaataagtcatagataatacaaggaaaacatccttggacaactaaattagctttaagggtatcaaatgtatttgtaatactatagaataataatgaaagtttgctgtgctctctgttaccaagaagacatgaaatatatgtcctgtatagtatatatattagttaggattcttcagagaaacagaaccaataggatagctatgtgtagatacagatctgttggaattggcttacacaattatggaggctgagaaatcccgtgataggccgtctgcaaactagggaactagggaaaccagtagctcatttcaagtccaaaggcctgagaaccagcagagccaacattgtattaggttggtgcaaaagtgattgaggtttttgcaaaataactctcaattcgaggctgaaggctgaaaaactagggggctgctgatgcaagtcctggagtccaaaggctggagaacctgaagttctgaggtcagagggcaagaaagacaaatgtctgagctccagaacagagagtgagtgaatttgcccttcctctgcctttttgttttatcttatcccccagcagattggatggtgcctgcccacactgggtaagggtagatcgttcttactcagtctattgattcaaatggcagtctctttgggaaacaccctcataggcaaatgcggaaataatgcttttactagctatctgggtatcccctagtttagtcaagttgacaactaaaactagctatcacagtaaatttatgaaggtgtcaaagtatttatattactaagatttttaaaatatgaaataggatgaaaaccagggggtaaacttagtacagttatcaaattgtttttttcagcatgattgatttctaaaaggctttgaataaccatagatttaattttcttgtatatgacacagaccagtagattatggaatgctagacattgttcagtacaatattatataactgtagttagaaattacttagataccagagttatggttcttaaccacttgggtaccaagaatttttagagagcatgaaccatgtcgtctttttgttctggatggcatgaagttggggtctgagcatagatatcatcttaaaaagcctttcttgagactgtggtctctgttagaaatctctcatttgtgcttttaaagcattcagttttcctctttgttgtcatactaatcacattgtattgcaacttgcctgtttctgcattagactacaggctttcttttttctttttttttttttttgagacagagtcttgctatcttggctcactgtaacctctgcctgctgggctcaagcagttctcctacctcaacctcctgaatagggactacaggcacgtgccaccacgcccggctacttttttttttttttttttttgagacggagtcttgctcagttgcccaggctggagtgcaatggtgcgatctcagcttactgcaacctctgcctcccaggatcaagcgattctcctgcctcagcctcctgagtagctgggattacaggcacccaccatcatgcctggctacattttgtatttttgtagaaatggagtttcaccatgttggccaggctggtcttgaacgcctgacctcaggtgatctgccctccttggcctctcagagtgctgggattagagacatgagccaccgtgcccagccagtattacttaattcttataatagtcctgtattactaacagtttagcgagaagacagcattgttttagattttgcaaacctgtgtaatgtctggctttgtagaagacagacaaattctcatatttgtcactgcattcaccctattgcagtatgctttttgggttgaaatatccaaagaaaagctggcctcatatgtagcttgtaaagggaggagtattttaatagtcttttaaggtaatgttgatatttttctttcatatcacaccagaattctacagttggtagttttatattaatggttagttgccatgtaaaatcttacatcacattaatgaactttttgtaacctgttacatttaaaatccactggtctgtcttgcagtttgaatggatcttttatctatgtgtaattttataactcgtcatttgtaaggcattggttcactgatttatgcagatctttataatattggcacatcttattatacaatataaagaagtcaagctgggcatggtggctcacgcctgtaatcctagcactttgggaggccgaggcgggcggatcgctggagcttaggagttcaagattagcctgggcaacatggtgaaacgctgtctctaccaaaaatacaaaaaacttagccaggcatggtggcacatgcctgtagtcccaactacttgggaggctaagatgggaggatcacttgagcctaggaggcggaggttgcagtgagctgacatggcaccactgtactccagcatggacaacagagggagaccctttttcagaaaaaaaaaaaaaaaaaaaaaaaaaaaaaaaaaggtcaacatttgttaatactgccatcagtgtcatcagaaaagtcttctaagggctgggcatggtggctcacgtgtgtaatcccagcactttgagaggctaagtcaggcagatcatttgagtcagaagtttgggaccagtctgaccaacatggtgaaacctttactgaaaatacaaaaaaattagctgggcatggtggtgggcgcctgtaatcccagctactcgggaggctgaagaaggacaattgcttgaacccaggaggtcaaggttgcagtgaactgagataacaccactggactccagcctgggcgacagagtgagaccctctctcaaaacaaaacaaaacaaaaccaacagtgtaaaacgttcctgtttctccacagccttgccagcatctgttggttcctgactttttaataattaccattctaactggcgtgagatggtatctcattttggttttgatttgcgtttctctaatgaccagtgatgatgagctttttttcttatgtttgttggccgcataaatgtcttcttttgagaagtgtctgttcatatccttcgcctacttttgatgggattgtttgtttttttcttgtaaatttgtttaagtttcttgtagattctggatattagaccatagttagatgggtagattgcaaaaattttctcccgttctgtaggttgcctattcactctgatgatagtttcttttgctgtgcagaagctctttagcttaattagatcccatttgtcaattttgggttttattaaaattgcttttggcgttttagtcatgaagtctttgcccatgcctatgtcctgaatggcattgcctaggttttttcctagggttattatgattttgggttttacatttaagtctttaatccatctttagttaatttttgtataaggtgtaaggaaggggtccagtttcagttttctgcatatggctagccagttttcccaacgccatttattaagtagggaattctttccccattgcttgtttttgtcaggtttgtcaaagatcagctggttgtagatgtgtggtgttatttccgaggtctctattctgttccattggtctgtatatctgttttggtagcagtaccatgctgttttggttactgtagccttgtagtatagtttgaaggcaggtagcatgatgcctccagctttgttctttttgcttaaggttgtcttggctatatggattgttttttggttccatatgaaatttaaagtagttttttctaattctgcaaagaaagtcaatggtagcttgatgggaatagcattgaatctataaattactttgggcatatggccattttcacgacattgattcttcctatccgtgagtatggactgtttttccatttgtttgtgtcctcccttatttccttgagcagtggtttgtagttctccttgaagaggtccttcatgtcccttataagttgtattcctagttattttattctctttgtagcaattgtgaatggcctgatttggctctctgcttgtctgttggtgtataggaatgcttgtgatttttgcacattgattttgtatcctgagactttgccgaagttgcttatcagcttaaggagtttttgggctgagatgggtggtggcagtataaattagttcagccattgtggaagacagtgtgtcaattcctgaaggataaagaaccagcaataccatttgacccagcaatctcattactgggtatatacccaaaggattataaatcattctgccataaagacagatgcacacgtatgtttattgcagcactatttacaatagcaaagacttggaatgaacccaggtgcccatcagtgatagactggataaagaaaatgtggcacatatacaccatggaatactatgcagccataaaaaagaatgagttcatgcccttggcagggacatggatgaagctggaagccatcattctcaacaaactaacaaaggaacagaaaaccaaacaccgaatgttctcactcataagtgggagttgaacagtaagaacacatggacccaggcaggggaacatcacatactggggcctattgggggttgggaggcaagggaagggagagcattaggaaaaacaggtaatgcatgcagggcttaaaacctaggtgacgggttgataggtgcagcaaaccaccatggcacatgtatacctatgtaacaagcctgcacattctgcacatgtatcccaaaactgaaagtaaaacaaacaaaaacaaaacaaaacaaaacaatcccagaaaagtcttttaagtagtgtgaggctgttaagctagtttttttttattttttatttttcaagagacagggtcttgctgtgttgcccaggctgtactcaaactcctgggctcaagcgatcctcttgccttagcctaagctgatttttttttttgcttgaagctaaaattttatcattggcaacaaatactgtcagttgttttcttcgaattgactgtgttagcttgttccattgagagaaaatgtcttccaaatacccaagtccttacaactatagtttgtcagttagttgttctttaaagtaaaaatggtactctgtgaagaaaatggttaatttaacttgccactcaaacaattgcacaagtgcattttcttctgaaaactattatactttggtgtgcagcagaaatactttgtgtatttcctactttgtcacatagaatgttaaaaagatgtgtgctcaaaaggttggagataatttttactgtttcattaaagacagtcttagcacgtgcacacacacacacacacacacacacacacacacacacactttttaactgagcatatatggttgtacagtgactaccagtatactttggtgctgctgtttcatttgtgttaagacaccagcaatcttacccaccattgcttttgcatcatcacattagcacagtgaaaaaagcaaataatgtctcagtattattaggaaaattgctctgaccttatgaactctctgaaagggtcttgggggacttctggggtccatggaccacactttgggaatagctggaatagagcaagccctgtataagcccagcaatttgttgttcaatgttactttttcatcttatgtatgcatttaatgtagaaaataatatgttagtagtattcaagaatttggacatttgttaaagtctcagaatatattccttggagatagcaagagtatgctggagcaaacattttttaaataacttcattgaaacatgttttataatgcatattcttaagactcttcttcctaaaaggaataaagaattagttgagatttccataagggatacctttatatcagttgctaagttcagggtactgatcctgtataagaatagcttccaattcagatctataaacaacaaaatagtttagtgaaaacacacacacaggatttggagtggcagagaactagtagttctagagccagacagacctggtttgaaccctgactccactgttgtaaccttgggcaagttggtgtgaccacactgtcatttcttagcactctttactgccgctttatatgttcttgaggtctttcattagtactagaataatgatacaatgatagtgatgcatgtaatcatgacaattggaaacttgctatttcctccattagctaaaatttgaaagccataattgataaactttgcttaagttgtacatttttttgagataaggtctcactctgtcacctaccttagagtacaatagtgtgatcatagctcactgcagccttgaactcctgggctcaagggatcttcctgccttagcctcccaagtggctgggactgaaggcatatgccaccacgcctggctaattttttatatttttttgtagagacaagatctcgctttgttgcccaagctggtctcgaactcctgggcttcagttatcctcgtgccttggcctcccaaagtgctaggattacaggcatgagccaccgcatctggccaagttttacttttattttgtgaaaatagtacctggtagcctctgaataatatatatttcttgttgtgttttaaaatttgcttatttgtgttcatatattcactcttgataatttaataattattaaaacactctgtgcctggtacttgtttcatgctttacctgcattatttcatttaagatcaatatgtgaagtgggcacttctcttacatttaattcacagacgagaaaacagaggatacagggagattgagtaacttgtcctatatgatatggtttataagtggcagaactgagatgtaaactcttttctattaggttcttttttgctacaactaacaccagaaaagtagcttaaacttaggatgtatataggttatatgccagtactaagccatattattttattttgatttttttaaagagatgaggtcttgctgtattgtccaggttggtcttgaattcctatgcttaagtgatcctctcactttggtctcccaagtagctggaattatgtgcatgtgccactgtgcctagctactaatcattttatacaagggtctttctttttttctttttttttttttttgagacggagtcttgctctgtcacccaggctggagtgcagtggcgtgatctcggcccactgcaagctccgcctcccaggttcacgccattctcctgcctcagcctcccgagtagctgggactacaggtgcctgccaccacgcccagctcattttttgtatttttagtagagatggggtttcaccgtgttagccaggatggtctcgatctcatgacctcgtgatctgcccacctcggcctcccaaagtgttgggattacaggcgtgagccaccatgcccagcctgtacaagggtcttgagcatcatctgtggattttggtatccatgggggatcctggaatcaagcccccacagatactaagggactgtaaccaccattagtagggctgtgaagagagagtatgtgtgtaaggtcactattcctgagcatatgccagtaagggagacagcttaaacaaattaagggctctgccaacagaaagaagggaggtgggtaggaatgattatttacataggtaacaaagagtgtctgcacctttgtgtcttttaactactactatactgtactccctccctaatttaagaagatattttaaaatagcataaatgagggagaaatataaatggtaataaatttcaggatagaagaaatcctatggagatttgacagttacagtggttaggtagtctaagttctgatgcagatggataagtaatacagatcatgttaaaaagcaactttgggttgaattaatataactgtgtcctccgtggactgttgagtaaccacttgctttacttaaccctaattggcttcatattaaataatttggtttagctgtgtagtttcagggctatgggaagaaactgaggagattcggggaaaaaaaaatgaaatatgcattaaggagatgaagcataggctttctaagctaattaccagaattagtggaatttctctgtattttggttgagagaaagttagtaagtgaccttaatagttttcaagcttgtaaaatttctaagtcgaaatggttcttgtctctcccaccccttcaattcctagaagacgaaattgagattatcataaaatactttggttagaggtaaagaacagctttctgactgtagaggttattaaacactggatctcaggggaagagggccagctgtaggttttagtcaaaagatgaagtgaaaaggcaagacccataaatcacaaattatagtttaagcagtgaaattatagtttaagccatttttgaagctgttggagttgggacataattctgagtctgaatatttccacagtcaagctcctgaaggtcctgcctcccatcctatcctctctccccacttgagtgaatctttgttagcatttaagacttttacttccccccgtaaacagctctacaacagtgtagaatgtaaaaaattagaactgcaaatatgtgttgccctgacaaatacatcaactattttgattttctttcatgttgcctttctcagtatggctatttaaagtttcttaagacatttttttcccactaagttatttatatttattatagaaaaccagaaataacttctgtgaacatgttgtaatatttttctaaagctatttctttatatgcatgtgttttagagttgtgtgattctgtagtttcataacagcatgcataataacactgagttataatagttcccttattatctctttcctattagactgtgagcccctttaaggcatatattattgttttcatctttatataccttgaaaagttgatgtacttcacataaagatgaggcgagagttgtagatacaatttgtatattttcttgatctattattagcattttcttccaaattttattaaaatggatgccaataaaaacagatacattattcaactcactcttttgcccaggccctgccgtggtgaagatcacggctcactggggtgttgctttgttgcctaggttggtctcgaacttctgggcttaagtgatactcctgccttggcctcccaaagtcttgggattacaggtgtgagccactgtgcgagccgctgtaaccggcctaaagatatactttattttttaaagcagttttaggcccacagcaaaactgagcagaaagtacagacagttcctgcatacccctgcccttacacaacgtgcacagccttccccactatcgacattcatacatcagggtagtaaatttgttacagctgatgaacctacttgacacatcatttcttcaccttaagtctgtagtttatattagatttcactattgatgttatacattctatgggttttgacaaatgtatagtgacgtgtgtccaccattattagtatcatatggaatggtttcactgctctaaaaatcctgtcttcagcctattcctccctccctggaccctagtttgtcttgcctcaatacttttgccttttccagaatgtgatacagttgagtcacagaatatacagccctttcagattggcttttttttttttttttgagatggagtctcactctgttgcccaggctggagtgcagtggcgcgatctcggctcactgcaagctctgcctcctgggttcacgccattctcctgcctcagcctcccaagtagctgggactacaggcacccaccaccatgcccggctaattttttgtttttttttagtagagacggggtttcaccgtgttagccaggatagtcttgatctcctgacctcgtgatctgcccacctcggcctcccaaagtgctgggattacaggtgtgagccaccgtgcccggcagattggcttctttcacctagtaaaatgcatttactgttcctttgtgttttcgtggctttgtcactcatttcttagcatggaatagtattacattttgtctggatgtaccacagtctgtctgttcatctactgaaggacattttggctgcttgcaaggtttgacagttatgaataaagctgctgtaaatatccatgcgcaggtttttgtatgaatacgttttcaactcatttgggtaaataccagggagtgcaattgtggggtcatatggtaagactgtgtttagttttgtaagaaaccatcagactatcttccaaagtagctgtattattttgcatccccactagcagtgaatgaaatgacatcataaatttaaattcacttaaaatgtccaaaacgaaatctgtcagcatttttaaaaaaataaattaaaacaaaaacgaaacacttttaagctcaggaaagtaacctccagagtactttcagaatatcccagacaaattggggctttgcagattaatatttgcaggttgatctttgcctgggatcttccatataaaactaaaaaatgaagtctgtggtagctgttcttgcctagagtctctgctaacacagaagtttcgtgaaattttatggtgttaatcccttgtaaactatggatttagaaactcatattcccagactaagactagtctctttatttatttcttcaattcctagtagccaaaggtaattagattttacttttggcaggtgtatgctagcgatgtctactttatttaagaagatgctcaacctctaagtggtgtgggaggtgtttctaaaggtcactcaaggttggggtacagttgtggtggcaacccttccctgcctaacttgttgtttgctctatagggcaatgattcttgacctctttgggttatagatttcaatgaagtgtttctagggaaaggaggaacctgggagagatctgtcagtgctctctgctatccttttgtttgtagtgacagtatctgcaaaatatggggacaccttaagatgccttataatcttttagatctattaggttggtgcaaaaatgattgccgttaataacttcaaaatctaccggttagggatcattcagtaagcaagtaaatataccaactgaggtggagaaaagtgtaggcagcttgctttgagaattttagagctaaagtacagtgaagggtaattttaaattttacttcttttagaaggttttatttataattaaattgcttttttggttttatttgaataaatataaaattatacattcaaataattatttcttgaaattttctcctttattttaaaatgctggttagtatgtgatagttgtagcacatttaaagaagaatacaagtaaaaagtgcaattctacttctccctatacattgtttaataagcatatgccttttaaaaaatgaccttataatgggctgagtatattttggatattgttctgtggcagcataataccacataacttaattaactgtctccttattgttaaatgtttagattccctccttcctgcaccccctttgaaagcaatgctgacatgtgtgtccttgtaattgtactttgatatattggcaagtattttcctgggacagaattttgcagatggatcactggattattgtgtacatttactttaaaatttgcttaaagtcggggcgcggtggctcacacctgtaatcccagcactttgggaggccaaggtgggcggatcacctaaggtcgggagttcgcgaccagcctgaccaacatggagaaaccccgtctttactaaaaatacaaaattagccaggagtggtggtgcatgcctgtattcccagctacttgggaagggtgaggcaggagaatcgcttgaacccgggaggcggaggttgcggtgagccgagattgcgccattgcactccagcctgggcaacaagagcgaaattccatctcaaaaaaaaaaaaaaaaaatttcttaaaaattttcttttaattctaagagagttttatgttgacttctagtgctttttgggcgctgatgctcacacttattttgataaagatgaaagatgtttaccaaatagaatattggacatagaaactcccaaggaaattctctacgtagctgaatttcaggcagatggtgaagatgcaaggataatctcacaaagttatagctaacaatcactaattctgggtgatttggcaatgttttggcaagcagttattttaaactgctttctagtaagaaataattaaagtcaatgctttgatttaaaaagaatgcatatggttaaaatttaaagagttcagaatgctatctgtctactatatagatccctgctccccttctacaccaacctgtagaaaaactagtcagctcagttattcagaggctgatttcccagtttgttattatctgtgtacttttattctccacatttgacctgttactactcagttctacatctgctagtatggacatgtaaaggaaagggagagaatgtgatcagatctagtaaatgatgggttaattgaagaagttgtttaaagttaggagtcataaaaacataacatacatacactttaaacattttattttaacttgaaatcgaggtatacatttatttaccaagattttgatgttgggccaaggccttctggcattctatatcttggtctttctttcatccatttcccctataatgcttcattgtagatttttcaatgtacttaaaactttaaatccttaaatgtggtacaagactgtacattatgtggctctttgccagtttcttcgaaatctacttatccttaggttttctgtgataagtttcactgacttttcagtttccgaaacttgcctcagcgcctttccacatattgttcccataacctggaatgataatttctttaaatccttggctggcccagatcttttgaggtctcttctcaaatgttctgtcctcagagaggcttcgtaaatattagataatattccagtataaagtaggataaccccaacctccccacaagcccactaatatcacccttttctcttccttcactctacctgccaaatgtggcaggtagagtgaaggaagtgaacagggtaattttctttttacaagactgaagcctctgtgaaggcaagggccatccatatatattgggtttaccatagtgtaatagcctttggttagagcagtgtctgctatgtaataagaagcttaaatatttgtagacttaatcaaatgtttattatttatatataaagtgtcaggcactgtggggggcattacttagtaaaatgccacttagtcatctcattgatagcctatagtacattttaaaatggaagtgtgtacatccaagtatgcatttaatgaaatatgggacatttaaaaaagttttcagatgctaatactgaagagaataatgcaaatttactaaaataattaggaccctttttaaaacatgggggcaatgttgcttatctttttaaaaatagtcatttatttttcgttcactatcttaagaattctgatcatcttgtaggaaacttagaaacactaggaaggtcataggcactattattaataattatagaattgttttcctctaaattagagttttctttgtgaccctacataacgtaatgatatttgctctctggagagccaaatgggcctgaagtatagaaacagaactgaaatatagataattaaaactaaactaatatactataattctgattgttatgtcttaagatttgttggccttaataaggtgtgctgggataaacaaaaaggaaggcatcatttgtaaaggttttcttctttaatcccacttttgtttttgcatgaccagaaattctctgatatagcagggtatactttatataaagactatgggcagtaagtgtttagtgtttgtctttatattaggtctatagagtgtggtttcttgattatgggtgaggaaattagcctttcaaattccattagctgtaaagtggatttggatttggtatttgtattggttggctaatttaattcaaatcttttaaaattctcgtgctgaaatgatcttaggaagatcaaaatttctctaacagaaattattttggtctttgaagtgtataaatttaacctgttcataaaataagtattatcagctggtatgtttcttatacttttctgggaatacaaaaatgaataaagcatggtggttgtcttagaggaaataattgtaattgatgagatacatataaataatgtgatacgataaatgctagagtaggaatataaattatgtcaagtgttgtataagcactgtagagggagtgattgattctttgggagagttggagaaagttttatggatttgttaatccagacatatctaattattagggtttttaacacttttgtgtcttctctttttcctgtttagcttggtactttgccgttagaactcttgagtgaccaggtgcattgtaaatgagcaataatattttgaaagaaatcttttttcctgagcagtgggtctcaacaatggttttaaaatactcagtaaacagtgctctaagcagatgtgctgtcatttaggctttgttgttccatttatacagcacaggcagagtagattttgcataatttttaagggccgtatgatttttggaatgggatatgaacattggctacaacttaaagtcaccagttgtgttagcctctaacgagagtcagcatgtcctttgaagctttgaagccagtcattgacttctctctagctatgaaagtcttagatagcatttatttatttatttgtttatgatggagtcttgctctgttgcccaggctggagagcagtggtgtgatcttgggtcactgcaagctccgcctcctgggttcacgccattctcctgcctcagcctcccgagtagctgggactacaggcgcctgccaccacacctggctaattttttgtgtttttggtagagacggggtttcactgtgttagccaggatggtctcaacctcctgactttgtgatccacccacctctgcctcccaaagcactaggattacaggcgtgagccacgacgcccggcagatagcatttctttcagtagaagattgtttgtttacattgaaaatctgtggtttaatgaagccacatttatcaattatcttagccagatcttctggataacttactgcagcttctgttactgtattagtacttactgcttcactttatacttacatgtcatggagatggcttttctttaaacctcgcttatcgtttgaatatttctcccctccaaaacttctgttgatacttaatttccattgtggcaatattgagaagtgtggtttttcagaggtgattgggtcatgagggctctgccctcatgaattcattcatggattaatgtgttagtggattatcatgggagtgagactgactcattgctttttaagaagagaaaggggctggatgcagtagctcatgcctgtaatccttgtactttgggaggccaaggcaggaggattgcttgatcccaggagtttgagaccagtctgggcaacatagtgagactctgtctctacaaaaactaaaaaaataactagctggatgtggttgtgtgtgcctgtagtgccacctgtagtcccaggctgggtgacagaatgagactctgtctccaaacaaaaagaaaaaaggaagagagacctgagctagcatattcagcctctttgccatgtgattccctgttctgccgttctgctcagtactctgcagagagtccccacctgaaagaaggcccttggctgggtgcagtggctaacgcctgtaatcccagcactttgggaggccgaggcgggtggatcatgaggtcaggggatgaagaccatcctggccaacatggtgaaaccccgtctctactaaaaatacaaaaattagctgggcatggtggcgtgcacctgtagtcccagctacttgggaggctgagccaggagaatcacttgaacgcgggaggcagaggttgcggtgagccaagatcacaccactgcactccaccctggtgacagagcgagactccgttgcaaaaaaaaaaaaaaaaaagaaagaaagaaagaaagaaggctctcaccagatgctgcccatttaccttgggcttctcagcatccataactgtaagaaatcatttttttttataaattaccaagtttcaggtattttttaataagcaatagaaagcagactaagataaatgacatgaatcagcatctgctagtttcatacttttcttctgcggcttccttaccctttttatccttgcttagaattgaagagttagagcctagctctggattgggatttggcttaagacaatggttggttggtttgatattctatccaaagcactaaaactttctactcagcagcaaaaggctgtttcactttcttaccatttgtgtgttcagtggactggcactttaaattttttaaaagaactttatctttgcattcagacttcactgaccggtacaagaggcccagcttttggcctgtctccgcattcaacatgttgccttcctcagtaagcttaatcatttctagcttttgctttaaaatgagagacttgcaacttttcctttcatttgaacacttagaagccattgtagcattattaattggcctattttcaatattgttgtgtttcaggaatagggaggcccaaggagagggaaagagatggaagaacggctagttggtggagcaggcagaacacacagagactttaaactctgaagttcgctgtcttagataggtgcggtttgtggcacctgtaaactattgcaatagtaataccaaagatcgctgatcacagatcaccagaacagatagaataataatgaaaaagcacaataaagtgaagcacaataaaatgaggtatgcctgtaccttataatagcttgaaaatttcttaaattctgtgttttatctcaggaatgtgtgtgaattttgcatttcattgcatactgttaataaaaatatagaaatatttgaattactgccagaaaaaggaaaaacaaaaatcatttcctgtttgtctgttgatttttgaaaactggggtgaatgaagagagctgacactacatacctggtttagcacttactttctttttcttagtgtatccctggtatgtttcagtttatgcctgaagatgtacgtcaccagtttgagaaaaaaagattggccagtcagatcatgaaacattgcattacttttctccctcttacgtgtagtatagccttggggaaaattacttaatttgagtctgctaccctcataaattgggccaataatgtgtacccatactttttttgggaggggatcatatagtagctgctaattaaacatttattagctgcttcctccttttcctgccacattcctgttgctttcttcttggctttaacccaggtcttataactgcttggtatgctttaatcagcttgcttactgccctgatggtttttattagccagtgcgtagagaataatgctagaagatgcttggggcataagctgagacattcctggaataatagagacacactgactcaggaacagtcagtgcacagggaaatgttcggatttagcttatcagagtaagcaaaggtctagaaatacatctacattaatcagtggaaagatgggccagactaaaaattggaattagaatgtaggactgaatgcatttatactagagtctgctttctgtgcagcagtaaaagcaggtgatattgacttagtttttttcaaagtggttagagtattagactgaatggtctaaaaatttcatagatggaagtaaaggtatgttcaaaaatagactttctctgaaatgttataattgaacttagaacatttatgttagtggttttattctgtaaatgataatactcattcctgtaattctctttatgttgtcagtgtgtttcattaactatatctgcttgatctcaaaccttgattatttctctaactgcgtaacacatggcagttggaggttcaagagagtctaattgagtcacttatccacctgtctgaggtgttttttttttttttttttttggagatggagtctgtcactctgttgcccagcctggagtgcagtggcatgatcttggctcactgcaccttcacctaccaggttcaagtgattcttgtgcctcagcctcccaagtagctgggattataggcacatgccaccatgcccagctaaattttgtatttttattagagacagggttttaccatcttgccagactggtctcgaacttccaacctcaggtgatccacctgtctcggcctcccaaagtgctgggattacacacgtgagccactgcacccagcctctgatttcttaacagagaagagaaacaataagccaaacatggatcaaaataaagtattgagcttcattactggtaaaggtgagttagaaaatgtggtgaatattacagtattgcactcctagcaaaaagtgaaagcccccacatgaaaataggagaacaaaggaataggttttttgccagagtcccttcacataaacactttgggcaggaaactaggcaggcatgtcaccattgggcttcagatgggcacctgacaatgctgtcgttactgtaggagacagaccaccacaaagtgagattgatttggttgcttcagatctggactgaattatgtattttaattagctatattaaataaaacaaattaactcttttgaacgtattccttcatttgtaaggtgggaatacagttgagtgatgactgcgaacataaacatgactaaaatgcccagaactttctggtttatagtagtagtttctggtttagcaaatagtagtaataaaaggataactgttatccttaacagttattcttaacaaatcaaacctcgaatgtttacatctttaaaaattttaactgccacatttgttacattcttaaattgtgctgttaaaagtagacaacttggctgagcgcggtggctcacgcctgtaatcccagcactttggaatgcccaggcgggcagatcatctgaggtcaggagttcaagaccacccttgccaacatgacaaaaccctgtctctactaaaaatacaaaaattagctgggcatggtggtgcatgcctgtaatcccagctactcgggaggctgaggcatgagaatcgcttgaatctgggaggtggaggttgcagtgagtcgagatcttgccactgcactccagcctgggtgacagagcaagactctcagaaaaaatccccaaaatagaaaacctgtctccttaaactaatattgtttctctgacctactcatttcaggaaacaaaagactacaattgcctttatgctgatatgcccttatattgaagacttgaccatatataggaacattaaacagaatgccaggtagaggttttgattttcttgtcaaaataaaatgtcagaaatattcttcatgtgttttggggaagggagtattaataggggtcaactgtacattagtgaatacctgtcatttgaaataggagcttttaaaatagtatatatttaaggtgtaaaacatgatattttgatatacatatacatagttaaatgattactacagtaataggagcaataattttatgtgtgctgttctaagcacttatggtaactcattttatgttaacaacaatcctgtgagatgggaatatttatcctccatctgaaaaaaattaaggcacggagagaccaagttacgtgttcagggtcattaaactgatccatgtagaagccatgattcaaaaccaggcattcttagtgcccagcatggggtcaacactgacctgcttggctttggtacctctttaattgcattcgtactaagcactcagtcagtcataaccattctcttctcccttgtggtaattaatggtggtggtggtggagaatctacgggattaggcttcagttaattcttttttttttttttttggagacggagtcttgccctgtcgcccaggctggagggcaatagcatgatctcaggtcactgaaacctctgcctcctgggttcaagcgattctcctgccccagcctcctaagtagctgggattacaggtgtgcaccaccacgcccagctaattttttgtatctttagtagagatggggtttcaccatgttggccatgctggtctcaaactcctgacctcgtgatctgctcacctcagcctcccaaagtgctgggattataggcatgagccaccgtgcccggccggcttcagttaattctaaagcctgggactgtcagtaggattttaaatcttagagaccagttctgagaaagtgacctgttggctctgcattgcccccaggaaaagtgctaagattgttatcagttacctgacatctggtgggccggcacgccttagccacagtctcttgaatagtcaggaatgtctaaaaagttataagaagaaaaagcaacaggaagagacagacaacagataggtggttgccaggagtgggggaaggagagaatgggtagtgactgctggtgggcacagggtttgctttgaaattagattgacacaaattattattttccagtttataaaatcaggtttttcaggaggtctttacattgaatcacaagtgatttcaccctaatatggtgtgaattgattttattgttcactcttagttctttataaactaatttccccctccttgagtgtttgttttaaaattttggctctttcttgataacctggaatatatatatttggataattattttcaggaagagtatattatatgagtgatctcttttctgagttcttgttcagttgagaaggacttgattatgtacatgtgcagatatgggattctcagattttgatctttatgtttctccctgggaaagtttaagggttgatccattataatctggcttttagttttccagaggaaagggctaagtctgagattaacttgattcctcttggcccttccgaatatccatttctccttttttcctctttgtagataatcttttttgatttcttgtttttctgtaggattgaaaaatgtttttattaggctgtatttagatattggcatgttttaattaatttttccctatatactcaaaatctgtacatgttccgattcagatttttcttcagtttagaaaaatttccttctcgtatttttttgagagtgtaatatgtttaagaccacagactgaggagccagattgtttggtttccaattcctgttatgatactagtaactttgggtagggttcttaatcaattctttctttctttctttctttctttctttctttctttctttcttccttccttccttccttccttccttccttccttcctttcctttcctttcctttccttctttccttctttccttctttccttctttccttctttcttttctttcttttctttcttttctttctttctttctttctctctttctctctttctctctttcctttctttcttttctttctttctttctttctttctatccttctttctttctatccttcttcttcttttttttttttttgagacagagtcttgctctatcgtccaggctggagtgcagtggcgtgatctcagctcactgcaacttccacctcctgggttcaagtgattctcctgcctcagcctcctgagtagctgggattacaggcatgcaccaccatgcctggctaattttttgtatttttagcagagacagggtttcaccgttttagccaggatggtctgggtctcctgacctcgtgatccgcccaccttggcctcccagcatgagccaccacgcctgggctgtagttctttttattttcttcttgtggaattattttatttagattgcctcttttggatatgatctccatatttttctttcctcagcatttgtacttctttctttctttcttttttttttttttgagactgagtcttgctctgtcgcccaggctggagtgcagtggcacgatcttggctcactgcaagctctgcctcctgggttcacgccattctcctgcctcagccttccgagcagctgggactacaggtgcccgccaccacgcctggctaattttttgtattttttggtagagacggggtttcgctgtgttagccaggatagtctcgatctcctgaccttgtgatccacccgcctcggcctcccgaagtgctgggattacaggcgtgagcagcatttatatttcttaatccttttattctttctgggaaaattttttgagtttttaatcttttttcttttttttttttttctctttactgaagttctaatctggccagttctgctgttgttttcatattattttttctctgcaatttctccaaatcttagattgtttcctcatcataacttcctgctctagtttcttgtttgtaatcttctcttggattgtcctgagaacatcaattagaaattttataaacatgttttcctgtatcttatagtaaatctgtttctgaagaaattgtgcattcattgtttaggctagtatccataatttgaattatggtatttttttggacatcaactttgtcttctgctcatttttataagtgggaggtctctgccagcttagtattagtcttagcataaggtggaatttgagatgttttataacaaaggtagatatagatcatattaaatttttgatttaagaaaaatgaaaggtggcaatatttcttgaagccccaggaatgactgatctgggattcatattatcataaaagagaacaataagtgataaacattaatatttatttagctttttaaaatgtgccaggcactgtgcccagtgctttacatatgaattatatccttttctctttctcagcaactttatggtagatactgtttttcctgtaaacttaatgaagttgaagtttagagatttactcacctaaggtcataaggctcataaatagtagagccaggattaaacccaagtgtctgactccagcagttgagtgtcaaatagttaggttttaatggcctcttgtcaatatcccaaagggcttgaactcttataagtaggtttggttccagactgatacactgcccgatcttaatcatgatggtcagtagaagatgtgtttagatccctcttggtgaaaggagcccctgagtttccacgtaatacacttggaaaaccatagaatttgtttccttaattttgctcattcacaacccctctgtcacactgcttgattctctgtttcttaagcgtagcacaatacgtctgatctcttgtttttaaaatatctgttatgcctggacaacatggtgaaaccctgtctgtactaaaaatacaaaaattagccgggcattggttgcgggcgcatgtaatctcagccactcgggtggctgaggcaggagaatcacttgaactcaagaggcggaggttgcagggagctgagattgcaccattgcactccagcctgggtaacgagagcgaaactccgtctaaaaaaaaaaaatctgttatggtgtgtgttatgtagatattcttagagttctgggcatgtagctgacaccttttcatgaagtgcagaaaaacccattttatatgaatgtgttttcagaatcagccatagttcctgttacagaagatggacccaataattattggttgtgtgaatgttgtatgaattaaattagataaggagattacatagcatactcctctaaaatgcgcatatttaaagtagttgggtatatgtatcatgatcaactggaaaccttttttgaaatacagatgcttattatgacttagaaacactgttctaattatagtctaatatatagtgattattatagtctaataatcactgactataaaagtgattgaatagttcttggtaaataattgttacttttcttgatttttaaatattcatgctgtaatgataaaaatgtccaaatccatagtgtatatggtttagatcttgtttataatatacagagaaaggccttcaggagtttcttgaagtaataaatacattattgttgagttcattttggagttatttactgtactaaaccagcctcacaatgactttgcagatttgtgatattactcttggcttttagagagagaaggacacacagtaaataatccctaaattcaaggaattgacttaatgagaatagttgaatttttaagctctttggattctgagttagtatttagatttatttgatttaagatgattgttgaagttacatgaaaataagtctttccaaaatgaaaatctttttagtaatcaaatgaggattttctgatagcaacagggtgcattggaaatgagattttctgatcagcagcagcatgcattgcactgtattggggaattgaggtaaagtaatatttaaaagttcatattattggccgggcaccttggtcatcaagagtgagtgagtccaacaactagcaggtgtcttggcttgtgaggcgccccctccagcattaatgggaaaagagatgagggccagggccgggcatggtggctcacgcctataatcccagtactttaggaggctgaggcgggtggatcacctgaggttgggagttcgagaccagcctcaccaacatggagaaaccccatctgtactaaaaatacaaaattagccgggcgtggtggcgcatgcctgtaatcccagctactcgggaggctgaggcagtagagtcgcttgaacctgggaggcggaggttgcagtgagccaagattgcgccattgcactccagcctgggcaacaagagcaaaactccatctcgacaaaagaaaaagttcttattactgaggaaaattaaaaaattcagtgccttcaatataaacacttaaagttatgggatatgaaaattatggacatatcagacctgaattttatgttattttactcactcgaccagtaagatcttgagtcatatattttagtggaggcaattttattcatgtattgttttttttcttttttaagacagggtctcgctctactgcccaggctgaagtgcagtggtgtggtcttggctcactgcaacctctgcctgccggattcaagcaattctcctgcctgagcctcctgagcagctaggattacaggcgtatactaccacactcagccaatttctgtatttttagtagagatggggtttcactattttgaccaggctggtctcgaactcctgaccgcaagtgatccgcccattttggcttcccaaagtgctgggattacagatgtgagccaccatgcccggcccatacattgtttttcaattctaaaacattctgttttaaaagatcagttgttttgttcattatttccttaatagtggattccttcatgattgtgagagccaattcaatatctctaacggtcttttgaaaatcttaaatagggcaaattttattctgggtttccatgagtcaaaaatcagtgttgatggttcttgtctcccctccctcataatgtggtttggcaaaatgcttcagggaaataacagtgagggtgattgagggaaaactgaaaaatccatgaaggaagtaatagctattcttagaattattggctctaaaaaatactttcttaggttctctctagtcatgattactcataggaaacaaatatgaggtttatagatttaaatccaggtatttctttaaagagaaaataaatgttaaagaagtcatattcattgttttcattaagatttgagattttcgtaacaagttagagtaagagggaagtaaaaatcaaataagctaaaataggtacctgagatgtctttttcttccatgttagacagataatgtaccaatgctgtagcaaggtttgagggaggcacatctcatatgtgtgtgaaaacccagttatcatgcttatgaactacaaaaggatctatatgagttcttgtgtaggtgttagctaacaatctggtgttcctaaaatgtgaaacacatatatcttactctttggcaaattaacaaagtaagctggcataacagcttctattcttgacaggaaaattctatacctttttgtacttgattagtccattaggttattatctacagttacctgaatatgagtaaaaattaaaaagaaatctgtatatgaggtagagggatggctcctagaaaacatgtatatacagatgtttttgccataaacctatagaataatcatattttactagagtagatttaatcagttggggagattgttgaaactgcttccagaggtggcacaagttatattttgaaggttacaaattgtgttatatttagtttatgccactttgatacttctaaggtttaaattttctgtgcttttttgtttacttgacatttctgggattgagatcatgtttgtttcctgctatatttgttttctagtcacgttgaaccttgtttttctaataattatgctgcaatattatttgatacatacaattttagctatgttctcttgtccctgctggtattttgcatttatataaataacctttataggataaagtacagtgtcttttgttttgaaaaaagatgaaaaactttttcaatgtgtccccgtttggtttcagttatccacatctgaagtcactgtggctttgcctgtttaaacaagtttcttttcttgtcccttcagtagcaaccaccagggccgtcgttttacatgtcacttttctttcattcagaaagaggtgctcactttggtcgttaatttttgttttagtctgctcctatcattatggtagtttatagaaactattttttaattttagttttaatttttctttttttgcagagacaagagtctccctctgttgctcaggctggtcttgaactcttggcctcaagcagtaatccgtcgcaggctcccaaagtgttgaaattacaggtgtgagccaccacacccagtgtagaaattttttttttttttttttgagatggagtcttactcaagtgattctcctgcctcagcctcccgagtagctgggattacaggcacccaccaccacacccggctaatttttgtttgttttagtagagatggagtttcaccatgttggttagtctagtctcgaactcctgagctcaggtgatccgcccaccttggcctcccaaggggctgggattacaggtgccaccgcacccggcctagaaactattctttagctgtgatatgtactttattctatcatcatttattttatgtagatgctacacagtgtgctagagtctaaagggaatgtgtgcttgtatttttcttttttttgttaaactacctctcatgctattattgcttggcttttttttttcttttttttaattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtaatgttccccttcctgtgtccatgtgttctcattgttcaattcccacctacgagtgagaacatgcggtgtttgattctttgtccttgcgacagtttgctgagaatgatggtttccagcttcatccatgtccctacaaaggacatgaactcatcattttttatggctgctagtattccatggtgtatatgtgccacattttcttaacccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgctacactgacttccacaatggttgaactagtttacagtcccaccaacagtgtaaaagtgttcctatttctccacatcctctccagcacctgttgtttcctgactttttaatgattcccattctaactggtgtgagatggtatctcattgtggttttgatttgcatttctctgatggccagtgatggtgagcattttttaatgtggtttttggctgcataaatgccttcttttgagaagtgtctgttcatatccttcgcctactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagtagctctttagtttaattagatcccatttgtcaattttggcttttgttgccattgctttctgtgttttagacatgaagtccttgcccatgcctatgtcctgaatggtattgcctaggttttcttctagggtttttatggttttaggtctaacatttaagtctttaatccatgttgaattaatttttgtataaggtgtaaggaagggatccagtttcagctttctacatatggctagccagttttcccagcaccatttattaaatagggaatcctttccccattgcttctttttgtcaggtttgtcaaagatcagatggttgtagatgtgtggtattatttcttttgctgtgcagaagctcatgaatttaattagatcccacttgtcctttttttcctttattgtgattgctttgatgtcttcgtcatgaaatctttgcctgttcctatgtccagggtggtattttttaggttgtcttacaggatttttataattttgggttttacacttaagtctttagtccatcttgagttaatttttgtttatgatgtaaggaaatggtccaccttcagtgttctgtgtgtggctagccagtttatcccatcactatttattgaatagggagtcttttccccattgctcatttgtatatgatgtaaggaaatggtccatcttcagtgttctgcatatggctagccagttatctcatcaccatttattgaacagggagtcttttccccattgtttttgtcagctttgtcaaagatcagatggttgtaggtgtgtggccttatttctgggctctctattttgttccattggtctatgtgcctgtttttgtacccgtaccatgctgttttggttactgtagccctgtagtatagtttgaagttgggtaacatggtgccttcagctttgttatttttgcttaggatttctctggctgttcaggttctttttttggttccatatgaattttaaaatagtttttcctagttctgtgaagaatgttgtttgataggaatagcattgaatctgtaaattgctttaggcagtttggccatttcaatgacattctatccatgagcatgggatgtttttccatttatttgtgttgtttctgatttccttgagcagtgttttataattcttagtgtagagatgttctacctcgtggttggctgtattcccaggtattttgttctttttgtggcaatttggaatgggattgcctttctgatttggctcttggcttagctgttgttggtgtataggaatgctagtgatttttgtacattgatttttttttttttttttttaaagatagtgtatctctctgttgcccagagtgcagtggcactagagtgcagtggcacaatctcggctcactgcaacctccacttcccaggttcaagtgttcttgtgtgtcaacctcctgaatagctgggatttcaggcatgtgccaccatgcccagctaatttttgtatttttagtagagacaggatttcaccatgttggccaggctggtctcaaactcctgacctcaagtgatctgcccacctcagcctcccaaagtgctgggattatacgtgtgagccactgtgcctggcctgtacattgattttgtatcctgaaactttgctgaagttgtttatcagctgaaggagcttttgggctgagactggggctttctagatatagagtcgtgttatctgtaaacagagatagtttgacttctactctttctgtttgaatgctctttcttactcttgcctaattgctctggctaggacttccaatactatttttaataggagtggtgagagagggcatccttgtgttgtgccggtttttacagggaatgcttctagcttttgaccgttgagtataatgttggctgtgggtttgtcatagatggcttattattttattccttcagtacatagtttactgagaatttttaacatgaaggggtgttgaattttaccagaggccttgatatggtttagctctgtgtccccatccacatctcatattgaattgtaatccccagtgttaggggagggacctggtgggaggtgattggatcctgggggcggatgtctcccttgctgttctcatggtagtgagtgagttctcacaagatctggttgttctcacgagatgtggagtgtagtacttcccccttcactctctctctctttcctgctcctccatggtaagatgtgcttctttgcccttcgccttctgctatgattgttaagttttctgaggcctaccagccatgctttctgtacagcctgtggaactgtgagtcagtgaaatctcctttcttcataaattacccagtcatgggtagttctttatagcaatgtgagaatggactaataaaggccttttctgcttctcttgagataatcacgtggtttttgtctttagttctgtttttgtgatgagtcacatttattgatttgtgtatgtttaaccaacttcacatcctggagatgaaggctgcttgattgtggtggattagctttttgatgtgttgccggattcggttttcaagtattttgttgaggatttttgcgttgatgttcatcaaggatattagcctgcagttttcttttattgttgtgtttatcaggatggtgctggcctcatagaatgagttggggaggagtccctcctcctcagttttttggaatagtttctgtaggaatggtaccagctcttctctgtagatctggtagaattcagctgtgaatccatcaggtcctgggatttttttggttggtagacgttttattactgattcaattttggagcttgttattggtctctgtggggaatcagtttcttcctggttcagtcttgggaggacatatgtgtccaggaatttatgtctcttttaggctttctagtttgtatgcatagaggtgtctgtagtagtttctgatggttattttttatttctgtggggtcagtggtaacatttcctttgttatttctaattgtgttctctcttttctttattactctagctagtggcctatgtatcttactaagtttttcaaaaaaccaactcctggattcattcatcttttaattgttttttcttgtctctatttacttcagttcagctctgattttgaatacttcttttcttctggtagctttggtgttgatttcttcttgcttctctaattctagaaacccaatttaaactaatttgtgcaaaaataatttgttgaaaggaatattttagggaaataaaaaatggaagatttattaagactgaggatggggacaattggagctaggcctcaggaatgactcagggatatgacttggttaagaccctttttcttgtctccgtctagggtttacttttctctctcactgcacactgtcattcttcattgaggaaaaacatggctggtcactagtccaaaaatcttagaaattggattaattgatctagcttagattcatctatttggctgtggggttgacatttttataaaagctatgtggtttaagtagagagaaggcttattcgcagaataagatgtttgagaattattgttggacagataaaaataggtatccattaaagtaatgtgaattaataaagttcttttgtccccttttcagagctagagacatacttgtgtacatgcatacatattggtttggttcttgcttgggaactagagtagtggatagactgtttagtaaacaaaagtcatggtaattttttcctggattggctcagtttttcaaagcacagaagaattttggttggcaaatgttgttctataaagtatttgtccattttcttagtgtaagttaagaatagttccctttctacttttgttatggatctcctacagtcattctaattctaatgcctgatagtctttgcagcctatccaatcttgactcacccttatatttttaggtttctattttagctcaggagccacttgaaaatgagtaggcacaaacacgtgatctaaaagcaagaaggaggctaaccacatttggcactgaaggaaattagatcacgtgcactgtgattgcacactttcgaatatgttacgttattttgggaagaaaatagctttcagttagacattgctgaatattgttgtactatttcttgtatatgtgaaaattgtagttttaggcatccaagtgaggtattaatttagatatcattattgctcatttagcaaaaatgatgtggcattaaagtaagaattataagctatttcactggtagaattgctgtaggtatgggggagaagtgtgtctttaagtgatttaatttaatctaaatatttattgagctcctttgagtttagaaggggatggatagaagaaacaaaacactgatacataccagattttctataatgctgataagcttctgttccttatttccgtatatctttaaaatgccctgaaagtgaaaatatttatgcctatatttccattattttttgcacctgaagaaacataaaaatcttttgtcagattttatattctgatttttagattgcaacagagcagtcttaactaaatgcattttaaagcagttttgcatttgtacactgctctgtagtacatgctgcgttgaaatggatgtattagtctgaagttcactagaacagtgagcttcatattatttaaaagacctctgagaatattccagctgttatttcttttgatttgaaataatagcagattgccatacataaagacaaagttaacattttgttatagcacactgctgcataatagtagacttagtaaattatattttgaaaggacgttttggaatgtaggtcaggagctgactggattcttctggaaatcacatagcatgagaatcttgagtcaagtcagtacttgactttagaactcatgcagtccaacttcctacctgatgctggaatccatcttgctatcccaaataattcatttggttattaaagaagtatttattgaggcatagtgtgtgtagatactgtcctggggatgtgttggctaaaataaaaatagacttggtccctgcccatgtgcagataggtcttttttagaaggctattaattattgttgattcagtttcttgaaaaatataggggtattcaagttatctgtgtctcctggtgtgaattttggtactttgtgtcttttaaggaactggtctccttcatctaagtggccgaatttgtggataaagagtctaacttgtagttgggtgttcagtgctcaatcagtctcaacaagttattttttgaatcaagtactcaagttgggaagaattgacaatttaacaactttgaatttcctaatccatgaacattgaatatctctacattaattagatctgatttaatttccttcctcagtgttttttagatttctgcttacagaccctatgcatattttgttagatttatacctaagtatttcaatttttcccttgctattgtaaatgatactgcttttctaactttcaaattcctattgtccattgtatgtagggaggatagtgacttttgtatattgaccttgtatcctccaaccttactgtacttgcttattagttctgagggttttttttttctctttttgaatctttaggttttccacattgacaatcatgtaatctgtaaataaagacagtttgatttcttcctttccaatctgtatacgttttatttcttccaatcttagggggaaagtgtctgcttcgtgattattaagtgtgatgttttgtaaatttatttattggaggaaattcccctcaattgctagtttactgagagtttttgttttgttttgttttatgagtggatgttggattttgtcaaatgcatttcaattgacatgattatgatttttctttagcctattgatatgtagggtgacattgattggtttttgaatgttgagccagtctttcgtacctggtatataattcttttaatacattgttggatatggttttctaatattttgttaagaatttttgtattaatgtcattatagatatggatgtatagtttttcatttttcttgttatctggttttggtattagagcagtgctgatctcacagaatgagttagaaagtattacctctgcttctatattctggaagatattgtggaaaattgatattatttcttctttaaatgtttggtggagtttaccagtgaagtcatctttggtgcttcctttaaaaatatagggctattcagtttatcagcttggccatagtggggtagaacagcagtccccaacctttttggcacaggggaccagtttcatggaagatggttgttgtccacggaatgggggctggatgaaactgttctacctcaaattatcaggcattagttagattcttgtaaggagcactcaacctagatccctcacatgtgcagtacacagtagggttcacactcctatgagaatctaatgccactgctgattggatgtgaggtggagctcaggcaataataatactcgcttatgcattgcgtacctcctgctctgtggccttgttcctaacaggcctgggaccagtatcagtctgtggcctgggggttggggatgaggtagagcacaaagtggagtctttgggtccccttttccaggccttggctcttagatggtatttctggacctgccctggaccagaggggagccctctgccctgaggaatgagtcccaggccagccagcattcaccagaaactgactgaagagcccttgggccttaagggaacatcggcagtagcttggaagtataccaaatgggcctgtgttgtgggtggccacaggataaggctcctctgcctgtggaaacgacagggatgagtggaagaattgtgtcttgtggtttgagtgccagctcatctgtagcatagtagaatattaggtagacttctaggtttttaaactccagtccctggctcccagatgacacttcttgacccacctggggcccaggggaacttgttgccctgaggggaaggacacaaacctggctggctttgctacctgttgattatacagcatcaagaccttgagctgccataggcggtagccaggtagtgcttacagcaggcctttggtgagacacagtgctgtcctgactttaggtttgactcagtgcagtttcagtggtggtgaaacaggagtcttgtgtcactctatcctcagccccaggtggcacagaacagagagggagattccattggtttgagagaaagtaagtaaagagaataaaagtctctgcctggtaatcaagagaattctcccagatctcttacgcaagaccgtcaaggtgatacctttgtgagtctgcaagatccacagtgttactgggtttggatggagtgcccctaatgcagatacagcttagatcacaacacctaagtccttttgaatgctaggaaagccttcccaagaagatgggtacaaacaagcccagactgagaagactacagtagatacctaactcttcaatgcccagacgcagatgaacatcgacaagcatcaagaccattcaggaaaacatgaccttaccaaaggaactaaataaggcaccagggaccaattctggagaaagcgagacagaaaattcaaaatagctgttttgaggcagttcaaagaaattcaagaaaacacagagaaggaattcagaattctatcagatatattgaacacagatttaaataattaaaaagaatcaagcagaaattttggaattgaaaaatgctgttgacacactgaagaatgtattgaagtcttttaatagcagaattgatcaagccgaaggaagaatttgtgaacttgaagataggccatttgaaaatacacagaggagacaaaagaaaaacaaaacagaacaaaaacaatgaagcatgcctacaggatctagaacatagcctcagaagggcaaatctaaaagttattggccttaaagaggagatagagaaagatatgggtagaaagtttattcaaaggggtaataacagagaacttaccaaatctacagaaagatatcaatatccaagtacaagaaggttatagaacaccaagcagatttaaaggaagatgatgtctgcctcaagacatttaataatcagacttccaaaggtcaaggataaaggaaggatcctaaaagaagcaagagagaagaaacaaataacatataatggagctccattgtgtcagacttttcagtggaaaccttatataccagaagagagcagcaggacatgtttaaagtgctgaaggaaaaaacttttactctagaataatatgtttggtgaaaatatcctttaaacatgaaggagaagtaaagactttctcagacaaaagctgagggatttcatgaacaccagacctgtcctataagaaatgctaaagggagtacttcaaccagaaagaaaagaacgttaatgagcattaagaaattatctgaaggtacaaaactcactggtaatagtaaattcacagaaaaagacagagtatggtaacagtaactgtggtgtgtaaactactcttgtcctaagtagaaagactaaatgatgaaccaataaaaaataataactgcaacaacttttcaagacatagataatcaaaaaagatataaatagaaacaagaaaagattaagcaggggataaagttagggtgtagtgtctttatgagttttcttcttgcttgtttgcttgcttatgcaaagtgttgttatcagcttaaaataatgggttacaagatagtatttgcaagactcattgtaaccttaaatctaaaaacatacaataagtacaaaaaaattgagaagcaagaaattaaatcatgccatcatagaaaatcaccttgactaaaaggatgacagaaaggaaagaaggaagcaaataccagaaaacaagtaacagttataggagtaagtccttacttatcagcaataacagtgaatgtaaatggattaaactctccaatgaaaggatacagagtagtggctgaatgtataaaaaaccaagacccactgatctgttgcctacatgaaacatactttacctgtaaagacacacatagactgaaaataaaaggatggaaaaagatattccatgtcaatggaaaccaaaaaggagcaggaatagctatacttctatcagacaaaattgattttaagacaaaaactattagaagagacaaagaagatcactgtataatgactaaaaggtcaattcagcaagaggatataatgattgtacatatatatgcacctaaccctagagcacccagatatataaagcagatattagagctaaagagagggatagacccaaatacgataacagctggaaacttcaacacatcactttcaacattgaacagatcttccagtcaaaaaatcaacaaagagtaatcagacttaatgtgccttatagaccaaatggacctcatagatgtttatagaacatttaatccaatgactgaagaatacatatttttttcctcagtacatggattattcttaaggatagaccgtacttaggtcacaaaacaagttttaaaacatcaaaaaaagaaataatatcaagcattgtctctgacgacaacagaatgaaacttaggttggtgcaaaagtaattgtggtctttgccgttaaaaaggcaattacttttgcaccaacctaatagaaatcagtaacaaaaggaattttagaaactatacaaacacatggaaattaaacaacatgctcctgaatgaccagtgcatcaatgaagaaattaaggaggaaattgaaaaattcattgaaacaaatgataatggaaacagaagataccaaaacatatatgatacagctaaagcagtactaagagggaaatttattactgtaagtgcctacatcaaaaaagaagaaaaacttcaagtaagcgacctaacaatacttaaagaactagaaaaacaagagcaaaccaaacccaaaattagtagaaaaaaagaaataataaagatcagggcagaaataaattaatttgacatgaagaaaataatataatagatcaacaaaaccaaaagctggtggtttgaaaagttaatgaaaattgacaaacccttagccagactaagagaaaaagagagatccaaattaataaaataaaatcagagatgaaaaaggaggcattacagttgatattgcagaaattcaaaggatcattagtggttactatgagcaactatatgccaataaatgggaaaacctagaagaaatggctaaattcctagacacatacaatctatcaagattgaactgtgaagaaatccaaaacctcaacagaccaataacaagtaatgagattgaagctgtaatgaaaagtgtcctagcaaaaaaagcctgggacctgatggcttcactggtgaactttcccaaacatttagagaactaatcaaatatattcaaactattccagctgggcatggtggctcatgcctgtaatcccagcactttgggaggctgaggtgggtggatcacctgaggtcaggaattcaagaccagcctggccaacatggtgaaaccctgtctctactaaaaatacaaaaattaactgggcacggtggtgcatgcctgtagtcctagctactctggaggctgaggcaggataatcacttgaacctgggaggtggaggttgcagtgagccgagattgtgccactgcactccagcctgagcgacagagtgagacttactcaaactattccaaaaaatagaggagaagggaatactttcaaagtcattctaagaggctaatattaccctcatacccaaccaaagacacatcaaaaacaaacaagtaaacaactgtaggctaatatctctgatgaatatcgatgcaaaaatcctcaacaaaatgttaccaaacaaaacacaggaacacattagaaagatcaaattgatcacaatcagtgggatttatcccagggatgcaaatatggttcaacagacacatatcaatcggtgtgatacatcatatcaacagaattaaggatgaaaaccatatgatgatttcagatgatgatttcagttgatgataaaaaagcatttgaaaacattcaacatcgcttcgtgataaaaacccttaaagaactgggtaaggaagaaatatacttcaacataataaaagccatgtatgagagacccattgctaatatcatactgaagaaggaaaagctgaaagccttttctctgagattgataacacaataaggatgcatactttcactgcttttgttttcagcatatactggaagtcctagctagagctatcagacaagagaaagcaataaagggcatacaaattggaatggaaaatgtcagattatccttgtttgcagatgatatggtcttatatttggaaaaacctaaagactccaccaaaaaactgttagaactgataaacagatttattaaagttgcaggataaaaaatcaacatataaaaatcagtagcatttctatatgccaacagtgaaaaatatgaaattgaaaccaagaaagtaatcccatttacaatagctacaaataagataaaatacctaggaataaaccaaagaagtgaaagatctccacaatgaaaaccataaaacattgatgtaagaaatcagagaagacacaacattggaaagatattccatgttcatgggttggaggaaccaatattgttaaaatgtccatacttacccaaagcaatctatagattaaatgtaatccatatcaaaataacaatgacattcttcacagaaatagaaaaaaaagtcctaaaatttatatgaaactacaaaagacccagaatagccaaaactatcctaagcaaaaagaacaaagctgcagcaatcacattatttgcttttaaattatgctccatagctatagtaaccaaaacagcaaaaaccagtactagcaagaaacacatagaccagtggaacataatagggaacccagagataaatctgtacatctatggtgaactcagttttgactaagctgctaagaacataacactggggaaaggacagtctgttcaataaatggtgctgggaagaatggatatccatatacagaaggatgaaactggacccctgtatctcatcatgtacaaaaacaaaattaaaatacattgaagactcaaatataagacctcaaactatgaagctactaagagaaattattgggaaactctccaggacgttggactgggcaaagatttattgagtgataccctaaaagcatgggcaaaaaaagcaaaaatggacaaatggtatcacatcaagttaaaaaggtatctgcacaacaaagaaaacaatcaacaaagtgaagagacaacccacagaatgggagaaaatattttcaaactacctatctgacaagggattaataaccagaatatataaggagcgcaaacaactctataggaaaaagtctaatctaattaaaaatctaatttagattgggtgcagtggctcacgcctgtaatcccagcactttgggaggccagggcgagtagatcacctggggtcaggagttcgagcccagcctggccaacatagtgaaaccctgtctctaccaataatacaaaaattagctgggtgtggtggtgcacacctgtaatcccagctacttgggaggctgaggcaggagaattgcttgaaccagggaggtggaggttgcagtgagccaatgttgcgccattatattccagcctgggcgacaagagcgaaactccatctcaaaaaaaaaaaataataataataaaataaaatctaatttaaaaatggacaatagatttgaatagacatttctcaaaagaagatatacaaatggcaaaaaggcatatgaaaaggtgcttagcaacactgatcatcagagaaatgcaaatcaaaactacaatgagatattatctcaccccaggtaaattggcttttattcaaaagtcaagcattaacaaatgctagtgaggatgtggagaaaaggtaaccctggtacactgttggtgggagtatgcattagtacaagcactatgaagaacagtttatatgttccttagaaatctaaaaattgaggtttcacatgattcaccaatcccactgctaggtatatactccgaagaagagatatctgcactcccttgtttattgcagcactactcacagcagccaagatttggaagcaacgttaagtgtccatcaacagataaagaaaatgtatacatatacagtggagtactattcagccataaagaagaaggagatcctgtcattttgcagcaacatggatgaaagcagatgtcattaggttaagtgaacaggcacagaaagacaaagttcacacattctcacttatttctgattgctaaaaattggaataattgaactcatgtagatagagaattagaacaatgattaccagaagctgaaaagggtagtgggaaggtgggatgggtaagggacatggggatggttaataggtatgaaaaaataattagaaagaatgaataaaacctagtatctgctagcacagcagggtgaatgtagtcaatttaattggacatttaaaaataactaagagaataattgaattgcttctaacacaaaggataaatgcttgaggtgatggatactccatttgccctgatgtgattattatgcatttcatgcctatgtaaaagtatctcacataacacattaatatatacacatgtacccacaaaaattaaaaataaaggagtaaaaaagtaattttttaaataattttatactgcatgtaacccatgtacaagtagtgccattaccttgtaacaggatatttccaattcctccctctctccccctcccctttttttttttgccattgctgtcatgttttttttttttgtccatgtggtataatcatccaatacatttattcttccttttatcacatagatccacatttttgacctatataattttctttctgtctgaagaactacttttaatctttctttcaagccagatatgctggcaatgatttttcttggtttttgcttgttttggaacttgtgtgattaaggaattataatgagaaagtgatgggggcaagggtgtattgggccttgtaagtcttgggaagcagtttgaattttatttaaattttagtgaaaaggttttggtctggagttttcatgtaatctaatttattttccgaaaaaaaattaaataaattggcagctttgtgaacaatgacgtagattgagggaagaagactggaaatagaagatgggttaggaggcttttacagtagataagagcattgtttggactagagtggtagtagtagtagacagaaaaatggatagatgtgagtcttattttggaagtgggtctgacatgacttgctgatgtgaggagtaaagaagtggaggtgaatcaaggatgatatccaggtttcgtgttcaagtaactttgtagaagatagtggtgttatttactgaaatggcaaatcgggactggaaacaagtttggaggagacattaggaattccattttggtcatgtttcatttaagatacgataagacttccacatggaaatatcaagtagagaggtgaatttcagggcaggaatttagagaaggtatttgagttgggatagaaatttggaagactgttagcctgcagatggtattttcgtccatgacaatgacagacattacttagagtgtgtgacaagggaaaaggtcaggatctgaactcagggaatttctaacatttagaaatcaggtagaggagcagcaacctgagaaggacttgaaggattgaccacagaaagacatctggaatatgtggtgtgttggcagttaaggattcatcgtgcagtctggaagagtaaagacctggcttgtaacacattctgcatttttagaaacaaaatatacaaagtgagaaaaaaaccttcagaggacagatgaatgtcgcttgggttttaaaaaggaagggtgttaacatgcataacagaaataaatgatggctagctaattacactggtccaggagtatggttattctttattttgatattcttgaaatttttgattttttataaagttggaaagtaattactttttaaaagatacacatgtaacttgaagctagactcattctttttattgccaagagtaatggtgttagtgtcacctaatggcaaaatggaatattgcagctatacttataggctataatgaaaaggtaacctaattagaaagaaaaataacatttctggggggattttaggcatggatcagtagacttactatggcttacaaggtcccgtgttctttagccctagcctgcttgtcctgcccctctatcacattactcatttggtcactgagcagattgtgtaatagtagggttcttttttgtctttcaggtttaggctcagatattttcctctcagagagctttttcctaccaccttaatttgtccgtatacttcccatagctactgtttgtcacattaacgtgtttattgtttgcatagcctttagagtgacttggaatcaccatttgctccctttttatttgttttcttactagtatgtaagccccagaagtgcaggctacttgttttccttattcacttaggtaacctcagggctgagttgtgtctgttatatagtgtatgtctgcagttaaacttagttgtgtgagtacatgaacttctggatatgatagtgagtgttgtttctatgctgtagagatctatccagaaaacagaattacactgtgtttgattactgaaacattatttgctacgtgaaggcaatatagaagcttttttctttttctttttggtgttaataagtgataatgtgtcaggaaagagaagctatatgtcttaggatgttgaattctgtattagtcaactttagttactcagaaaaaatatttgcaggtacaatattcggtcttgaggagataagtttttttttgaagcatttagatttaattaatatagcagtgtcagtgaatatggttttgtgtctgtgtgtgcatttgtaggtatttctagtatcatttaattatttcctctattaaaaagaaaacagtatttctaagagaaatgagagtgagtgtgtcaggtaaacagtgataaatctggttgagatatggactggtttgtgtaaatttttaggtaacaatatggctctattagtctggaaacttaggatgaagagagagtacatttccattaagtggctcagtccaagaaggtagcctccctaactttgagataattatctagccagcaggattcttcttcacataaaccatttttaaagctttattagttcatgtttttaattagttcatgtttttaatcagtaggtttttttttttaatcccttttgtttttccaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaaggtatttttttcttttctacatatggtataatttttaattaaaaactatttgaaacttaggagatgtgtaaaatgcaaaggtttttctcaagtgctgactttcaaaataaaatcaatgtttgatttatccagaccctaattatttggtttgtgtattttaaaaagttcttgcttttggttgtttaccttttgatttggaattttagggggaagaataaaagaagaaaaagaagagaaaggattttttggtgaattagacataatggttaaattttacattactttatctggatgtttttgtttctcttactgctgggttttagaagttaattaaatgttttgctttcacttgagagacttttttctttatgatttttatgttttaaatcagctggtaacgttccgttgtgtgatttaacagtcgacttgtctaaatgtttttaaagcatatcttatatttttagcatttgagtttttatttagatatggtccctttttcacttctgtgttgcactttctaagtcaaagaaaaggaagcaagtaaactcagttatataggcttgaaaatggtataactgtcttctagaaacaggaataggaaaagtagttaaaagtgctatatattacttatgacttttatttagtattaactatggcatcaaaagtgtattaatatatcagtctaataaaatatattctgaaaatgagattactaaatgtttatgttgagaatatattgttttataattttatttaaataatcagtggctttatttttagatacctgtattttagcattattgtgtttaagacatcacttatttgcttaggctttgtgtttcacctgcctttgagaaaactatgagtcaacttaagtgtaaggaaattagcaatattcatcttgggagctagccaacaatttgtaaagaaatcagaaatatggttatgctgtgctaacaagaaatataaccttttaaatgatattcataatagacccgatttaaatttacctattttttcctttagacatgtaaatttaaggttatctgatttttagggtgtgttcctaaaaaagaaaaagaaaaagaagggccaggcgtggtggctcatagcctgtactcccagcactttgggaggccaaggtgggcagattgcttgaggtaaggagctcaagaccagcctggccaatgtggggaaatcccgtctctacaaaaaatacaaaaattagctgggtgtggtcgtgcacgcctgtagtcccatctacttgagaggctgaggcatgagaatcgcttgaacccaggaggcgaagtttgcaataagctgagattgcaccgctgcattccagcctgggtgacagagtgagactctgtctttaaaaagaaaggggaaaaaaagataaatacatctctgtaaataggatcttatataaaatgtagttggaaactgtcttaagtgttttataaagaatccttttgtgaaactaataatcttcctctaatttagttttataaccaggattttaatgtattatatatgtgaaacaacttcttagtattttagtaactatatttaaatatttagattgttttaatttcttctagaaatgaaatactttcataaaatttagcttcagaactatggtagaattgaaacagaattgtcttgctgtgtctgtagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacaggtactgtattgaattcttagaaactattaaagaaatgggataaagtaatagtgaaaattttaagatgaaaatcagaaaaaattgttagctcttctcaagctttcagttcttgttgagagtttccacttcggtgttatgtttctgcctatatctctgcctataaaaatcaggtcttaatgttctttgggaacaaagactatgtctgggtcctcattttacccctagtacttcatgcatggtaggtcctcaacagatacttactgaacaaatgagtaaatacttgggtgtcacagaatagtgtaatggagatagtctttcatgtgatgtgcctttttgctcagtttcactacacttatttaaagttatatttagtaaaaactctaagtaaaacatatcaattccaacagtgtattaaataataaatacatctatgaataattaggatttgtactttgaatactagcttataagtcaagatgcttttgggtgcaaaaataaataaaaccaaaaccagctccaacttcagctggcttaaacaccacaggtataatttgatctaggctctgatggtgtttttttggtaactactcagctctgatcttgtctatgttacctttctccttagctggttacaaagtagctaccagcagaaactggtaggtaagggaaggtgacctgtttgtgcctggtggcaaagagaaagtcttcattcttttactgatttttaaaatttctttggtgacacgatctcattctgtcatccaggctgaagtgcagtgatgctgttcagccttctgagtagctgggtgtgtaccaccatgcctagctaattttttttttttttttgtagtgatggggttttgccatgttgaccaggccggtcttgaattcctggcttcaggtgatctgcccacctcagcctcccaaagtgtcgggtttaccagtgcaagccattgcacccatccctggcctgttttacggattaaataaaagttctgagttttactctgattggaccagtgaaaccattttctagtagtgagggaaatgacatgaactgatagctgtaggcctgggttacattcaaacctgtaaataagtcactctgacagaggggatgggattatcctaattggcttaggaaactcgtgattcatttctgaaccaaatgaaccttggtacagggtaagtataggtatagccaaactgttacacaatagggctgtgatgcatttatgtagggaatgtaatcacagtgccttccatggcaaggatgattaagcattagaaaaatctttcagtgtggtttaccacataaagtggtgaagagtgaaaaagtatcagtagataaagaacaagcactggataaaatttaaaattttacatgtatatgcacatgtaaagttcttggaaaacttagaaggaaacttgcttaatcaaatatctatcaaagtcttatgttttatgctgaaatttaaaatgcgttaccatcaagatatattgaaacaggagcagttagggcatgatagctatcaccatagctctttgacgttgtactaaagaatccagccaatgcaagatgacaggaaaaagaaatgaagtgtgattagaaaaaaagtgaaaaaattctcatgattggtaaagtatttaagaaagtgaatggataagctattagatttaaagactttttgccaggcatggtggctcatgcctgtaatcccagcaatttgggagggtgaggcgggcagatcacttgaagtcaggagtttgagaccagcctggccaacatggcaaaaccccgtctctattaaaaatacaaaaatggctgggcggggtggctcaagcctgtaatcccaccactttgggaggccaagatgggcaggtcacgagatcaggagttccagaccagcctggctaatatagtgaaaccccgtctctactaaaaatacaaaaattaactgggtgtggcagcacatgcctgtagtcccagctactcaggaggctgaggcgagagaatcgcttgaacctgggaggcagaggttgcagtgagccaagactgcaccattgcactccagcctgcgtgacagtgagactctgtctaaaaaaaaaaaaaaaaaaaaaaaaaaaaattagctgggcagggtggtgaacacttgaaattccagctgctcaggaggctgagacagaaaagtcacttgaacccaggaggtggaggttgcaatgaactgagatcatgccactgcactccaacctgggcaacagagtgagactccatctcaaaaaaaaaaaaaaaaaaaagatttaacgacttttaggaaggttagcaccaacagtagaaaataaaattgccattcataataccaacaaaaataataggtaacaaggaagaaacaaaaatttatgtaaaattttaataaaattataaaatgttattgaaggaaatgaacacctgaatgaatggggagagatgccatgttgattgataggagtcaaccttgaaaagatgtaacttatctccaaattagtctgtaacttgggtgggaatttcaaattttcagttatttttataaacattctgaaatgtatctggacaagtagaggtacacaggtagctaagaaaatttttaaaaagaatattatgtattaagatagactacagagttacagtgattaaaccaatgtgatattggcttgttatagaagtgaatcactagaacagggtaccagaaacaaacctatgtatataaaggatttcagtatatgacagaattcgcttcacataccactgggggaaatggtaactatgcagtaaatagtgttgggacagttgcatctttgagtgcaataaaataaaattaggttccttagttgtacataaaaattatttttagtgaatcagatatttaaagtgagaaataagcctgtaagaagaaaacaatggagcatatttttgtgattgtcaaggtaggaaaagccaaatcacaaaaggaaaagatagttgcatatcattatagaaaaatttaagtctggcctgggcatggtggctcacacctgtaatcccagcactttgggaggccaaggtgggtggattacttgaggtcaggagttcaagaccagcctggccaacatggtgacacccggtgtctactaaaatacaaaaattagccgggcatggtggttcatgcctgtaatcccagctgagaatctgggcaggagaatggcttgaacccaggaggcggaggttgcagtgagccaagattacaccactgcactccagcctaggcagcagagtgagactccatctcaaaaaaaaattttaaatctgagtgcaaaagaccatttaggttatctatttcttcttgagtgtactttggtgttttcatctttcaagtaattggttaatttcacctaagtatggggatagagttgtttctctgttatagagtaatattctcttattatccttttaatgtctgcaggatgtgtattaatatcctctcattcctgatattgacatgtattacatatacatacattgaaaaacctaccagtctaataattttgctttcaacagccatacgtatatttccttgagcactttaaaaatgcttttccagtgtcttcttgtctccattgtttctgataacaaatctgaagggatttgaatcattgttctcctatttgtaatatgttatttttctttgctttcagtacttttatttcattgttttcagcagtttgattatctgtgtgtggttttctttgagtttatcttttttttttggatcactgagattcttgaatctgtaaatttatatctttaaccaaatttgggagttttcacccattatttcttggtaattgttttgtttctacactaatctctttcttttctgggactcagtagacaaaaatggtagacatttccataccgttctcacaattccttaggctcttttcattgttttccctgtgttcaagctcactgactttttactttgttaatctccattctgctattgagatcgtctgatgaatttttaattttagatattgtatttttctgtttttaaatttacattgttttttaaagtttttttgtttctctgtggatagttttgatatttttattcattacaggtgttttcacgtttattttatggattatttatggagcaactgggacatcttgggattggtctgtggattattttttcacttgagaatagatcacccttttatgtttgttgagtaattggcttgttcccagagttttcgaatcttatgttttgagactatttcttgttaaaatcctctgaagaatgttgactttttttttttttttttttttaaagcagacattccacctggttgtgtccaaactgcaagatctgtcttgctttctggttccaaagtattttcaattctcaaaacctttgctgtgcttcttcagtctgttccacatgcatacacagtttgctagtttacacgcagagttaggggattatcttcttcagctctctcctctctgagatttccccacactctctggcttccttgggccattttccttctacccctgtgttagaaagacaggtttctttcttagagtttttgctgctttgtgctgttttgcagaatcatatgtctggagcactttatgacaaagtggtgagagaaaagagagggaaaaataatagagtttttcttttccatttttgggttataggggcctctttgctttggtattttagcctttgagacacatttcttttcctccagattgtagatgcttacagtaccaccgcgactaccagcatttcaggtagttctgtggtcggggctagtggtagaactgggagagaaaacaaaacagaaacaagtcatgatttctcagatactctctagtttgcagggacttctttttctgttatttggctggaaagattggatttctttgttttgttgctcactgctattctgcaactcggaccacccttaggtcaaaactgggaggtgatgatgagaaaaatggaaaactcaccactgtaatagaggttcagattttcactttcctctccactctggctgttcctatttactttttaaaaggaggctggatgtggtggctcacgcctgtaatcccagcgctttgggaagccaaagtgggcggatcacttgagctcaggagttcaagaccagcctgcgcaacatagcgaaacccaatctcaataaaaaaagaaagaaagagtcctccggtcgttgctttttatattctgtcgaaagttttcaggtataatctgtgggagagataacttataacagtaggagagataaattgtaacaggcttatcacttcaatttcactggtccagttcaataatcttgagtctgtttttgcttcagctgttttgaagttctgctattaagggcatagtcacttagaatttttgtgttttcttaatgaattgaccattttagccttgtgaaatatccgttttctttttgttaaaattccttgtcctgaagtctagtttttcttatattaatatagccacttttggtttcttatgattagtatttgcatggtatatatttttctttttcctttttttttaaaaaaaattttcatctatttttatctttaaagagtgtttcttgtagatacctttttaaaatccagtttaacaatctcagtcttttagttgggtttagactaggataagtaaactactatctgtgagccaaattccacttcctacttgtttatggtgtggcttgcaaagtaaaatggtttttacatttttaaatggctctaacatatcaaaaggagaataatattgtgacacatgaagcttatatgaaattcaaattttagtatccataattaagttttaagttttgtcaaaaaatctgtggaaggtttttttctcacttgtataaatacttgcataatattgtagattttgtctcttggcccaccaaacctaaaatatttatcatatgaccctttacagaaaaagctgaccatttacttttttttttttttttttgagatggagtttcactcttgttgcctaggctggagtgcaatggcacgatctcagctcactgcaacctccacctcctgagttcaagcaattctcctgcctcagcctcctgagtagctgggactacaggtgcatgccaccatgcccagctaatttttttttttttttagtagagatggggtttcaccctgttggccaggatggtctccatctcttgacctcatgatctgcctgcctgggcctaccaaagtgctgggattacaggcatgagtcactgcgcccagctgaccatttacctttgatgtaattttaaatatatttggatctaagtgtacttactctcttgctgtttttctctgtctcttctgttcttgtttttcccctcctttcctgcctttagattatttttaatgttctattttatctccattattggcacattagctatataattttgtcttattattttagtatttgctctggagtttataactcaagtctttaactcatttacattctaataatgtcataacactttatgtacattgtaaggatcttttgttaccttctagattttatgcttctgctctcattcattttgctaatacatatgttagaagttctacaaaatactgtggttttttttttttttgctttagtctgttatattttgaagaaattaaagagcaaggaataggtctttttctcatatttaacttctcgtgctcttcagttttctatcattttcctgtagcccaaggaacttcctttaacattcctcttctgcaatttagaaactgctgttatattcacctggggaatattttactgcagatcttgtattttttcagctctagaatttcttttggttcttttttatgtctttcatttttcttcttattttgttagatgtttatctttaaatccttgatcatatttataatagtcgtataggccttctttgcctattttatcatttcttatttttggatcagtttctgtactgttttatatttggaatctgtagagtcatgaatcttgggttacacaggtttataaaatacctcttcaaacaacttctttttggcctcctcttttctctttttatttatattattttttgttgttcctcactggttcacattcatcttatattttttctgtttttaagactctagttacacatgttagaccacttgaactacgtaatcacccaggctcatcagtcttattgttgctgcataagtgcttgttacattaagaaaagtatgtaaaaacatacatgtatataataatataatacaaagtaatttaaacatattaaaatgtatttgtagttttttatttatcccttttgaaatacattatattgaactgactgaaaaagggagaaaaacatgtttcagtggttgaagaacatggtagatgaagtagttcattttgaatggctttagttccttaacaaaaaagtcagtggtgaagttgcatattttagtataatatttaggagctgcagttggggaatttgaaatggcttttgtgaattatttattaaaatcctatcctacaagaggaatcctggtaatggcagtctgaaaatgttgcaaggacctagttcaagtgatacatgtatgcttaattttgtgcggcatgaatgtaggtaacagcggggaagccaagcagaatgtggattttaggtaggggcatgaagggagaatgttatactacctgatacacggagatggatgctctctaaccacaattggacctttgctgcctgctgttcttagaataaaatgaacagttttttttttttaaagaaattcattatgatggggatggaattgggcgaagcaatcgtagattcattcatcaaaaataattattttgaggaaaaaaattccattggaatacttatatagttcattatagttcatagaagccagcaagccaggaatgagggaaataaggagcttgacacttgttgttggtatgagatgtaacattttaacattgcttgtttttgcttaggaagttaggctgcttaataaatgtggtgcagtgaaggatctttacagtcaagataaacttttagctgatttacttttgtttaatcctcattattttggggctaattcacagtatctttagtatagtttttcctccttattgttctatatcacttgttaaccaaaaagtggcaggtctcaatccatagaggtttacttagtcaagggtttagtatgtgcctgggaaaaacaagccacaggaacagttgtgacctgtgcttttctagaggggttttgggaatttcggtgtttaaacggggaaagggcaagcacaggttaaaaaagagggaaaggtaggcagtgaggcaaatggttgcattcttgtgaggctctgactagcctcaataaatctacactttacatgtgaaaagagggagtagaggaaaaagtcatttgggttggttccaagtctttgctattgtgaatagtgccgctataaacatacatgtgcatgtgtctttatagcagcatgatttataatactttgggtatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgctgtttcctgactttttaatgatcaccattctaactggtgtgagatggtatctcattgtggaaccaacccaaatgtccaacaatgatagactggattaagaaaatgtggcacatatacaccatggaatactatgcagccataaaaatgatgagttcatgtcctttgtagggacatggatgaagctggaaaccatcattctcagcaaactatcgcaaggacaaaaaaccaaacaccgcatgttctcactcataggtgggaattgaactatgagaacacatggacacaggaagggaaacatcacacaccggggcatgttgtgaggtggggggaggggggagggatagcattaggagatatacctaatgttaaatgatgagttaatggatgcagcacaccaacatggcacatatatacgtatgtaacaaacctgcacgttgtgcacttgtaccctaaaacttaaagtatagtaaaaaaaagaataaaaaaaaaggaagtcaattatgcattcgtcttagtgtaggtgaagggacgatttctggtcttgtcctgtgtctgtgaagataagctgataattgacattgtgaggatgagatttgacagaactcagctttagagctagtttatagggaggatacatatcttaaatgatttaggggctcacacggaaattccttgtgagtaatctgtgagggaagccatctggggagatatgtgcccttctatcgttgtgggaacctggcatatggataaggctatgacacagggttgtgaatttacagctatctgggaacaaaaagaaggcagtatggtgtgactcggttcccaagcttatcttttgctttggcatagtcagtttggagaccagaggttctgttgttcttttacatacttgtactctatctttttgagttttttttaatataaagcttaaattttttctctcatctgaagaacttacagctaagtaagataatattttgagagattcaaaagtatgaaatggctggctctggaactctgacataagatttaggattataaaatcctagaatcctagattttaaatcctaaaattttaaaatataaaaggagtgaaaatacagagagacctagattttgtttgaaatatttcatttctttttgggcattggcaagattataatgatggtggagttttgcaatgacttttgagtgtttctttttttgtttcttcagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgaggtaagctctaatttgtttttctttagacacatattaagtcttttgggtggtggtgaagatgttatagcatcatcaggtgtagaacttactgtgaactcacactgtagacatgcagagtaaacatgtttaggcttagactgtgttcattgtttgaaaggggcatttgaacaattgtattagtctattcttgcactgcaataaagaaatatctgagattggataattgataaagagaagaggtttaactggctcttggttctgcagggtgtataggaaacatgatgctggccatctgctcagcttctgggagggaggcctcaggaggggaggcctcaggaaacttaaaatcatggcagaaggcaaggggaagcagaattgtcttacgtggcaggagcaggagcaagagcgagaagggggaggtgccacacgcttttaaacaaccaggtttcatgagaacagctatcatgagaacagcaccgaggggatggtgctaaaccattcataagaaattgttcccatgatccaatcacctttcaccagccccacctccaacattggagattacaatttgacatgagatttagacggagccgcagatccaaacccatatcaacaattacgcttagaatattataaatagaaataaaacggtaaaaatacttgtaatatttatttctctatcctgaatgagcataaaaatctgccttcagcttctgaagtaatagtggttgaaagaaactggagtgagccatagattttaagttatttacattagactggaaagaagcaaaatggctttttcctcttatgcttaattaggaataatacattacctcagctgaacctttagtttctttaaatgtaagtcagggccaggtgtggtggctcacacctgcaatcccagcactttgggaggctgaggtgggtgaatcacttgaggtcaggagttcgaaaccagcctgggcaaaataatacaaaaatttgccacgtgtggtggcacacgcctgtaatcccagctgcttgggaggctgaggcaggagaatcgctcaaactcgggagatggaggttgcggtgagccgagatcatgccactgcactccagtctgggtgacagagacccccatctcaattaaaaaaaaaaaaaagtggccgggcgcggtggctcaagcctgtaatcccagcactttggaaggccgaggtgggtggatcacgaggtcaggagatcgagaccatcctggctaacacggtgaaaccccgtctctactaaaaatacaaaaaattagctgggcatggtggcgggcgcctgtagtcccagctactcgggaggttgaggcaggagaatggtgtgaacccaagagatcgtgccactgcgctccagcctgggcgacagagcaagacgccatctcaaaaaaaaaaaaaaataagtcagataatgttattctcctacattcggcctttccctcagtcacacttgtggttatatttgaaatccttatcatggttaggcactgttgacctactgctccaacttgttcttcccctcttcgtccttccttcttttcttcttagcctgtttgggctgctgtaacaaactgccatagactggtggtttacatacaacagataattatttttcacagttctcgtggttgggagttcctagatcaaagctccagcatatttggtgtctggtgagggcctgcttcctggttcatgtgttcttacatggtggaagagagtgtaagagctctctggggtttcttttataaggatactactcttattcaagaggactcccttctctctctctttctgtccttctgtctccctcctcccttctctctcttcattcatcaaaagaagatgcagatttgtgtgtatgtgtgtaagatgtgcaagaatatgaagataatttttttttttattatactttaagttttagggtacatgtgcacattgtgcaggttagttacatatgtatacatgtgccatgctggtgcactgcacccactaactcgtcatctagcattaggtatatatcccaatgctatccctcccccctccccccaccccacaacagtccccagagtgtgatattccccttcctgtgtccatgtgatctcattgttcacttcccacctatgagtgagaatatgcggtgtttggttttttgttcttgcgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatataccgagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgttgtttcctgactttttaatgattgccattctgactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgtgaaaattttcttccattttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatttattaaatagggaatcctttccccattgcttctttttctcaggtttgtcaaagatcagatagttgtaggtatgcggcattatttctgagggctcttttctgttccattgatctatatctctgttttggtaccagtgccatgctgttttggttactgtagccttgtagtatagtttgaagtcaggtagtgtgatgcctccagctttgctcttttggcttaggattgacttggcaatgcgggctcttttttggttccatatgaactttaaagtggttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaggaggtccttcacatcccttgtaagttggattcctaggtattttattctctttgaagcaattgtgaatgggagttcactcatgatttggctctctgtttgtttgttgttggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctgattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgagtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgtctttttttgttttccatttgcttggtagatcttcctccatccttttatttttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttactagattggggaaattctcctggataatatcctgcagagtgttttccaacttggttccattctccccatcactttcaggtacaccaatcagacgtagatttggtcttttcacgtagtcccatatttcttggaggctttgctcatttctttttattcttttttctctaaacttcccttctcacttcatttcattcatttcatcttccattgctgataccctttcttccagttgatcgcatcggctcctgaggcttctgcattattcacgtagttctcgagccttggttttcagctccatcagctcctttaggcacttctctgtattggttattctagttatacattcttctaaatttttttcaaagttttcaacttctttgcctttggtttgaatgtcctcccgtagctcagagtaatttgatcgtctgaagccttcttctctcagctcgtcagtcattctccatccaggtttgttccgttgccggtgaggaactgcgttcctttggaggaggagagacgctctgcgttttagagtttccagtttttctgttctgttttttccccatctttgtggttttatctacttttggtctttgatgatggtgatgtacagatgggtttttggtgtggatgtcctttctgtttttagttttccttctaatagacaggaccctcagctgcaggtctgttggaataccctgcagtgtgaggtgtcagtgtgcctctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcccggctgctttgtttacctaagcaagcctgggcaatggcgggcgcccctcccccagccttgctgccgccttgcagtttgatctcagactgctgtgctagcaatcagcgagattccgttggcgtaggaccctccaagccaggtgtgggatatagtctcgtggtgcgcccttttttaagccggtctgaaaagcgcaatattcgggtgggagtgacccgattttccaggtgtgtccgtcacccctttctttgactcagatagggaactccctgcccccttgcgcttcccaggtgaggcaatgcctcgccctgcttcggctcgcgcaccgtgcgcgcaccaactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcttcgataatttgtttacttgcattgttagtaccactttcctctccctttctctgtcttcattcactacattccagttatactagcctctgtattcattcttataggacttaccagtcatatttcccgccccaggaccttggcatattatctttatactccctaagtaaatctttccctgattttccaatgctttttgtttcatcttagtaaacattttatcataagaagccttccttggttatatcatgtaactctctttcctcatactgggccatttttttttccttcgtagcacttttctttgaattgatattatatttatttgcttattggtttattggatatcttcctcactagattataagcttgtgagaatagtttctttatatttttccctgctgtagcttcagtggctagggaagtaagtgattcattgtaagattttagcaaatatttgctgaatgaacaaataagcagaccaggtcaaggaaatgaggttgaatttgtctggagcctggaatattctctgaaagttgctttaatcttttaaaaaccctttctgatttgcctcattctctaaagtttagaatgtgggaaaacttttgctaaattccaagtaccaaaatattggcaatataaatttagaaaattttggtaaaaatgctttgaatttttcaggaaagggtttgcatgtatattgtttatatgttatcgtctaaaaatgtcaaaatgtctttttaaagaaaaattgttttcaaagtgtcttctatgctatctgtttagcttcaatttgccaaacacaccttgacagagatttagtgttttgacttgcctctttattcctggggttgtccccttaccctcagtttctaaatttgagatcttgaaggggtcttgaatgtgtagatcagtccaggacttaggatttgttttgttttgttttgtttttgtttttgtgtttgtttttgtttttgagacacagtttcactctgttccccaggctggagtgcagtggcacgatcttggtgcactgaaacatctgcctcctgggttcaagcgattctcatacctcggcctcctgaatagctgggaataccggttcccaccgccatgcctggctgatttttgtatttatcagaagagatgggatttcaccgtgttggtcagactggtcttgaactcctgacctcaagtgatccacccatctcgacctcctaaagtgttgggattacaggcgtgagccactgcgcccaaccaggacttaggatttgtgtagggaaagtcagataattatttgcttccaaatcccagactcctttcagcttttgtattccgttgttgaattcatctttggaaccacctgaccttttctgtggtagaaagggcctcagttgaacaatgaattagggcttagataaactaataggtgctgctctgtatagaagtgggctctccaggaatagtctatactattctagattggcattccttttgccataattgaaaaagactagatttagggatgggtgatagagatgttaccaggcacgtatacttagctttggagtaaatgagttggttcataggaaacacaagaatgaagaaattgtgagaagataataaagaatttatgtgtatgtgtgtgtttgtgtgtgtgtgtgtgtgtgttgtgaatatgaagacaagttgttctctcttgcattgttagttccagtttatttttgtgatttttaagatagttatgtttggccagatgcgggggctcacgcctgtaatcctagcactttgggaggccaacgcggggggtcacctgtggtcaggagttcaaggctagcctggctaacatggcaaaaccctgtctctacaagaaatacaaaaattagccgggtgtgatggcaggcacctgttatcccaggtacttgggaggctgaagcaggagaatcgcttgaactcgggaggtggaggttgcaatgagccaagatggggccacttcactccagcctgggggaaagagcaaaactctgtttcaaacaaaacaaaacaaaacaaaaaagatagttattttatatatcatatattgtcatagtaaaactatttgttctttttttttaaaaaaaaaaacctaactggaaatatgtctttgttcttcgagaattaatattttatctaacttttcattactgttctacagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagtataatatagtatagcaatttgctatagagatgaattagggtaatatttttgagctctaatttcactgttgtataaatatgttacataaatttggagtatgtttctaaagacaaaattaatatttgtaatgacatagaactgaatgtggaaagccaagtctggtatatctgcataggtagggcactctcacagcttagcagttgtcgtagaaaaatacaactggatgagttgcctttccaccttaccatggtagtaaattgcttatgctcagaagggagactatttttgcagctctcttattattttgccctagtagattggtccatgtgattttaaaaagtgcctataacgatacctgtttctctgatgggcttgatagttgcatattgctttcatttagatattgcattaagattattttatcaatctctgtggttttcattgatgattatttgttttgtgctttcttgctcagaggctatattttgctccagagaactggcttaaataaaattacaaatgctcacttaaagcaggtataacaacttgtagtcctttgaaaatgctagtaagtttttttatagaaattactaattggtagattattgttaggagaaatggtttagattaaatgcagttaattacatagggaaatcttttctacatctattgaattatccccaattttaaaatgttgcactgttagacacttagtacttaaaaccatttcaaaggcattcataaatgggtgtggatggcaatgtctcaggtatgtttgcttgtgacaaaataaattatcagcagaaaatgctgaaagcaatagttattctagcctctatcatgaaacatgaataaatcattctattaacaggagttttgagtttatttctggcgacaaaatgggaattaatggaaatatggatttctgtgagtttgatacaaagcatgatggctatgtcagttcttgtgccctggtgatcagtttgctttacactaaactgaacatgcacagacacatataatttagattgtaactgtagaaattctctatcagaacccatgccttctgaaagaagttgaagttttgtgttttgttttttagataaggctttatctatttttttcccagcacttacatatctatgtgtatactgacttcttgttcaaaatggtctgatagacaggagagtgaatgagtataagtatgctgctagtgtgcctagcatatagtagacagtgaatataaatatgctgaaggaatatgtatgtttctgtgaatgaggggggctatttctgatccttacgaactccactacagaggtggggaagcagatggtagaatcctggcatttcatgttggcagccatcatttaacccacctgtgtgatttccgaatcactggagctcaacagcaaggaaatgagctttgaagacctggaaaatctgctgcttggagagagagaaatgctgctgcagaaggatactgaattgctgcaagaagtttccataactaatggtatgaaactgtcttttggattgtagcattcacttgggtttagagtaggggaagtgtttatttttgagagcttatcatggtaggtaagtagtggaagaaaccctgggaagttcttggccagaccattttggatatagtattaaataaatgctgtttctatagagcatattttttccattgcacgttgtaagaaagttatctccatctattatttaattttttgagtgcattttagaaagtattacattatgggggcattagtggtaaaatatattgtttgaaggagaaatacatgacagtggtcattaaaccttattatgagacattatttctttttaaaaaaaattttaaaaatcctcctccaggtaatgaatgacacatcagttctaaatgaggaataacccaatataaatagagagcttatgccaggcactgtgctaagcgttcatttgatactcataacagcccgtgaccaggttggacttattagacaagtgactttatgtttctctttgcctggagcagttctattttatgcttattgtccaggtttttactaataccctcatttttattctcaaaagtgttgtggtttggatgataaattgtttggttaccctttgtttatcctgtggctaagagactgggtgatagagctgggttttaagttgaagtctttgactttgaagagccatacagttttcagtaacaactttcctgttgcttacatattataaaacacaaatgtggatttttgtattttagttatgttttataaagggatttattggtaacatagcttgcattccatttacgttttgtattttacctggcccttttgcagaagatgtccaacatcttcctctctgccctacaaaataattatggttgtaattaatctgaagtcttctagttacatttactggtcatccggttgtctggttcccagaagttttctgttctttgataaacacctttagtcgttagtatttgagtgcctcttgatgggcacaaacagttggcagatagttcaggaaccagctgacaaacattcttactgcttaagtatgtactgtgcagcaatgccacaaatttattttttatttttattttcgcagagttcgtggatgagagctgaagaggtttgtcgttaaaggaagatttctgaagcaggagtagcagcatggctgccactactgtcactgtgatgcttatttcactataaaatccctcaaactgcaggcatcaacaatggtagaagggaatcccagtgagggtgatggccctcttgaacacctgtgacacaaggattgggaggtcccacagaagggttaggacacatttgacttgcaacacttggatgtgcttctgcaggactgtgctttagtagatttcaataatctatggcaaaagagttggacaatccaaccagaagtatcttgaggtcaatgatctttgtataaggagaatgatatgctaggcttctgctgaagaattgcagaccaagcaaggtatcagaaagtgtagtgaaaaaaatacaaggaggcacctgttcttgtcacatctttttggatatattatataaaactttcaaaagatacttttaaagtgttaattgagtctttctaagattttatttctactagccagtgtaaccattctatgcaaagcagattttgatgatatttgtgtgttttaggatactattcagtattagaaactctgttacattatggaagcatgttttttgtcatctggtgttaaaggcattcagagatacttcttgataaatatcaagggcatcattgggaagatacttattcttattgcattgttttttcttggggttgcagatatgacactgtataaaagaaaacgtgttccttgcatgggaaaatttctttttctttgagatggagtttcactcttgttgtcaaggctggagtgcaatggcgtgatctcggcttactgcaacctacacctcttgggttcaagtgattctccagcctcagcttcccaagtagttgggattacaagcatgcatcaccacacctggataattttgtatttttagtagagacagggttgcaccatgttggtcaggctgctctcaaactcctgacctcaggtgatccacctgcctgggcttcccaaagtgctgggattacaggcgtgagccaccacacccagtggagaatatcatttctaaacaagtatttatttaattgttatgttagctaaatgcctcattttggaagataattcgaagttatcttgttagtgttttccttaaatcaattgatttttatgattttaaaaaagtttcctggtagtgtgcctcttattttagctccttcccatgaataatgtatttgagctagctgttttaaaaattttaatacatacctttcaaggtgcctttcatagaatgatttttcacatttatttcttgggtgaactttttatttttttttttgaggcagagtctcactgtctcccaggctggagtgcagtggcgtgatctcggctcactatgatctccacctcctgggttcaaacgattcttctgcctcagcctcctgagtagctgggattacaggcacatgccaccacgcctggctaatttttgcgtttttaatagagacggggtttcaccatgttggccaggctggtcttgaactcttgacctcaaatgatccacctgcctcagcctcccaaagtgctgggattacaggtgtgagccaccatgcctggccttgggtgaacattttcttgatatatggtgtttccaaaagagtgagttatctttcaccagtattaatgaaaagacttcatcttggagaaactagctatgttatttattttaaataaatacctttgttacttaataacagtgtttggacttttaagatgtaatacatatttgagaatttggaaaatattgaaataaaaaagaaaataaaaggtgcttaaaattccgccgcagttaagattttggtgtatctccattccagatatctacatgtgctctcctccctgcctcttcaaaaacaacagcaacaaactcaaacagatatacagttttgtgtttagtattttctatagatactgttttctggagaaagattgtattatttatcaataaaccttttccttctgcaaagaaatgcccattcaagactatttgtgtgtatgtgttttaataagtgtgacatgtattgaagtgtttgccatggtatgtgtttttaatttcctttcttgatgtacagttagcccactatatttgtggattctacatccatggagtcaactaaccatggctttaaaatatttgataaaaatgtatggtttcatctgtactgaatatctatagccttttttccttgtcattagtccctaaaagatacagtataaaaaccattcacatagcatttatattctattaggtattataagtaatttagagattaaagtatatggaaagatgtgtgtaggctatatggaatattacacagttttatataagggacttaaacatctatgcattttggtatctgggagttttggggggtcctagaaacaattccccatgggtaccaaaggacaactgtaattggttatccagtttgttataagatactgatagtcattgtttctgaagtttatcttgttaattcttggattactgtttcagcttattcacagactctagaattcacaatatattttaactcttttggtagaaatggcagcttgtaagacatagtattaaatgcaatttgattgctgttaatgaaattaatgtactgtcgtgttctttctccaaaagagagatagatggaatcttatttttttttctccatcattctgtatcactctggctcagctccatacgcttaacctttctataaagaattttttgaagccttgccagatgctttagaatttgccaagttctttgactttttttgatatggccttctgatgtgacaagctggctgatctgacataaagaatgtgaaaaagaagagatgagaaaggggaaaaaagaataaatatggctggggtttaactaccaatgtatgcaaaattacatacaggtgttctcctgttttcacatacagtgctttcttaaaaatacgcttaagtccgggagtagccagaaagagtcatggcccaaaaccccctaacagcagttagtgtggcatctccacagtggggaatgttgtaggagttattaagaaattattttaggcatatagagatgaaaagggatccttgggaaattttcattttttaaagcatctctggaaaagtttcttgtaaagccccagctcttagagccaggccagcaacctataatatacaaatggtagccattagaaaccgggtccacccaacatggcaattcccagggccttcttgcccttgccccacatgttcctggcaacatggctgcccacacatatccttgcgtgtggagagcatcatggtgccctgcatttgcatatgaaaagctagggtgggagggccagctttttccacctgctacgtgaattgcatgcctagtcaaacccatcccatgagccctatgcaaatcagacatcacgtcctccagcctctgcatatatacctggttagtatgcatggcaggtggtgttctgtctcttggctttggagcccctctccctctgtctctgtatggggagccgctttttttttgcccttgtttcttgcctattaaactccctgctccttaaaacaaaactaaatatacactgaagttaaatgtataaaaatcagacagtagactttatatttcatttaggagtaggaagtggagaatacccagagaactaaaagtagtttaaagtctctatttacacttgaccttgtaggcatagtcttcaatgacatatttctagcatattctttggttctgttttcctctataaacacttgaattattgggctaaatccagtaactatccagctgaggctgaacctttctgtttttagcttatctaatgattccctctcatccatccccaagcacattcaacttaatatttgctggagtacaggctgtatgttctctcttgtatttctggcacctagactaatacttggtatgcagaaggtgctcaaataatatttgttgaatgaatgagtttattgtcttaattatataagttttgaggcctacagttcttattagcatcaatcttttgctgcttttttaatttttactcatataagattaaaatggggatagcatggtaaaataatgaagaaattttgggaacattatgatataaatatggtgctactgcagaagttgaactttagactggcaggtaggatttctgtatagttgttaaaagttaaaactgttaatttggcattgagaaggcactttagggtaatcattggttaatgggtataaatgtggcattcggaagtttttgaatgtgttagactgtgtgtgcttgtacaagaaaaagtggcagaatatgtgaataaaacaaaggaaaacagaagacctcatactttaacagactcttctgttatagggagtattcctgtttcaagcaagttacaaatattgtattcctagactaatacagttcaagaagtactttgaattcactttatctaaagtgagggatttattaatgttcacagcattcttcttatctgtacttcccaatgtgacacattgaaaatatttttttaacccttcacatttcaccttgttttctttgtcaacctatgcgtgggctgagagatttggagaatctttggtgcttcaagctcacaagtttgtgatgatctgatgcttcttttggaaccaagaagtagaataacttctggagaagtgttggatttagagtacttcttcactttaaggaaagaatatgagctatacacacaaatacacacacatatgtatatacatatatatgtatatatgtatgtataaaagtagtcactagagtggcctaataccaatagaatagataagaataagaccatttcagcattcattctgggaacccaacacttatagcacaacaacattgagtaaaaatactggtagctctttatgttactgactgtattgctaaagccagtatttgccttattctatggttctgtatctagcccctgaggctgagggaagtgaagagagaacttggagacttggccaaaaccttgtttgtgagagtgtgttgggaagattcagataccaatatcattttagtaaattatcttaggatacattcaatttcttgtatattttgaagcctagaaatatctataaataaatacagtttattttgtgaacttaaattagttcaatatctttatcaccatgtttaaatgtcagagttgtgagaagcaaatatttgaaagatagctttttttttttttaaagtaaaaggaattccttctttctttctttctttcttttttttttttggagacagagtcttgctctgtcacccaggctggagtgcggtggtgcaatggctcactgcaacctccacctgccaggttcaagcaattctcctgcttcagcctcccgagtagctaggattacaggtgtgcaccaccatgccctgctaattttttgtatttttagtagagatggggtttcaccatgctggccagtctggtcttgaactcctgaccttgtgatctgcctgccttggcctcccaaagtgctgggattacaggcatggagccactgtgcccggccctcttgcccttcttcattcttaagatgctcagatcctagttgcagctcctaaatcatagttctcttctggtctccagtatgtatgctggtggtgcttagtgttgaactttatctgtatatatttgaaaaccctcctcagatttgaacttaagtttccatgaagtgaaatgtaccccattattaatttcaaagtaaaaaattctgttaatttacttcttaagcgatatttcttcaatatttcccttcttggacttcacattgatgatagtttttaggttgtaataatttagagtttggatggtctacatttaccatctacagttgtttactccctctttttttaatgcacaagtgatgaaaatgttgtcatgtaatatctaaacaatgataaatacttagactatatataaaaatatatattctgccaaagaaaattgtcatggaaaattgtagattcaagagttaggagagaaggatatcagaatgcaattaaaacctttgcctaatggtatttccttttttattcttttaggtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttaggtgaggcatttggaaagattaaaaattcgcattgtatctggagtataatataggcgcatataaagtttcaagaaactatacagtgttggcataaagcctcaaactgataaatatttggctggtgaattaatattttttattcttgtgcttgtcagatatttctttccttttttttttgagatggagtttcgctcttgtcacccaggctggagtgtgcatgtgcaatggcacgatctcgactcactgccatctctgcctcctgggttccagtgattctcctgcctcggcctcctaagtagctgggattacaggcgcctgccaccatgcctggctcatttttgtatttttaggagagacggggtttcaccccgttggccaggcttgtctcgaactcctgacctcaggtgatctgccttccttggcctcccaaagtgctgggattataagtgtgagccaccgcgcttggtcagatacttattttcttaatgatttaaaaaatactgatactgtagaaaatttagtaaaataataaaagtagaataaaaactacgatcttgtcagccacagtcacttttaacatttggtctcttccctttgtttatttctaggggaatttttacacaattgtatatatataccttttttttttctttatgttaagtgttctaatcaaaattgtttttaacagtaactgataatatatggtttgaccaccacttaattaaccatttcttttttttttgtacatttagaatgttttcctccagttcagatatagacagttaataggaaacagttatattatttaatgctcaactttgttccttagctgtgcctttaattctaagagtagttgctagctaggtattttatctgtagttttacagacattgaaattgaggtcatgtaaaagttgctcaagatattttttctttttagataagacaagccatattttatacattgattattttaatgaattaatttgtaagaatagtctagcctaggctagaatttgattaacttgtccctgttatgtatctctttgtccatcttttgtttatatattcatggatacatcacagtcatctcaaattctatgtgtctaaaagtatgctcttctcacttcctttgctttggatttcactgttttacaggcacttatgaccacccaaccagctaaaccagacatgtgacagtcttaagaacttcaagtaaacattattcctaaatttgttttaaaactgaaatttatcatgttgtcattttttttttttttttggagatagagtcttgctctgtcgcccaggcaagattgcagcagtgcaatcttggctcactgcaacctctgcctcctgggttcaaccaattctcctgcctcagcctccccagtagctgggactacaagcatgcaccaccactcagctaatttttgtatttttagtagagatggggttttaccatgttggccaggctggcctcaaactcttgatctcaagtgatcagcctgccttggcctcccaaagtgctgggattacaggcgtaagccaccgtgcttggccatgttgtcttttttaagatcttgcttttaactttggttagcagacaaaatataaggctcttgtaaactcaatttagaaattaataatgactgtgttgctgactataaagtttatagtcaaataaaattaatagtttgctgcctgtggcaaggtgagagtttagtatatcttaagaataagggtgttgttgcttaaatactttgttgttttgttctaaccttggaataggttattttatcattttattagattattggtaattcctattccttttgaatatttcagccctgtgcctaaggatagagataaattttatttcaaattaaagcaaggaatagagaagaaggttgtgattacagtgcagcaactttctaacaaagaattagctattgaaaggtaagcagcttgctcctaaatgctaccaaaaacttgtattgacattgttactgtctcagatgcattgctcagtgtggcttttcactatacttcattttctccaattaaaaatgaggataattaataatactttctctactttaacttagatgtaactggtttcattgaaaatcaattgctggggtaagtaaacatgaaatggttttagtttttcagtcataactgctacaactgggtttgttcacatctttttttcttgttccttatttacatacagcataaatacttttaacttttcaatcactttcgattactcttccacttagctgctggaatttcagaaactttaaaagatagatacatatttttaaaatatataaatacatacacatatacttgtgtgtcaattcacaggaaaactattcagaaaacaaaggaatggtaggacaaaagatataaataaagtcaacaagaaatgatagttctggaaaaaatattcgtaatgtagatgacaggaaaaggtaatgtctacaatatacataaatttcttaacaattggcagaaagcagaggagaaaaacaggtcagagtataaacagatcagaggaaagctactggatggctaagaaacatatgtaaagaggtcctgattcacaaaaagacagggaaatgcgaattatagtaaccttaagatatcagattgcaaaaatatgtagtgatggtgggggtatggggcaaagggaattctcatactgttaatggaaatgtaaaatgtacgtatgtcctttttgaaaaccaattaggcaacatatataaagattttaatacctataattggacacataagtcttattctagggaatctgtgctattcaaaataaaagtatcactatttaaggacatttgtaaggatgtttattaataaacttaattcaaagttaattcaatacctagtacttctttgtctttgttgctacatatttgttaaattgaaagttgctttgttatgccaaaaaggaagtgctcaaaaaaatgatgggggcatatgctaaagatagggtttgaaggggcttcaactggttacttcttgggcaatctgaacaacaaaataattaggtacttcagtcaattatcagtcagtactgaagtcaatcagtacttcagtcaaacaacaaaggatgtttattaatttaactttgaagtattatttttagtggcaaaaactggaaatacagatgcctatttggcttcaaggagcaagggaagttggtgatgctcaagagaaataaaagcctcttcatcaagactgctgtatactatgtcttattctagggaatctgtgctattggaaataaaattccaataataaatagattccctctgtcttccctccagtctctagactgggatgagggtgggaggcaattgaggcgctggctgatggcatcatggccacttctgttcctcttaaatataggagaaggtatctggcccccagttatctgctgtttttttttttagaaggtaggctatctagctccactttgttcccatctttgaatcctgccaggcaacaggaaaagttttattcagcatcttggtacagtgatgcatgcatgtgtttttaattgcttgcaaagtttggccatatgtaaaaaccatcttttataaattttaagatgcatgtgttttcatattgaacatctctgaaattgtagtttgtcttataattgatggcattttttaaatactttaagttctgggatacatgtgcagaacatgcaggtttgttacgtaggtatacctgtgccatggtggtttactgtacccatcagcccatcatctaggttttaagccacacatgcattacctatttgtcctaatgctctcccttcccttgcccccgaaccctgacaggccccggtgtatgatgttaccctccttgtgtccatgtgttctcatcgttcagctcccacttatgagtgagaacatgcagtgtttggttttttgttcctgtgttagtttgctgagaatgatggtttccagcttcatctatgtccctgcaaaggacatgaactcattcttttttatggctgcatagtattccgtggtgtatatgtgccacattttctttatccagtctgtcattgatggacatttgggttggttccaagtctttgctattgtgaatagtgctgcagtaaacatacgtgtacatgggtctttatagtagaatgatttataatccttcaggtatatacgcagtaatgggattgctgggtcaaatggtatttctggttccagatctttgaggaatcaccacactgtcttccacaatggttgaactaatttgcactcctgccagcagtgtaaaagtgttcctatttctccacattctctccagcatctgttgtttcttgactttttaatgattgccattctaactggtgtgagatggtatctcattgtagttttgatttgcatttctctgatgaccagtgatgatgagctttttttcatatgtttgttggccgcataaatgtcttcttttgagaggcatcttataattatagttgtcacctttttttcatgagatacaaaaaataatggtgagtcttaaaattgatggctttcttaaaattgatgaaaaagagctgaagatatcgtatttttgatgttgaatattacagttccaaaagaatatgattatattttgcatacaggaaccttttagtttttaggggtaagcattatatatagcagtgttttaaactttttatttggaagtaatttcaaacttacagaagagttaaaaacaatacaactagtagagagaagacctgtatactctttaccaagattgttaccaatatctcagtgttaccagtgttaccaaaatctcagatattgatgacattttacctaatttgctttgcattctctttctttttttgagacaaagtctcgctctgtcagccaggctggagtgccatggcctgatcttggctcactgcaacctccacctcctaggttccagctattctcctgcctcagccttctgtgtagctgagattacaggtgtgccctacaacgcctggctaattttgtatatttttagtagtgatggggtttcaccatgttggtcaggctggccttgaactcctgacctcaaatgatctgcctgcctcagcctcccaaagtgctgggattacaggcataagccactgtgcccagcttgcactctctttctcttctccctgctactcgctatacacacacagttgttttcctgaacacttttaagagtgagttaaatacatcgtggccctttcctccaagtgctttagtgtatgttttccaagaatagggatatcgcttacatcaccacagtatacttatcaacatacgtgaatttagcattcatacacaacttttaatctaacctgccatttgccttcctattttgccagttaacctaataatatcctttcccccactccagttcagaattcattccaggattagatattgcatttagttaccatatgtctttagctttctttaacctggaacatttccacagccttcctctgtctcttaagacttggacgtttttggagaatacatccatttttcctctttttaatataacattgcccatttttggctttgtttaatatttgtgactaaattcagattatatattgctgcatagtttatatgtccttcacagagtatcacatctggaggcagatggctatcacagagatagccatctgtcccttgatgatgatgatgttaattctgattacatagttaagatgtctgatttcttcccactatgattactttttttcttccttgcaaccagtaagcagtctgtgaggaaacacattaagaccatgaaaatatgctgggcgcggtggctcacgcctgtaatcccagcagattgggaggccgaggcgggcagatcacgaggtcaagagatcgagaccatcctgaccaacatggtgaaaccccgtctctactaaaaatataaaaattagctgggcgtggtggcgggtgccagtggtcccagctacttgggaggctgaggcaggagaatcccttgaacccgggaagtggtggtcgcagtgagccaagatcacgccattgcactccagccttgtgacagagggagactccgtctcaacaaaacaaaacaaaacaaaacaaccaaccacgaaaatatatcctgctcctcatcaaaatatcctccttaatttaacattcttgtatgattcttgttggatctagtctgtactatgatgattgcaaaatgattaatttctcaactcttgccttctctctacattttgtattcagtccttggcattctgatgtaaaccagagctttcccttttcttccatttaactacttgttattgatatagattcctaaatttaaccccacctcctccccccagtactatataattgactgaagtacctgattattttggtgttcaaattgccctagaatcaaccagttggagccccttcgaaccctatctttatgacatgcctgcatcatttttttgagcacttcctttttagcataacaaagcatctttcaatttaaaaagtctgtagcaacacagacaaagaagtactaggtattgagttaatttaactttgaataagcgttattttaaaatcttggacttttatgattaagtggtatattatgcctgaactgtgcctaaatgtaaaggaatgcaatccttccttttctcagtaagttccatgtttgatcaacttgaatatagaaacctagacaaatataggtgaaatagttgaatgcctaattatatatatgttctttgctaactgggtagaacatttgcacacacatttaaatatattacacaaaacaataacttagaaatgttactttttgcccacccttatattcatacaacaattttatcagactctcataatctttaatattgatatcttcatcatccttaaaactactttttgaataattttaaggcattttttccagagcacattatgtcaacttctgcctgagttgagagaaaatgccttttgaatcagtatatgctactaacattggatattttaccaaaaacacgagtacacatttgtacacattaggacaattgtttttaaagttactttgaatacataaatgctatattggttttatttctttgttaattgacacagaagagttgtattattgtgtacatgttttgagatatgtatacttgtggaatggctaaattacattgtttttattttaacaactattttgctgatgctaatatctaacacttgcaaccttggactcatatatccaacagtaattactgaatccatgttaaatttcattgcttccttttccactgattctgtcagataatctctgtaaacatccaaatgttaattgactaagatttcttcaggtgaatgactcttccctaaacaatactttgttcagcataacagaccaaattacctgtgatacagaagatttagtaaattcttggatttttctatattggtaaaagaaacatttgcatttcattggattaaatgtggtatttaatatgtttaaatcagactgtaaacagtggaatttaaggtagtccagcaggtggcagccttaccaagaaaattcttaacacctctgaatcttttttgttagactgggtctcactctgtcacccagcctggagtgcagtggtgtgatcatggcttactacatctttcattgcctaggctcaagcgatcctcccatctcagcctcctgaggagctgagactacaggcacatgccatcattcttagctaattaaacatcttttttttggagagatgggggtctccctatgctgcccaggctggtcttgaactcctgagttcaagtgatcttgacttggcttcctaaagtgcttggcttcccaaagtgctgggattataggcgtgagccactgtgcctgacccaaatctttaataactgctgctgacaaagttaatttgtaatataaaagcattggtgtgaaagaaaatccttcaaattacataatttttatcttctgaacgagaaaataaaatttatcattaaaaaatttttaaaatcattatttaaattatgtaaaattatcaacattctgggtttttttttgtttgtttttggtgacaggacctcgctgtgttgcccagactggagtgcagtgatgtgatcatagctcactgcagccttgaactcctggggtcaggctatcctcctgcctcagcctcccaagtagctgggactacaggtgtccaccactactctgggctaattttatgttgtcttatttatctttcatagagacggggtctcgcttagttgtctgggctggtcccaaactcctggcttcaagtgatcttcttgcctcagcctcccaaagtgctgggattacaagtgtgagccaccatgcctggccaatattctgtttttttttttgaaaaatatattatgaaagaagccatttctgtgtgcatccaagggtttaagggttgtttatatctagatattttgcaaattatactgcagttgtctgtcttgacccttttgataacaagcactatgttgtttatcccagaatccccagcatctactatagtgcttggaatacagagctttatacttagctacttactccttacttagcactttctcagtgccaggcactgttctaggtggtatttctgaggtataggtactattatcttcatttttcagttgaggaaactgaggtacaaaagttacataacttgaccaaggctataaaattactttttaactaagtacatctagtactagaacacatattcttactctctactgcttctttttaaatacttgactaaatcaataaaaagtatataaaagtttataaagttagagcattggctaaatttgttgtaatatggaattaataactgcacattgcaccaataaaatcctatgtattttaaagaatgtatgaaaactgttctcaagtcatgaaaacttttaatattcttttccttttcttgattacccatgttggatatcacatattaagctttatttaataactggatataaaagagcaataataatggccaacatttaatgaacacttactatttggtggccattgaacaacttttcttaacatatgaggaaggtactgttattattactgcatttttttttttttttgagacagagtctcactctgtcacccaggctggagtgcagtggtgtgatcttggctcactgcaacctctgcctcccgggttcaagcaattcttctgcctcagcctcctgagtagctgggactataggcatgcgccactacacccggctaatttttgtatgtttagtaaagatggggtttcaccatattggtcaggctggtcttgaactcctgacctcgtgatctgcccgcctcagcctcccaaagtgctgggattacaggtgtaagccaccacgcctggcctattactccattttatagatgatgaaacagaggtttaatcaggttaagtaactttggttacttggccagaaactggtagagccaggatttaaaccagggtcatctgatttctgactgtgtactcttaaaggctaaacccaattaattcttgattatatactaggtttaaaattaagccagtttgaagataaatgaattggtattctttggtatcttttcagcagaatttaaaagtgcgaacttagatgttagggcattcaagtgattgctcagaaatttcaaaccctcagtgccttgggagaaaagccaatttgtagaagagaaagctgacattaacaactaagaggagaaagcaagatcattgtatatgaaatgtgtgaggagtggtagggcaaagcttacttattgagggtctccagctgagatgttaaagtgtgtgtacatgaggtcaggctcttctggtgttcccaaagcagaaatggtgatcatttctctctctgactagctgccattattatgggttttggtatcaccacatacagaaatattgcaaaagatttcttgcatactaacacattgatatgtatttttaaagccttgatagtgtttaaaatacactattactagcactgttacctaaatgcactattactagcactattacttagcacctacttggatgctttgaatagtttgctatgctcaatattccaaaggtgagagaaggggaaattttttcagtctttgccattagtgctctgtctagttgatttttttttttgccaagtattacttcttatttcatgataaaatgattcaagacaaataataccatatacatttagaaaatgggcctctttattattccttaacatgaagaggttccaataatggtagtttcaggccttggggaagggtaatcaggaagcgatttttggcaccaggttttatgtctgtcctatcactcttctcaggggtctgccctcatattaatacttgtgctaaccagaatgaagtagtgatacagcaagcagaatataatgattagagttgttataagcacacaactcaatttgcagtgagtaacatgggccaacactgttggaaaataaggatttccatgagccacttctatctcacattgatttggggggatacaatcattatatatacattagaaaaacatcacttctaaatgacagtgatcatatcagatcatgtagtttgatcatttggagagttcagtgatgtgcctcttttggtagcaattttgcttcagttttcaatttgtgcttgccggcttgcagcacaaactatataatgagaaactgaagtgataagaaccatactgtgtagcatgggtgattgatagtacctttccttgtgttattttcttgaggaaaagatatcctagacaaggagtactgaaaaaatcacccagggactctcttcttctcatgaaacagttttttagtgtgagttgacatcactaaatttgatggacagtagaatttgaattgtttattattttttgactgctctaacttgatgttagaccattctgagggtcttttgctggatttacttagtacttatttttacttttgccttagcaagttgttacagttttatttaggtaaaaactcaagttactatcttgaagttgcctagatgtcagtctgatttggatgttttattctcttatgtgaattagtacgtttatgaacttttacagcaaaataaagaattttagatgttataataatttctcttagaggatatcattcctccctttcctgaaaatgggaatagattagtgggatgacccatattctgcataacattttaaaagctaccctgtgagcttactcacttgtcctttttgtgttttcttttaaggcagtagaaggataactctctttttccataggaaaacaggtattacttacttatacaaaagtactttcattattctctgttaatgatttcatgtgacaattgatagaaagctattggcattttcaggtgaataatttggggagtggataactggaagcttctatctgactctcagcctttgaactgaaacttgtaatcaggacagaattttcagcatcttttcattgctggcttctgttggcacccagtggggagaggcggcatcatggtttaagtattaaatgtggatgtagtactattacgtttttagcattgtattttaagaaatacttttaaaatatgagcaatgaaaacatatattgttgtctgtaatgtgttctcataagttgattgattctagatgttttggagctcattaaaaaaaattccagtttgaagtaattgtagatgcacaggaaattgcaataatagtatagagatgctctatgtgtgcttccccatttccccctatggtaacatcttacataaccatagtacagtatcacagctaggaaactggcattggtacaatttgcagacctctattgcagctctttttgaatccttttataaatcacagtatacttctataatataaacatttaatttattggtttaagaaatttggatatgtagcctggctgctaattagaagagattgggtattttaaccatatcctatccagttaccaggttattgccccttggctccaaatctgtcctcttagctgatctgcattaatggagctttaaacatttcttctttgcagcaagcacaatattaaattatgccagtagagggtgttgcagggacactgcaggaagatggggtttcttttgtttctgatgtgttacatttattgttttcttgctcttgcttattgtaagatccagggacatccagtgatgctgtgcttttgctgatgtttggttcaacccagctgtgcactcacatgcagtccctccgtgagctcatagctttggttctgtctcagtgaggccctcctacagccttcctgacacagacactgtgtgccccaggcctcgtaccaccctgccagtgagctgactctggaagccctgatttcctttgcccacctgcctgccagcctttgctggctgcagcccagagggtttcctgcgtgcctgtggtctagctttgcctgggcagtccaacaaacttctttgctattcattgggctgtaatcctgccttctccagtgaggtctgaataccacctttggtgaaaggacccaacttccacgttagttcttcttgtggtactctcccttagctttagggttaaattctctttgtagttactctactatgacagttaataattctttatagtaaattttccctgtttaaattactgtgttttctgtcctaatcaaatgctgacttacagtatctaattgaattaatatctaatgatattaagcagtccataaagtttctgatatttttccaggaaaaacaaaacaaaaaagtggttattttagataatctttttactgtcacagtaatggcaaggaaaaaacaactattatttctaccgtatgtttatttccattccacgcacagcctttttcttactaaagcaagaaaccctgcaaagtagattatcttttatttacttttttttttttaacggggagtagggagctaaagcattttattttgccttgctatgagatctagcttataattggcaacacaagtatttgaatcaagaccatcttgctattcttcctaaagccttttcatttgactcttctgtatgactttctttcttttttggggggccgggggatgtttacaggggtcagtattaagtacctataaataggatatgattattttatttctttagtaaatattgtttagttactaatattttatccgtatttgtaatagtagcatagttgttttattcccttttcaagatctttggatcatttgaagggaagagggaggaagacttaaaaatgttattttttttttagtaggactttaagcaattaattaaaagttaaatatgtcttataggtgaaattttgtatttgtgctttaaatatttgatttttaaaattttcagcatattttaataaatttactcattctttttatttccctggtattttttaaattttgaagttttatatatttaggtgaattatttcattattccactgtactacaagaaacttaattcttttataatatgaaatgtccctgcttttaaggctaattttctacttgtatactctattttattccattttgacatctcaaagacattgtttaagcagtctttcttctaccacacttgcttgttagattagcccatccagtctcatgactttaaatatatctatgactggatgattccaaatgtttttctctgacctgaggtctccaaacttatatattcaacaacttcagatcttcatctggcatctcaaagttaatatgttcaaaaatcaaactaaaaaatcaagtttgacactgtcccaaacttgttcctcctgtaatttctcacagtctttttaatttgtaacttgatctttccaattattgtagatgaaaaacttggcattttcaactccattttctctcactctacatctaattcttcattaaatcatattagttctacttccaactatgtaaagaaagaaaaaccctagaggaaagggattaaagaaaaaatacgaatagaaatgggaaaaaatatagactgtagataaaagaaaaaaattagaaaaaaaaacaaaagaaatgacaatcgagagaaaaagaaataggaactccaagtctaatcactagttttcttattttatcaaaagttaatgtaggtacttttgctataaattttctcataaaattgaattcatcattttttgcccatgttttgttcaaccctatctacatgtgttttatgagtgataatcaggaatcagtagcctgcaaaatgagcctttatgaaggagaaaaatggacttttgttaatcagctgtagctgtacaggggaagatattccttttctttatgcttttagatgtttttgaattgtgtttacaaatacattcaattgtaaaaatacttgtaaattagcacccgtttattttgatgcatatagctagtatctgcaaaagcccaaataatgtatcactatctgaatgtcctgtattagtcttactgaatggaaaagcaaaataattgattttaaatgttttaagcagggattaaaccatgtcagactttgaaatttattggttttcttgttataatcatttttaatatattttaaaatctgactgtagctaagttctcattttgtatttgaagggagttagtaaaagtactcatatttggtgggaggatggcttgaatcaggaagtggaggttgcagagctgagattgtgccactgcactccagcctgggtgacagagctggagcctgtcttgaaaaaaaaaaaaaaaaaagtgaagaaggaaagcactcatatttgagttattctgcattttaaattttgaccctttattaatgtgagaattaatgggaacattattgctaaggatggtatggagggtttttttgtttttatttttgaaatttattcaatgaaaaattttaagaacattgacctaaaaatattcttctttctgtatgttattttctctgtactggtatttttttttgtttttgaaatttgttggttgaaaatttaaaaaaagtggacctaagatattcttcttttatagcctatctgcatgttaaattctctgtactggtagcagctctatggcagtcctaagatctatttaggttatttttttcttggtgatttttcctagtgttctaggaaatctaagatagatagttagttacatagacagatagatagataaaacgatttcctacctgatgaatgaaaagagtaaccaatttttaaatctggagagactccttcttcctattactgatatcactgaagttactagagtgaaatttttaggataaatagctatagagtaccctcatctgggtttgaatcttggctttacagtgatcttggtcaagttatttaacttctctgtgcttcagtttgcaatttgtaaattgtgaataaaacttacctcttaagattgtggggagaagattagctagtaactgtaaagtgttcacaataatgcttaataaatgcatgctattattactattagtggtactattacaacaaccacagttaagattttaagactattggtcttttttgagtgataatcagaagtaagtaacctgcaaaatctgagtagactgctaccactggaaggcaaaatcttggctagagttctttagaacctatgtgtgtatatacaggcagtccttgctttgtagttatggtatacattattttctcttaccgtggttcagttacaacactagtctcccaaacacatggttcaaatttctgttaccatagtatattaacagagtaattgcaaaacaaactctgctgttcagtccacaagtcactatatacatacatgattagtgaccaatcatgtcgcttcttccaaagtctgttggtgattggtcactgtgtatctgttattcactttacttacagatagcaaagtatgtggttgtgttgcctctttgtctctggtaataaatccatttgacattttacaaaaatggataatccaaagaggaaattggccaacaaagctaacagtgctacaaagaaatgaaaagtcataatgctgaaagtgaaattgcatgtaattttagaagatgcacagtcttagaagattttaaaatggcaacagcaaaatgaagacagaatgagacctaggcctgtataaagttgtgatatgaaccatattgaaaaagtatgataaatttaaaaaaatgataaaatcactccaacatcctttagtttaagtttcactaggaacagaaagctgcttatggtttaactggagcatatacttctgctttggattaagactgtaataaacaaaaattccaatcagttttgctagcatgtcagccaaaatactgaagttagatgccacatcaaaaggaaatagtaattataaggagactggagattatgcaatttctttatctcaattttgggagaaatatgacataaagcatgcagttgaagacatcatttcagggagcaacaatgaatattatgtctgtagtatagcaaacttttacttcgctatagaagtaactttgaaggatatgaataggacacttatggagatgtagaataaatagctgtctgtgggagtgttgacactgttgctattcagtggactctagatatgcagccagatgaactttgtgaagatgaacttatcagtgtaaataaggaaagtggttgtgatgaaaagcatgaatgttccaggggaaatgactctggcaaatttttcacattaaaggaactcttggagatacttcacaacattgaacatgcaaaggataaagtttggaagttaatccaaacttagaaaggaatatgacagtttgccaagatagaaaaaatactttgtattgtaaattatatgagaaggcagcaagcactgttcaatatattcttgataagtttttttaaataattaaaatactttaatttttgtgcttcaaacaacgaagtgctaaataaacaatagttttactttttaacaattgtcctatatatttataactgaaagtaagagagtttttgaagtttggacaaaaatttttaaaggttactgaagaatcataatttttccttttgaaaaatatcattttatatgcagttttgcttatatggttatttttgtggttccacaccactgtacatagtgacaaatgcctgtgtatctttctctacttcagtctttttagtaagggaaataacagtctcattgacacaatagaagatttgcccaattatctttttgctttagcccctttggggagactgactgagattccaacttttatgaaattatttagttttagtgttttgcataaagttttgaaaaactgtgattgcattatagattttcttatttgcagttctgtttttccctttctattatgctgtcactttttcatttttttttttttttgagacggagtcttgctctgttgcccaggctggagtgcactggtgcaatctcggctcactgtaagctctgcctcccgggttcacgccattctcctgcctcagcctcctcggtagctgggattacaggtgcccgccactacgcccggctaattttttttgtattttttagtagagacggaggtttcaccatgttagccaggatggtctcgatctcctgaccttgtgatctgcccacctcggcctcccaaagtgttgggattacaagcgtgagccactgcgcccagccactttttcatttttaataataaaagtttagtacagcaagagagcgtgttcttttcctctctctccttccctaccttccatttttatcttcatggagatatatgtaattcctaatgatttgatagactaaaggtaaaagtttttaaaaaattagtttcatattgcaggacattaatacaacatctgtttttctcactttttcctgcagttaagtctaaagccgtattagtgatacagagtttttggtatttgttctagaggttaacttggtgttaaaagctgcttaaagttctattttgagtaaacactaagtattactatgaaagggagagctttctcttcttaatggtaatggtaattataataatttataattatcaactgttttatagtttacagtgccctttcatcatgagttttttcttttctttttcttttttttctgagacggagtcttgctctgttgcccacgctggagtgcagtggcgcagtctcggctcacacaagcttcggctcacacaagctctgcctccccggttcacgccattctctcgtctaagcctcccgagtagctgggactacatgcgcccgccaccaggcccggctaatttttttgtatttttagtagagacggggtttcatcttgttagccaggatggtctcaatctcccgacctcgtgatccgcccacctcggcctcccaaagtgctgggatttacaggcgtgagccactgcgccaccgcgcccggccaggagttttttcatgtcgagtttacgttgacgtaatgaacatgaaagcaagtatttgtacttcagaaatgtggaaagtgagactttgaggtttgtgatttgcccagggtctctcagggagcttatagtcttttactgacagtccttggcaggctgtaatgtaaaagaccatatagttttgtagtgatagacatgggcatgaatcccggtcgtgtaacttagtagctatgtggctttgggcaaaaccattgtttttgaaaatcagttttatcgtttgttgtatgaaggttgctttgaaatttaaatgtaacagtatagtagagcctggcttaaagttaagacattcaataaacaatatctattattatgataataattgatataatagcatcatcagctcattctcaggaggttgatttcaatttttcagtgaagtcagctattcactatattataaattatgttggatgtctcttctatactttgttgatattatgtacttacaggtattttagaacgaatgatatcagattctaattgcctgtttacttattttcccccccactatactgtaaactccttgagaaaataggtgggatagcaatttgctttttaccttatctatagagttaataagagactgttgaatgctttgaactccccagtgaaacactgaatactcctattaggtgttaatgttactaataatatctatctaatttctgacacattattcctaatagatcttgctggcctccataggaatcctggtgtgctttaatgaagtgtaattttgaaaatgactaatacagcttgacagaaaataattatgtaatttaagtgcttaaagttcatgtattatacctttcctgtttgctagaagagggagcagagtcccagggggttaggtgctttctctaaggtcatgctggttggtggcagggctttttttttttttccaggccaggaaaagattagtgcattaaagattatcaaaataaggtgatgagtattgctacttaagaaaaatccaaacctctaaggctccttttgcagtacaatgtaatatagaaatattatgctgagaaaatgtgaaatttcatctattttatcattcacctggaagtgcttgagaaacaaatgacattaaactttaacttttattatagccatcagagattacaaaaggtaggagggtgggagagcggggtgaaggttgaaagattacctattggttacaatgttcagtctttggttgatgggtactctaaaagcccagacagactttatctctacataatgcatacatgtaagaaatctgcacttgtaatccttatgcctataaaaataaaaattaaaaaaaatctttttctgccttaaaaaataaaaaaatcctttaaattttcaaaaagaacaaaaagaaagagagtatactttccaaactgttagcattatttcctaaggaggctgacagaagggagaaattattttttctttacatactttggtatttgttaacttattatggtgactatataatgggtttgtaatttaaaccctataatatagaacattgttcttaaaacaaaaaaccattagagatgcaagctgaagcaaagtatgtagggatgtgtgagataaatctgttctcattgacctaattttttagagagtcaaattttatttctaaaaaagaattaaatcttttattcttccttagcaagaatttagggcagtagtataagaaatagtacagtgaattgcatgattgattattatttaatttgtgtagacagtgtttattacaagaattcataggagagagatcatagcagtatataggtgaaattatgaatactagagtataattatttctcttgtagattatattttgttctctgtatttgaaaagttatcctcagagcttaccaactttagctttgctatgtacgtgatcatttttgggtgccagaaggaagccttgaacaagtgatcctcaagaacttataggaagtatacatttactccttactaagcttacatttggacaggaccagtgatcttgctcatgtcagcattagccatgatactaggagagtaaacctttgaaaaacaacaaggatgagaataacggttgagtggttagctgccactattttgaaattgaaaaaatcttatgtttaatatagttatattctttaccctttctataaattgttacatagcatatcttgaagttttgggaaactacaataaaaacattcttgtgtgtgggtatgtgttgttggcagagggaccctgtggacagattacattgcttctcaagttacgagacctataatatagcagtatgaatttgggtaaattgcttaacttctctggactttactttgcttacatgtaaagtggagttaataatagcctaacaaacataaaaatcttcgagttagctgaattttagagcttatgcaaatcctttacaaataaagtggcagtgttgatgggattcctaaagcttctctggcatcaggaagcacagaacaatattaaatagttaacagtaaattaataatatgttggatataatatcttcactaatagcccatttagtaataaagtttgcataactttttttttttaaaactgaggatatagtattaacatgctacttagtgaacatgactgtggagggccagggtaacaacagtttgctttctttttaatctggtttgatgcaaagagagcatagtgtcatcttcttatttttaaaaacctcgtttttggtttaactgggttaatggattttgacctatatgtttggaataagtctaaggcaaataaaatctcttatctccctagaaactaatttgtatctcagtaccatattttctttcaattaacaacttatggccacttttatggtagtttcttattggtaatattttacatgcaaataaagatctggaaatttagatgacttatttctgtgtgattttattatctatcttcataaatacttatttctggtgtttttagaaaaaaaactaaagcttataaatacagagctcagattgtatagttattgtaaaaaggctttatgctcactgggcttctatatattcttgataccttatttctcctttttttcccccaatattttcagatgttttggaatgttattaagcccaggtcgaaacgtgaagaacagtgacatgcatttactggatatggtaatgataatcttaagcaccttaaccaagtatagatgatagttattttatatttgacaagtattttctatttacaaattttgtcatattgtcaaaattatttcttgcagctgtgtgatagtaataattaaatttggaaacgcaaacttaaaattacttgtgaaagaggaattcaggacaatttccaccaaaacagtcatatgcaacaaataaaaggattgtgttatgataatgtccatttatttttttggcttcttagaaagatatcttttctttgaacctgtagtaacaagtacatgattataacaagcatctccagagtgaatatggtgcctttcatttattttaatgcactgctattaatttgagtttgtgatgggtacttttgttttctttaaagcgtttccctttctgaatttcttcttgattacctgtccttagcaaagtacacttatactaggagtaatatttatttaaggaatgtccttaaaggttaatatatattcaacagttgatatttagtgtaaaagtagcaagctattttaactttcaaatagaaataccttctaatattgcagttagtgaaaacatttaatttgtgatttggagacgttataggaaaataatcatcttagagtaagtataaagtttcttagtgaactgaaattcttatatttagtgataataagcactatatgctttcttctttttagctgtgttttgcaaatatcagttaaacattactaattaggtcaacttttttttgagtaatttcatggtaatatcaatactgattttatagcagtacaggaatggtttattcaggcttttgggtacctgtttgtctgctaagtgttgtgtgaagtgatgaggttatgcatatgagtaaaatatagctcttaccatctgtgggttcatggtcttgtgggaaacaaactttttagtatctggtggtacttcaagccacagaaatatagaggaagcactgcctgaataggtcaggtaaggaaaaccagttaaattgattattaaaacataaattagctattgatctatgtctcttacatcttttttttttttcttgaccacatatcagtaatgaaagtggttttacctaaggcaagccattagcattttggagccctgaaaattccatgaggaagtaaattaggaggattgaggtaatgaaaacttttaagatcctaggtcctaattaatcatggtctttcagagtttaaaagactaagatgaattactgcagagatttgtccataaaacctaaattcagattacagaattatagaactggtataaacttctgaggccccttcactatgtctctctaactttcagaacagtcctccccacctttgagtccatatctaaatcaaaagagttgtgagcattcatgctctcagacagagaaggggcttacttgcaacaaatagttgggcaaatgagaggcttgtatttgcaatgattagcagttgtgatttgttattacccagtgttgttaatcttcatagtggacattgaacctcagctagactacttctaatgaagagaaactcattaccttatgttaaagtctaagggacagttctggttattacaaagttatttttttataatcacctgaaatcatagttcttgtaacttggcctaattagtcttaattctgcactctagaacaagatattaatacttttactccttctatgacactcccaaatatcatgtgatcctcatgacaggaaagtcctatttataaatgaagatatatttttcagtgaaatagccagattacttatatataacagtcatatgctgagtaagaaaatttccgtgaatgatggacccatactttaaggtcgtcccgtaagattataatgtatttttactgtaccttttctgtgtttaggtacacaaatggtattgttatagttgctatagtatttggtacagtaacgtgctgtacaagtttgtagccttggagcaacagcctagttgtgtagcccctataccatctaggtttttataagtacggtgtattctatttgcataaagaaatcacttaatgacacataacttagaacataaccctatcattaagcaacaggtgactctgtgtgtgtgtgtgtgtgtgtgtgtgtgtgtgtagaggagagaaagagaccattatcatatgagtgtgttggggctgctgagagggtttcgtttacaagtgaccttgagtgtatttcatctctggaatgcatggtccctgcgctcaagctacacaatctgattagtgaagtattactaatacactagaaaaatatacatagtaattaccaaatgactgacacaattttatagggggttcagagaaacatctgtgaatgggtaataatgaaaaaagaaaagtttttctctttgttttagtctgacccttttaacagtctctattcataatgtgaggaaatcgctacaaaaactgaaatattgtagatactgttcatttgcatatggaaatacttgtatgctgtgtgttgttctttcatgggacaaactctacccctcctctctccacacacatatacacaagctataagtagcctagctttcgccataggagttgctggcttttttagtgagagtcaagagctggcttggtaaagtcttaaagaatggagaagaggaggaaggagagaagggaagaaagagggagtaagtgtaacagtagagggagagagttaatacacttggatgctgcttacaaaccaaaaattagtctcctaatactaatttatgattgtaagaaagtatataaatatctgacatatagaaaatagacaagtgttaattttaaaggtattaattgctacaaactaaattaatattttaagaattcattaaaaattagaatattagaagaaaaatattaactttccctactgtgattagctactagttcagtttaactgtcttcagctaattctatattattgttttaatagaaaccatatacattcttatgtgtatatgagatttggacaattggtgtcaagatcaagttaaatacaactttgtaacaatattatgtttttttgattcagcatgtaagtatatgcctccttttatccaagggtacatgtctttaaatagaaactgtgcttgaagaaagctgtagaagaatttaatatttaaataaatgcttttgtaggatgaaaagaatttacagtgaatataaagctcctgcttgactgttaatctaaattttaataatttgtattgcttaaagtaagatgtaatttaaagtagtgatttttttgatgtcttttatcagtaattactgtttgaatttttataggaatccatgggaaagagctatgatgggagagcttatgtcatcactggcatgtggaaccccaatgcaccagtatttctggcacttaacgaggaaaccccaaaaggtgacttttcttaaaagatcccttattgtttgctttacattttatattatgaacaatgttgcttgtcatgttttaaaaaaaatttggaactcaaagtggacttattctttcattgagaatttgaggttcatttttattctttatgcttctatgggggaaatctccactatttaaaaaaatcctccccaaaagatatgtgaattattattattgttattattttaagagacagggtctcactctgttgcccagggtagagtataggggcattatagctcactgtaacctcaaactgtcatgctcaagcaatcctcccacctcagcctcctgagtagctattaaatagaactacaggtgtgtgctgccatgcatggctaatttttaaattttatttttgtagcgatggggtcatgctttgttgcccaggcttgtcttgaacctttgacctcaactgatcttcttgccttccaaagcactgggattacagatgtgagccactgcacctggcctgaattaattttattagattatagagaaagcatttgggctttgtttttcatataccactatagagttatttcatttgtggagactagtgatggagaaatattaaagaaaatgatgaaaaggaaatattttagaattttgaatatttttaaattattaactatttttgcattatagtttacttatagtttttcatttattaattattggctccagtcttttggccttcgggatgcttgtaatatatattaaatatttcagttgtagcaaatagttttttcttagttttttaacttttcatattatttatcatgtctagtattgaacagaatgtataaatgttgaatagtcacatttttcgttgttccattgtgttttttcattcctacttcatccagatagctgttaattgcctgttttttgccccttcattatctacttttaaactaaatttaaagttttacctgccgagttatatgcctaccctaagtgctttactgtcattaaaccattaattcatatttagaatataatggatcagtttgttttatcattaatttttatattatttagtttatacccacagtagacttttggttactgacaggaagcattcgtgaatactgatatgaaaatataatatgttaatgaagggcattaaaatgataattattctttcatttccttaaagagagtattcaccatttatataaatcacatacattgatcacatattaagctgtctaaaaataaaggctaaacagaaaaaaagattatataaaatttaacttttcatttattagcagtaaataatttttagacccacaatttgttatttctggagacaggcttgcaaatacctgtaacttctttcttatacttgttcagaaggaagccacaaaaatgataaaaataagccagttgacagttttgaagaacaaaatataagaattttgcatatcaagttataaaaatagtttttatgtttttaatgtaacacctagtttagttttattttgcaataaaatatatatttggtccacaaaagaaaatttatttataatttattctattaaactatataatagtatattataatattctgattcaaagtatacattttaaatttaacattatctcatatgccacacaaaaatgttgccctgatttttaaaatttctaaattatgtccttgaaattacacattactcagagaatgtgtgatcaaataaagtttgatttttatggaagaagtttagaacctgagagatgaaaagtcttggatctttccactgcactaagatccagttgaatgttatattctgtcttgtgttattactccttactcctttctctaaggtcctccaggtcaagtataatgtctaacaaattttagtttctcttgaattggcaggtgtatttagtaagactgtatttagtaagaatgtaataaaattgttattgaatttgagaagtagttgatgaatctgaatgttatataatatttaaaaacactattgagggtttcttctagtggtggccttggttatttggactttcctttaacagagaactaaaaattgtaaagaaaataaattttaaaaaatatttaaaaaggaatgaggaaattacaaaatggtatggaatgaccaggccatagattcaaaaacctcaatgaggccaggtgtggtggctcacgcttgtaatcccagcactttgggaggctgatgggggtggatcaccagaggtcaggagtttgagaccagcctggccaacatggtgaaaccccgtctgtagtaaaaatattttaaaaatcagctgggtgttgtggcgggcacctgtaatcccagctacttgggaggctgaggcaggagaattgcttgagccctggaggcggaggttgcagtgagccaagatcgctccattgtactccagcctgggtgagactctgtctcaaaacaacaaacacttaggattattagttcctaagaaacatgcttggagtacttgcatacttatttaatcaaaatgtgaatagaacagttaaaaataaacatagaaggtattacaattgtaaagaactttaattctttcataagtgaggaaactttgtttaaagtagacaaggaataataaagctcgcataaaacccagaaaatttctactacagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacaggtaggacctttttgttctcttcatatatagtaacaaacatttttctttccacacttcttttttaatgccaagataattcctgaagttgcaaaacaatacaattcctcaaagaaatcaaatgatatttgaagtcaaccaatagagtgtttgaaaaagtcacatctaggtaatattagctaaaaaaacccagcaagtttaataattacatactttttccctagaaacctgtaatgtatgaaccttcttaacagaaatattgactgcatataaaacaacgtttctgccttttataaacaattacttaaaaccaaaaaggcagtgcacagaaatatcatatgcttataaaattttaatgaaaatgtttctaagaaatacctaatttctatagttatttctgcctgtaatattagatagacaatattatatgaacatcttgtttgactcatcagtgaggttataaaattattttaatattaaatgaacaaaattatggtttctatgatatcctcaaattaggcagtattagtagataaaatatgtaacttttgtattatagcaaaggaagcagataataatgaaaaataacttgaatgctaattgtgtgagtttttaaaaaatcaggataaaaatgctctattagaataatgaacatcttttatatgctgtttttgttagtactttcattctcccaagttttaaaatgcttgctgcttcatatactataatatgtggactgctgtgtgataaaagcaggcaccagtacaggaaacaaatatagaagcctcttacccattttcatattaaaaaaactgccatggcgcatctcggctttatatactatgtacttggaaattattgtggttttaaaaaaatctttcataaaattattatggctgttatttgactcagtttttattactgtgtgaactgcttttatagcatattctaatgaaggttatgtgagcaatattcaaacttcagtctcctgagcatcttttaatattttattatgagacttttttcctgtcttccttcctccccatccttcttttttaaaaaaatagcttagttatgactatccaataattcttcattttgagccaaagaattattcatagttgcataatcgtgaataaaggagctggagctgtatagaaagttgtcattcttctaatgatgataaattataatgtaaattatacctcctagagatctgagaaaatgttaggtttttcccagttctagtacttttgactgtctgtctgcctggagagagagagagagagagagagagagagagagagagagagagacattaaagtaattgttaaaattcatgtaagtaattattgcaagacctgagactataactccttaccttaagccagaatatgctgctgtaaggccagactagcttctttctacacctccaaaaggtgggttggtttggggtggttgatggtaatctggagatgttggtctacactatacaacattggtagaaagaatgaattaggtgattacctaatgcaattcaaagtaacctttgaaaatctgggtccaggccattactactttaaagaaataaagagagaatgcattgatttcagttctaagtgatttagacacctagaactttttctttcattctgagagtgttgaacttattgaatgaaaccagaacttgtcctgtacccagacaggattagaccagactcctgggggcaacaccaaagtacatgagatgccctgttcccaaactattttttcttggcaactttcttctctcaaatatagcagaactttatgtgtgggcagtggggatgtatgaaagtctgctttgttcctgtttactgtccactcagggccaaatggcatttcatttcattcattgtccatttactgggagcaaggagagcacttaacaagaggatggaaactagagtctgggaaagtaaactagaggctgggaaagtaaactagagaaagtccttttgtgtccggaattggttcctttcagtgggttcttggtcttgctgacttcaagaatgaagccgcggacccttgcggtgagtgttacagttcttaaagatggtgtgtccagagtttgttccttcagatgtacagatgtgtctggagtttcttccttctggtgggttaatggtctcactgacttcaagagtgaagccgcagacctttgcagtgagtgttacagctcttaaaggtggcgtgtctggagttgtttgatcctcccggtgggttcgtgatcttgctggcttcaggagtgaagctgcagaccttcgcggtgagtgttacagctcataaaggtagtgcggacccaaagagtgagcaacagcaagatttactgtgaagagcaaaagaacaaagcttccacagagtggaagaggacccgagcgggttgctgctgctggcttaggtggccagcttttattcccttatttggcccagcctgcgccctgctgattggtccattttacagagcactgattggtccattttacagagcgctgattggtccattttacagagtgctgattggcctgtttttacagagtgctgtttggtgtgtttacaaaccattagctagacacagagcactgactggtgcgtttttacagagtgctgattggtgtgtttacaaacctttagctagacagagtgctgattggtgcgtttacgctcctttagctggacagaaaagttctccaagtcccacccgacccagaagcccagccggattcgcctctcaccttgacctgagtctaaggggagtagacattaattaggtgtaagtgggaaacaccaagtataaatgcccagagaactagaaagactgggaagcacagtagctgatgatgaaaggcaagtaggcccctggccatgtgaaactttggagtccacgttcagagttcttttctaaatcaactttattgaggtagttagcatacagtaatatgcacccatttaatagtacattttgatgagttttgacaaatttatacacatgaataattaccaccaaaattaagatccctcactcttaaaagttctatagtgtccatgccagctaatctttctcaccttcagcctcaggcaatgactgatgtgctgtcattacagtaactggaatcatatgcttcttttatgtaaaagctttcttcatgtaacaatgcctttgagatccatccatgttgtatgtcagttgttaatctttttattgttgaatgttattcctttgtatagctgtaccataatttattagatcatatgttggcaatttgagttgtttccatttttggttcatgtggttaattaaagctgctgtatctttctgtggacatagattttcatttcttttgggttgataccaagaaatggaattgctgtgtggtatggtaagtagaaactgccaaactgttttctacagtgcttgaccactttattttccctccagcagtatatgtgtgtcccaatttctcctcatccttgccagcacttagtatcgtcagtcttttaaattgtagctattcttaggggtgtgtagatgtatctcattgcaatgtcaatttacatttcacattgagtaatgattttgagcatttttttcttatggttattaatcattcatatatcttctttataaaatgtctaaaatttttgtccactttttgtttgtcttactgagttgcaagagttgtttatattttctgaatatattttcttttgtcagatacacatatttcaaatagtttcttcctgacagtggcttgcctttttattttcataatgtctcttgaagaactgaagttttacatttcgatgaagtcatattaatattttattttattgtttttgctttttttgtgtcctatctaaggaaattttgcctacctcaaggttgtgaagatgttctttatgttttcctgtaaagactttatagtttcaggcctattacctattttctgttaatttgtatgtatggcatgaaggcttgaggtcatcttcccacacctctctcatgtgggtatacagttgttccagcatcatttgttgaaaagactcttttatctatagaattagtttgtctaaaattaattgactgtagatgtataagtctgtttctgggacactatttctcttccattgaactctatgtgagtaccacacagtcttgctcattataactttatattatgtattaaagtctgtgttgtaagcttcccaacctttctcattcttagttttatttgttgcgagttctttgcatttccatctgaattttaggattagtttgtcagtttgtagaaaaatgcatgcccaggctggacgcagtggctcacactggtagtcccagtactttgggaggttgaggcaggaggatcacttgaggccaggagtttgagaccagcctaggcaacatagcaagactcagtttgtaaaaaaaagtaaaataaaattacccaagcgtggtggtgtgcacctgtggtcccagcttctcaggaggctgaggtgggaggattgcttgagcccaggaggttgaggcttcagtgagccgtgatcatgccacttgcactccagcctgggccacagagtgacaccccatctctaaaaaataataataaaaaaaagaaaaatgcattcccagattttgactgagaatgcctgaatatgtaaatgattttgggaagagttgctgttttttttgtttgtttgtttgtttttttgagacggagtctcaacttgttgcccaggctggagtgcagtggcaccatcccagctcactgcaacctctgcctcccaggttccagtgattctcctgcctcagcctcccgagtagctgggactacaggtacccaccaccacgcctgtctaatttttgtatttttagtagagacgaggttttggcatgttggccaagctggtcttgaattcctgacctcaagtgatccaccctcctcggcctcccaaagtgttgggattataggcgtgagccactgcacctgtcctttaggagttgctgtcttaagagtgagtcttcaataaacatggcctgtctcatggagtatcacttcatttatttagctcttctttaatttatctcagcagttatgtcacttttagtatacaggttttacacatactttaatttatctctacctagttcatgaatttttcatctcagggtataattgaaaaaacggaatagacttaaggtgtacaatgtgatgatttgatacatatatattgtgaaatgattaccgaaatcaagttagttaacacatctgtcacctcacgtaagttacctttttgtgtgtgtgtagaacacttaagatctactactgtcttagcaaatttcaagtacacaatacaatattgttaactatagtcaccatggaacatattcatcttataactgaaagtttttaccctttgatcagcatctcactttttcccccaaaccccatctcctggcaaccaccattctactctgtttctatgagtttaacttttttagactagttaaaaatgagatcatacagtatttgtctttctagtctagctttttttacttagcataatgctctccacctttacccatgttactgcaaatggcagaattttcttcttctttatggctgagtcatattccattatgtgcaagtatgtgtgtatatattcattcattcattgacagacatgtttccatgtctagtgaataatgttgcaatgaacatggagtgcagatatgtcaagatactgattttgtttccttcagatatatacccagcagtgtgatagctagatcatgtggtagctctatttttaattttttgagtactctttgtactgtttttcatactggctataccagtttacattcctaccatcagtgtgcaagggttctgttctcaccaacatttgttatttcttgtcttttttttttttttttttttttttttgtgatggggtctcattatgttgcccaggctggtctccagcttttttttcccccaagattgctatggatattcgggttctatatgaattttaggattgtgaaaaatgccattgggatttcgatagggatcacattgaatctatagatttctttggatagtatggacatttcaacaatatttttccaatccatgaacatgagataactttccatctatttgtgtcattttcagtttccttcatcaatgtcttacagttttgttttttgttgttttgtgatggagtgttgctcttgttgcccaggctggagtgcagtggtatgatcttggctcactgcaacctctgcctcccgggttcaagctattctcctgcttcagcctcctgagtagctgggattacaggtgcttgccaccacgcccggctaatttttgtacttttagtagagatggggttttgccatgttggccaggctggtctcgaactcctgacttcaggtgatctgcctgccttggcctcccaaagtgctaggattaccggcatgagccaccatgcccagccaatgtcttacagtttttagtgtatggatctttcactgccttggttaaatttatttgtaagggatttttttgtttggtatgctactgtaaatgggattttttttacatttatttttcagatagtttgtcgatttcgtatagaaatacaagcaaattttgaatgttaagtttgtaccctgtaactttactgaatttgttctaaccgtttttttttttttggtggagtcatcagaattttctatgtaataagatcatgccatctacaaacaatttaactttttcatttccaatttggatgccttatcttgcccagttgctcctgctaggactttcagtactatgttgaatagatgtggtgagagtgggcacccttgttactattcacctttgagaatgatgttagctgtgggcttgtcatatatggtctttcttattttttggggtacattccttctatacccaatttattgggcatttttatcatgaaaggatgttgaattttgtctttttctgaatctattgagaagatcatatgatttttatgttttattaatgtggtttatcacatttattgatttgtgtacggtgaatcatcttgcaccccagggatgaataccatttgatcatgtgtatgatctttttactctgctgttgatttcagcttgctagtgttttgttgagaacttttgcatctgtgttcatttggattactggcctatagttttcttgtgatgtcttcgtctggctttggtatcagggtaatgctggccccatgaaatgagtttgcaagtatttcctcctcctcaattttttttggaggaatttgtgaaggattggcattaaatgtttggtggaattcagtggtgaaaccatcaggtcctgggctttgctttgctgggagactttttattgctgattcagtcttattattctttattggtctgttcagattttctgtttcttcattattttatcttggtaggtcatatgtttccaggaatttatttattattctaggttatccattttgttgccatatagttgttcataatagtctcttatgatctgttgtatttctgtggtatcagttataatgcctcttctttcatttgtaattttatttatttgagtcctctctctttttttcttggctattctagttaaagttttgtttatctttccaaaaaaccaggttttagttttgtccatcttttctgttgttttactcttctctatttcatttatttctgctccagtctttactattttttccatatgctaatttgggtccagttttttttcccctagtttgctgagatgtaaagttaagttgtttgaggtcttttttttccccataatttagacatttatcaatataaactttcccacttagaacttcttttgctttatcccataagttttggtatgttgtatttccattttgttttgtcttagatgtattttaaatttccttttgacccattgattgctcaggaatgtgttctttagtttctatatatctgaattttccatttttccctctgtttttatttctagttttataccattgtggtcagaaaagatacatgatatgattttaattttcttgaatttaagactttttttgtgtgtcttaacatatttattctaaagaatgttctgtgtgtgtgtgacaagaatgtgtattttgctgctgttggataggatgttctttatatgtctattaggtccattttttctatagtgttgttcaaatctgttgattccttatgattttctgcctgcatgatctatctactgtcaagagtggcataataaagtcccctttattattatattgtcatttatttctccttgcagttctcttaatacttgttttataatgaggtaccctgatgttagatgtattactatttacaatagttaaatcttcttgatgaattgacccctctgtcattatataatgatcttctttgtctcttctgacagtttttgacttaaagtctactttgtctgatataaatatagccactctgttctcttttggttaacatttgcatggaatatctttttccatcccttcattttcagcctgtgtgttctcaaagctaaagtgagtctcttgtaggtagcatattcttggatcttaattttatatccattcagtcactctatatctttgtttttgttttgagaaggagtcttactttgttgcccagattggagtacactggtgacttgatcttggctcattgcaaccaccatctcctgggttcaagtgattctccaacctcagccccccgagtagctgggattacaggtgtgcaccaccacacttagctgatttttgcttttttattacagacagggtttcactgtgttggccagactggtcttgaactcctgacctcaagtaatctgcccgcctcagcctcccaaagtgctgagattacaggtgtgagccatagcacccagcctactctatatcttttgattgaataatccttttacatttaattattggtaggtaaggacttattattgtcattttattaatttttaaaatggtttgtagtcctttgttcctttctttctcttttgctgtctttctttataatttggtgactttttgtgatggcaggcttttatttctttctattaatcttttgtgtatctactgcaggattttgctttgtaattaccatgaggcttacataaaatataattattacatgttattttaagccagtaacaactcaactgtgtttgcatacaaaaattctacacttttactcccccatctctcatattttaggttattgatgttacagcttttaatattgtgtgcccattaaaattattttagctataattatttttaatatgtttgtttttaacttttatactagagttgaaagtgatatacataccaccacaagaatattagagaattctgattttgactatctatttgcttttaccagtgagttttatacatttatatgtttttacattgttaattagtatcctttcatttcaacttgaagaactttggcatttcttataaggcagatctttgtgatgatgaactcctttagtttttgtttgttggggaaagtctttctctctttcatttctgctgtacagctttgccaggtatagtattcttggttgaggatttcttttctctttcaatatattgaatatattattccactgtttcctctcctgcaaggtatctgctgaggaatccacttacagtcttacaagggctcttttgtatgtgacaaggtgcttttctcctgccattttcataattctctctttgtctttgacttttgacaatttaattatactatgtcctggtgtagacttttcagcctgtttggaaatctatgggtctcataactttgactgtcctcttcttttcctaaatttgggatcttttcagccattatttctttatatagatttttcagtctctttatctgtctcttttccttcggatacttctggaatgcttatgttgttttgctcgatggtgttccaggtatcctgtagactttcttcactctttgtttgtttgtttttgcttctctaactggataattttaagtgactcatctttgagttcactgattttttattcttctgcttggccaagtctgctgttgaagcatgctattaaatttttaaattcagtcattgtattcttcagctttatgattttttgtaaagagggtgcagggtctcactgtgtcacccagcctggaatgcagtggcacaatcatagttcactgtaacttcgaactccagggctcaagtgatgatcccaccttagcctcccaaatagctagaaaaacaggcatgggccaccacacccacctaattttttaaaaataacttttgtagagacagggtcttgctgttttgcttaggcttgtcttgaattcctggtctcaagagatcttctcgcctggcctcccaaagtggtaggattataggcataagccactgtgcctagctggattttaaaaatggtttttattactttgttgaacttattttgttaatgtattgtttttctgattagttgtctgtgttttcttgtagttcactgatttttaagagtattattctaaattctttgttagttacatatcttcatttgtttagggtcagttattacagctttattagtttccattagtggtatcatgtttccctgattctttgtgatcctcatatcattgtattagtgtctgcacaatttaggaagtgatcacctcttctagcctttacatgttcactttggcaaggaaagatctttactagtctgccaagcctgggcttctggttgggccagctggtagcatatgcaggtaagtgaggctggggtctctgatctggtggggctgctgccgttgctctaaggttgggtggagctctcttgttgggcaggccccctgactggtatctgaggtcaagtgggactgttggttgggctttgtaattgcctctggttgggtgaggctgcaggctgtgccccaaagttaggcggggttgctggctgggctctacagctggatggcattacagtcaggtagggatactgattggactccctgattggttggggctggaagctgtgccccactgtttgatgtagtcattggctaggctccctggttgggtgggattgcaggttatactctgggctgctggcttggttccctgcctgggcatggttgccatctgtgctttgcagctgggctggattgctgactgggaaacctagacacccagtactgccaaccatactccctggccagactgggtgccaggattgctttgcaggtgggaggagctgctgcctgggctccttgtcaggtgaagctgtcagcagggatgtgtggtgccattgccaagatacatgtgcttgttgcatgtggtctagtcctgacaattctcaatattctgtaggagaagagatataatttggccttttgggaagcatgctggaatattgggaaagctagatgttcaccttgtgctgctggtgaaaccatagactcagcaaatctctcttggcatgaggctgttttggcctggggtagtggcaacatcatcaaattgaaattgctccacttatacttccaatacaacttttctaagttttgtgcttctggaatttttgcaaagatgttcttgtatgtagatagttgctagttggtatttctgtgatggggactagagcttgggacctcctattctgccatcttgctgatgtcattcctcagaacacacatgtttttgatattactataaattgtattctttaaattttaattttttattgtttatttttagaatacataaagacttgatttttgtatattagccatatttcccgcaactttgctaaattaacttgttttctttttcttggttttttttttttttgagactgagtttcgctcctgttgcccaggctgaagtgcaatggcgagatctcggctcactgcagcctctgcctcctggtttcaagtgattctcctgcatcagcctcccgagtagctgggactacaagcatgtgccaccacacctggctaagttttaattttttgtagagatggctcttgctatgttgcccaggctggtcttgaactcttggactcaagcaagcctcccactgcagccttttaaaatgctgggattacaggcatgagccactgtgcccagctcttttagattcttaatgctttctctatatattatcatgttgtctgccaataaaggtagttttctatctgaatgcctataaattctttttcttctcttgcttagtttttttcttccccctgtgaacagtgttgaaactctatcaaatatttttctgcatctttgtggtttttccccctttttttcttatcaatatattgaattacattgattttttttaaacattaagccaaccttgcattccttaggaaaagtcacccttggtgatgatggtattctttttatatatcactttattgacccagtaatacattttaaaaataatttttatgtctatttttatgagacattggtttatagttttcttataatgtctttgttggattttagtgttcatgtagtatggtacctcaaaaaatgagttggaaattgtttcttcctatatttgctgggagaatttttataagatttgtattatttcttccttaattgttggatagagttcaccagtgaaaccatctgggcctatagtttactttatgggaagccttttaaatcacgaatttaatttctttagtaaatattggatttattccacttattattttttaaatttcttgaaatgttggtgatttgtctttcaaggaatgtttcaattttatttggtctattgcacaaaatattgacctattttttttaaacatctatagggtttgtaggatcttcctttattcctgacattggttaatttatttgttttctccctttgttttaatcagtctaggtagaagtctgtaacttattgacattttccctccaaagagccagatttcgggtggtttgattttcttatttttttttctgttttctcttcagtttattccctttgttgtttcattatttttcctgctttgggtttcacttgtgtttctttttctggcttcatgtgaagattagatcatttattattattattattattattattattattattattgacagggtcttgctctgtcacccaggctggagtgcagtggcacgaccatagttcactgtagtgttgaactcctgggctcaagcgagtctcccatctctgcctcctgagtagctaggactacaggtacatccatcatgcttggctttttatttttgtatggatggggtgttgctatgttgctcaggctggtctcaaattgctcaagcagttctcctgccttggcctcccaaagtgctaggattacaggtgtgggccattgcacctacctaatcttttttttttttttttttttttttttttactgcttttttcctaatacttttgtatttctaaggtttaaaccttccctctaaccactgctttagctgcattccatgaaccttaatatattgtgtgttcattttaattatatttgaaatattttctaatttcccttgttatttcttttgtgtcctatgggtcattcagaagcatattgtttgattttccaatatttttagattttccttttttttgctattgacttctgatttagtttcattttggtcacagagtatactctatatgatttgaattcttttaaactgttcagacttattttatgactcagcatatggtctactgtgaatttttcaagagtacttgtaagggatgtgtgctctgcagttgttgagtggagtatcctataaatgtccattatgtcaagttctataataagattttcctgtgatctttactcagtagatcaacaatttctatgactattactgtaagcaacagtagtaatagccactactaattattttttaattagtttactacataccataccctcttctaagcactttacatggattaatttgtgtaatcttcagtaatctctattgaggtgtaagtgccattattacctccattctctggatttgtacttaggcacaggtaggttattaggtggtggaccaggaattgaatctaagcagtttgaccctaaaacttacacataaaatgtttatggaaagtggaaaattatgataatctaacactaaaattaggatttttttttttcctgaaaactttttttcatgaacagtagttttttttggttatattcttcttcaatttggtttttccttacttgcaccatcttgatgctggtatcactatttaaattagttatatgaagagtttgtaaagaaaatctaaggacttgtaacattggaaacattgacagtgtacttgcccttactcctttaacaaaataggctcttggctggtaaaattcagtgatttatgatcctgatccatgaagagcactctgctcatatggggttatttgaaaactgtttgccaaaaagatttctgctctaaaagcctttctaaatgaatgaacatttggtattttcttgttacatgctaactccactggcttaaagctttactggttgttaaaatgtcaacatctccaggaaataggtcataataacttttactagttgtattgtccttattggtagtgactttaataagattctttcctttagtctaggttttattaggggtcaaggtaaagaaatgaagagggcatttctacttgaagtgtcactatattgagcaggaaaggccaaagtcctgtatcacttacaatttcactgagatgccggtattcattttagaaatgattttcaatgtttagtttagtttattaaacacttattgagtgcctacagtgtggtaggcattatgcattatgtgataggcattatgctatgttggggatatttgaatgagtattatctattctctgttctaaaacagtaaacaatatactggtaaaaatgttacaatactagatgataatggaacaatagaagtatatacatagttcagaagcagcactcactcatcacccttatcacccttattggagttcagttagacatcctaggtttgtatccagtttactctggtgtatgtttcacagctgtataaccttaggcaagatattagtagtctctgaaatggggattataattatgccaccccaaaagattgtcatagtgaataaatactaattcatttaagacccttagaacaatgcttgctacctgataaacaacaaatatgagttattattgttgttagtattattaattgactacctgtttgtcttctatctagtctgtattccttttgggcagagtcctttgtgtagtcagcctaacataaatgaattaatgaatcaatgaattgaagaactaattctggtggataggtcaggtgtttgaagtgtgacaaagcaaagaaggggatttcagtcagagacaatagttggttaacttcataaatctctgatccaacattgtatattcaggatttgtgggaaatcagatattgatggagcatcagtggacttgggtgggcaattactctgaacagatagataggtcattaccatgtcaggaatttagagactatcctcaggtacggaggaaccactgaagggttttaacttctgaatgactctagatttttaattgagaaaggtcactgttactacagtgaaaaggatatcgagactggtaaataaaaagtaagaaggctattgtggccaagataagaaatgatgatagcctcaagaaaggcagtggcagtgaggatggtggaaaagacaaatttgagagatgttagggaagtaaagataaacaagatttggtgtctgatttcatgtgaggttgagggaaaggaagaaaggtgtgattattttcaggtgactgggtggttgttgatgctcttgattgagatagagttcctgaaagaaaagttttgaggtgatgaaaggtagtgaagtttttgatacattgaatttttttttttttcttgagacagagtctccctctgtagcccaggctgcagtgcagtagtgtgctcttggctcactgcaacctctgtttcccaggttcaggtgattctcctgcctcagcctcctgggtagctgggactacaggtgcgtgccaccatgcccggctaatttttgtatttttagtagagatggggtttcaccgtgttagccaagatgggctcgatgtcctgacctcatgatccgcccaccttggcctcccaaaatgctgggattgcaggcatgagccactgcgcccggacttttttttttttttttggagacaaagtctcactgttgtacatgctggagtggtgtggcgcagtcatagctaactgcagccttgaactcctggtctcaagcagtccttctgcctagcttcccaagttgctgggactacaggtgtgtgccaccacacctggctagtttttctttctttcttttttttgaaatggagtctcactctgtcacccaggtcagagtgcagtggcgccatctcagctcaccgcaacctcctcctcatgggttcaagcgattctcttgcctcagcctcccagcagctgggactacaggtggccaccaccaggcctggctaattttttttgtatttttagtagagacggggtttcactatgttggccaggctggtctcaaactcctgacattgtgatgcacctgcctcggcctcccaaagtgctgggattacaggcatgagccaccgcagccagcctttttttttttttttggtagcagtggggtctcactatgttgtccagtctagtctcaaacacctgagctcaagtgatcctcccaccttggcctctcaaagtcctgggactataggtgtgagctaccacaagtggcctgataatgttgaatttattgttcctgtgtgactcccaggtagagatgtttagcaagcagttggatatttgtaacctaagcttgggaaataaagatttaaaaagtggtcagtgttgagaatgatgaaaagcagtagatgaaatcacccagagcctaagtattgaatgaggagtgaaggctaagccttgggaaacacagacgtttaaaaaattggagaggaggaggattgagccaaataaatatagaaggataacacagatctgggggtaaaatcataagaacatgatgtcaggaaaggcaagagaggaaatagtttccagcaggagagaatgcctaaagtatcagttactgcaaggagcttatttagggatttaattggtaaataagagacagtgttcttaaactcttaagacttggacaatttctgaggaatagtgggacagaagtcagattgcagttgatttagcgttagttgatttaactcccagccctctgtgcatctggagacaaaagagatgctgggtacaaatccaaagtattaggatagattttactttattttatgtaatttactctcttcttgtacttttcctgagtttggaagccaaactcttctgctagtgatactactgaatgaacattccattaaaatatggactcaagtgtaaaaactgcttgtcgccaacatttataggaattgcgtaacagatattttagaagttaatttcttcggcagatttggtgtaattcagaaattatgcatcacttggtattttctttttttgtaatttattgaaggtatttgaagacagctgaaagaaaaatgagaatttcggaaagttcccttgctttcagttttatgtgcttaacatgtcaattcaaagtttttttaatgagtttttaaggaccccaatatagaattcatattggaaatactcataactttatgttgataccagctgttgctactctgataaattgcttaagaaatgatttaatgggctattatttcttctcctgttactggaaataaatgtcatgcatctttatccataaggtgtttagtgacaggattctttgatagggaactgattataatacaaataaaaaacaagtacctttttaagtatttgttttgttttggtttgctttgttttaccttgcataattttttgaattatggaataattctgtattctgctggtgatgtttaggcaaaacaatgataagacaccaggcacatttaggtgctactacttatttctgagtatgtactatattgtattgaagtgagttgtaagggagaaaacatttcttagtgtcttaggtttatggctaagactccctataacaaaagacagaataacaagagaaaaacatagaaatttatttaagttttacatgacatagtgttgcaggttttctttagttcagctaaagacggggtccttgtctgtcccacgccacagaaatttcggcttgcagatggtttgaagggtgagtaaagcaggattttattgggtgaaaaggaagaaaagggggaagcagggactctcgctaggccagagtgctagagcgcctcccgccggctcttcaaattccaggttccacacaggaagaggaagggccaggttcctcctgctgcaaacagggcgaacttctcgagttccactccaatgagcattacggttggagtttttctggggcggcccttgcacctggctgtctcattcccctctctaaagaagtatatctaactgctgttagattaaggataaggactaagaccgatcttaactgcttcctgctgatagggggtgctgttttgggggaaatggcagagctccctcagagacctatctaagggtttccagcagaaggggccatcgtcagaggctctggttgcatgattgtttggagtttgatggcctgaaggcaagaatagacaaaccgggttattagaagacatatataaaaatgaaacaagggcacaggtaagggcagctcaaaaatcccaaggccggagggcaaaagcctgactggcaaaaacactttacccttttgctggcatgttgggtttttgggttccctttccctgaggccaatcctaagccaaccagtgtaagggctgggaaattaactctttccagtttggaggatgcatccgagggacgtgtcccatagtacagagacacagtcacctatcagtgaagagaggacagaggagaaaaaaggaaaaaagagggtgccttttaaaggactcctaggggtccagggtgtattttaaaggggaacagactgaagataaatggctacccatctagaaagaggggagcaggcgtccctggttcccttctcttcctagcagatacccagggtacctgagggagagagggaagagcgtcctctttccgtcttctgtccttgcatccccgagttctggtgaccttggcaggtgccaccatgagtaccaaagctgcttgcactcatgaagcagggggacctgagaattggaattatctgctctcacctatgtctctttctcacctactgtcagtagccttggagttccctagacctgatttatgccatggatactgatgtggcctttatccaaataggaagcttgggcttggcttaataggaaggaatcagccacactcacctgcgctgtgccttttaacttcccttattgtctgcctttggatccttcagatccaattttctttcctatggctttgacccaaaatttggaattgagtctggggcagaaatgtgtcttaagggggttgaatggactccttatcataagccaaatgctaaggtgaaactgtggaactgagtcctcctccaacaagggagaggaaaggatgtcttgtgacacacccagataactggtgctaagatctgggtacatggtgcctggctttgtttacctcccttggtcttactttcccaaaaggaaacctctgagtgatgatcatcctatttattcccatcatctggcaggatttgcaggataattgctcagaactagaatattgatccagacttgtacattacccatcccttttgttctttctgagctgcagccagaaattgctggttagttcacaggaacaagcagggttagtctaaaatgtaggtgaaaacttaaaaacaacgaatcagtttagaatttaatggcaaatataagttttgaaacgtgatttctctctgtctagtcctcatgttaaaaaacaaatcgtcataggactgagtggtttgcaaaatagactttagttttatacttggcctgattatttgcataaagtgcagcaagaataattatttctacataggccttttggattggttttgatggaagtttgttccataaggaatctcagataagaccttttaagtctgagcctaatcatgggtttgtatcctcaaacacttgtgagttgggtgattctctcctcttagggtcccaagataaacttggagctcctggacctgttagcaagtgacattctttactgaccacaggtcaggaactctgtacagggactgtgtagacaagggtaggtggccagtttctcactgggcttttatgggctctgcaatttgagattgactcagcctcagtaaaataaccactttctccaattgtgctctgttgcaaaagaaaaatgaattcttactgcactgatgcaaacagctatattgccataagaaggctcacagatagttttcaaattctggcggaaccaggcagagagaaacaaacatgctccaaatcttgatcataggaatataccttactcaattattaaaggccataaatagttcaaaataagtttccttgactctgaaaaacaaagcaaggatcagcagtattccaagtaaaagtcaaaaaggttgctttggctttctgagttcagtgcatttagttaactcttgttttgcttgatattcatgaatatttcagctcttcatgagtcctgtacattttcctttattaaaatgttacagtctccaaagttatcagaagtctgtgtttgagagcgactgttaaagttctatagcttattataaaccatcttttgaaaaggattaaaataagacaacaattgtctgtgagtagcaaaatacccagggtggttacagttagaaacacaattgacaaataagtgtggttatttctgtggtttatgataacttaacattgattatggttgacagcatatacttagacattagaattttagaaatcccgtatgatttttgaacatatattatcattattcacaaaaatataacctaaagaagacagaacatcattttggcaatcccatatacctaaacatgtcaaataatcctgtttacctctctttttctggacacttcagggtcccctgaagtatttgaaaagccaggtgctggctgggagtggtggctcatgcctgtaatcccagcactttgggaggccgaggctggtgaatctcctgaggtcgggagtttgagaccagcctggccaacgtggagaaactccatctctactaaaaatacaaaattagcaggttgtggtggcgcatgcctgtaatcccagctacttgggaggctgaggcaggagaatcccttgaactcggtggtggggtggaggttgcagtgagccgagaatgtgccattgcactccaccctgggtaacaagagtgaaactccatctcaaaaaaaaaaaaaaaaaaagtgaggtgccagggaacacggttttgaaactgaagtttgattttgggaaggctgttaaatgttcaaggtttaaaatacttgaagccaggcctggtggcttatgcctgtattcctagcactttgggaggccaaggtgggtgaaaccccatctctactaaaaatacaaaaattagctaggcatggtggtgggtgcctgtaatcatagctacttgggaggctgaggcagagaattgcttcaacctgggaggaagaggtttcagtgagccaaggtggcgccactgcactccagcctgggtgacagagtgagactctatctcaaatgaatgaatgaatgaatgaatcaatgtctgagaactgaatgacaagaaggaactcaccatagtgacacaggatttttcttggtcactttgccagtcggagacctctggttggtaacacccctgtccgggttttgctgggcctgggttcatcacaggagatgccccacacttggcctgccagttcatgcccggtctgcagtttgtcatggatcccacggccactgtgactgtgtattcaacctctggttggaggtggggtgtgagcaagcaagtgtggggtctggccagttgttccaagtgctgacacagaagcaggctttgtgcagtgcttgttgctggactaggcatgtctcaagcccactcctgtgatggtctctgatgtccagatagaggacacagcacccaggcaggggtgctgtgactccgaagcccctgagggggtgttacagcatgctaattagctcaaggggctgaaagagctgttaacacaccgccatctggaatggatggcggtgtgttaaccactctttcagccccttgccccagtttggcctgtggctgcaggcctggctcagccccattgctgctttctgttgtgtggggcagctgccctctgccagcagagggcagagggccacaatgttacagccttctgtgtacccagtttcagtgggtcctgagttcttgtcccatgaccaagaagaataggatcacgctgagaattgaagagtgaggaaggtggagaatttaattgagcaatgaaacagatctcagcagagaggggacacaagggtggtcccctacccaaagtcaggtggcctctctcccattgtggctgggtccagggcttttatgggctcagattggggagtgtatgctgattggtttgtgagtatgcaaaaagattaaaacaaaggcaacactcaaagttgggcatgacagtgtaaaatgttaattagggaaggggaggtatatgtaaaataggcgaaggctggggatcaatcagaggaaagtgtgccaaatgggaagacagattctcagtccggttggtggatttgacttgtaacttgtctttcaggctttaaactgccttttggcttgaaggtggggtttcactggggacctgcccctgtctgcctaggatttgtctgcctcctgccactgtcaatataaagatccagggaaagacttttcaaaggatcagctaatgtaaaagttctaagatacggacaagcttggattgttgttaggattgaattcttgctatccttattgttattaccatagtaattattttttcaggatttccagagtagtggtagattaggacacagaagccacttttgctgcttcattattcctgaacattacttgcatattgtactataggttagactctctcatgcctcatagtgttacatcaacagcacaaaatgataacaagaaataacacttgttattactgtgtactgagcatttttctaaatactttacttgctttttgtgtctggcttgggacagaatttggattcagaaaagagagaggtctcaagaaacaagagaggaaggaaagttagaatgaattgagaggagccataatggtaaaaagacatgaaatggtacttcaggtgaagagttaaggaggagcagaaacttttctcttgataaatctgttttccacatgccaacttcctgttttttattttcaggcaagagatagtttggagagaagaggcttgcccataagaaaaggataggcttcaggtcaggacaggagttagctgttctcagaagtttctatgacttgactttcgatacagggaagtaagctacttttttgatctgtgctaagtgtaggtttgatattaaaatatcaaatgttttcttgccctctcctccaaatatcttctttgcttttgagtgccttgacattcctttaagttggagacaaaacttttaatcaactattaaagttaaaaagcataaaaggaaaattcctatttgaagatgcatgttggtttaaacctacttaaatcaaagtatgatcagtcagtaaataaccaaaagtaaccaaataataagaataactattctaactgcagaaagatgaaaattaacaaggttgtggagtacttataaagttgtgagaaaatatctgttgggggcattttctttttttttttaacttagtgcttctgattagcattggcgttctttagtgtcacctctgcagaggtaaatagaagctgcttggacatgtattttttttcatgtgatttaatgtatctgtagcttagtgagaatatttgattctgttacatgttttatatagacattcttgttgaaaataacaggtcttgtaggcaatggttctcaattcagctttgcatcagattaacttgtgaaccttaaaaaaaaaaatccagattcctaaatcctgccctaaggattaggcattagtgtttaaaatataaaaagcctcaggtctggtttcctcatttatagccactgttgagacttgtaactttagagaatttatagagatatcagcatattgtactttgtatttaatatttgatgatggcatgccatattgaaaaaggttttagaatttatttgcataaatgtgatgaatctttgtaatgtgacttagccaacgcacatttattgagctcctgtttacatgttgctaagctgtaatgaatgctaatatgaaccaggcaattttctttacaaatacagattgattttttagttatctaaaatatgtgaatattgggaacaagtagtgtattttaataaaaatacacttatttgaaactcagtttttaggtgcaatatttagattctatatgagatcaaagtagttcagattctgcttgtataggaaactaagtgcagatgaaatattttaccactattgtacaattttgtactacaacatcagagttgagttgtttatacaaaacatttgtcaacttctgagaaagacagttatattgtttgtaaataagaacagttttatttccaatctgtatactttttcttgccgtaatgcactggacagggcttccatgggatgttgaatgagagtggtgacagtggactttcttccttctttctccatctcagggggaaattattcagccttttacctttaaacatagtgttacttgtagatttttcttagatactctttatcaggttgaggaaacgtgcttgtattacttgtttactgagcatttttaacatgaatgaatgctgaattttctcaaatgccctttattttgattatgacattaattgatatgaacataaggtctttcttctttagtctattaatatagtggattatgctgattgatttttccaatgttgaaccagcttggcattccccaactaaatcctattggttgtgatgtattttgtatgtgtatatgtataaaatttgtaatttggtttatatatatttgatttgaaatatatttgaatatatatttatttgaaattgttttatgtatatgtataaaatgattcgatttgctaatatatataatttataatttgattagcaaattaaatccatatatatttatatatgtaacccacatatatatttttatacatatagcaaatatatctttaacaaaaaatataacaactatatctgtggctacctatcagggatgggtataatataggaaggcatattggtatgcatgtggttccccaactgtatacagttgtaaaaattctttgagctatatactttaggttcgtgtaaggtagtcagttaagagtctagcatcacttgcttatctgtctgtcctagaacctctggtgtctcaggtttttctgatgaaaagaaattgagttctccaaaaataattagtaggtttcatcatattagttaaaaataatactagaggaacataaatttagaatatcctgtgaaggacagtgcaccttaaaagttttcagaacctcagacatgctgtagatcaaacacaacacgccattcttcattgcagctcttttgaatgcattatttaaatactatctttcaatgtttccttcagatttctaatacttaaatatactgttatatttttctcagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagagggtaagaagttggacttactcagtttattctgtctgtatagctgctttacttacaatcttcagaggaggtgtgtgtgttgtgggtagaagtggtggttattcctaacctctgttaccattaggccaaattctacaaggtgcagaaaagaatttggttcatttggttcctaagttgcatagtctccagtgccacttttgcaactatttaaatttgacagcatcacttggctgctgttgttttctattttatttcaattatttttattttttattttcttgagatagagtctcccctgtcacccaggttggagtgcagtggaaaatctcggctccctgcaacctctgcctcccgggttcaaacaattctcctgcctcagcctcctgagtagccagatacaggtgtgcgccaccatgcttggctacttttttttgtatttttagtagagatggggtttcgccatgttggccaggcttgtctcaaactcctgacctcaagtaatctgcccgcctcagcctaccaaagtgctgggattacaggcgtgagccactgcacctgccctcaattaattttttaaattttttagttgtaattatagccttttttttctattttattttttctattttattctttgcatatatatatatatttttaatactttaagttctagggtacatgtgcacaacgtgcaggtttgttacatatgtatacatgtgccatgttggtgtgctgcacccattaactcgtcatttatattaggtatctctcctaatgctatccctcccccctcctcccaccctataacaggccgcagtgtgtgatgttcccttcctgtgtccaagtgttctcattgttcacttctcacctatgagtgagaacatgcggtgtttggttttttgcccttgcaatagtttgctgagaatgatggtttccagcttcatccatgtccctacaaaggacatgaactcatcattttttatggctgcatagtattccgtggtgtatatgtgccacattttcgtaatccagtctatcattgttggacatttgggttggttccaagtctttgctattgtgagtagtgctgcaataaacgtacgtgtgcacgtgtctttatagcagcatgatttataatcctttgggtatatacccagtaattggatggctgggtcaaatggtatttctagttctagatccttgaggaatcaccacactgtcttccacaatggttgaactagtttacagtgccaccaacagtgtaaaagtgttcctatttctccacatcctctccagcacctgttgtttcctgactttttaacgatcgccattctaactggtgtgagatggtatctcattgtggttttgatttgcatttctctgatggccagtgatgatgagcattttttcatgtgtctgttggctgcagaaatatcttcttgaagtatcttatgagaagtttcaaatgatctcctgtgactttagaattttcatgattgttacgtcatgtcctgtttctcatttgacatcattcaattcttgtttttttttgttgctgtaccccttaccactgcttttttttggaaatagtggggtatctgctctatttactacatggttgctgctgagcaataactgacctcacaaaaagcacatatcatatggctctgtgctcaatactctttttatacaaactagagctaaatgacagatgtttacttttaagaccttgtatcatgtgcttctagggtatggtttattaatagtaaatttcttaatttttattatctttgaaaaaagcatcttagaattctcagtcttgcttctgtatgaaactgtttttttctatgattgccataaacataataattatttttagctaatatttatttagtgcttactatatgctaagaacattccaagtatttcaaatatgttaacttatttgagtcttacaatcccatgaatactcttattaacttggttttaaggatgagaaactgagacacagagagcatcatcacttgctaagctcactcagcttaaagtgacaaagctgagatctgagtccaggctatctgactttaagatttgtacttgtaactatgacattattcggtcaagttagtcagttgactaaaacatgagaacagctcacttttaaaactaaggtaaaattcacataacatgaaaataacatgaaaacttaaacatgtacaactcagtggcattttagtacattcacaattttgggcaaccatcacctctatctagttcttaaacattttcgtcatccaagaggaaatattatacctattaagcagtcactctctgttctcccctttcccttccccctggcagccactaatctgctttctatctctatggctttacctattttgcataattcatataaatggaatcatacaaaatgtgactttttgtgtctggcttctttcacttagcacagtgttttctgagcatattgtttcatctacattgatacatgatatagcaggtgtcagtatttcattccattttatgactgaataataattgtttagataaagcacattttgtttatccattcatctttcagtggacactggttggttccatattttggctattgtgaataatgctgcagtacacatgggagtgcagctgtccctttgacatactggttcatttcctttggatatatatgcagtagtaggattgctagattatatggtagttctatttttaattttttgaggaaccaccatagtgtttttcatagtggttgtaccaatttgtatatctaccaatagtgttcaagggttcccttttctccacatccttggaaacacttacttttgctttttggtaatagccgttttaatgggtgtgagatgatatctcattgtagttgtgatttccatttcccttatgattagtgatgttgagtacctttgcatatacctgttagtcatttgcatgtcttcttttgagaaatgtctatttaggtcccctgtccatttaaatttttttttctttttgctattgagttgtgcaaaattcacatatatatgtgtatttacatatgtatgtgtatatgtatacaggctgtatacatatctgtatatatacacacacatatacatatatgcatatatgttatgagatgtgtgatttgcgaaatactttctctcattctgtaggttgccctttcatactgttgattgtttcctttgttttgcagatgttttttagtttgatgtaatcccatttatctatttttgcttttgttccttttgcttttggggttttatccaaaaaatcattgcccaaaccagtgtcatggagctgctcccctttgttttcttctagtagtttaatttaagtctttaatccatttttagtttatttttatgtatggtggtgtgagataaaagtctaatctctaatttcattcttctgcatgttgtggatatccagtttttccaaaaccatttatttgaagagactgttctttccccattgtatgttcttggcacctttgttgaatgccagttggctctaaatacatggaattatttctgttctgtttatcccattggtctatatgtctgtttttatgctgatctcatgttgttttggttactttagcattgcactagattttgaagtcagatagtgtaatgcttccagctttgatctttttgctcaagattgcttcacctatttgggatcctttgtggctctatatgaatcttaggatttttttttctattactgtgaagaatgtcattggaattttgttagggattgtgttgtgatctgtagatttctttgagtagtatagacatttaaacatattaattcttccaatccatgtacacagtatatcactccacttatttgtatcttcttaaatttctgtcatcaatgtcttatagttttcagtggagagatctttcacctcatgggttaaatttatttctaagtatttatcttttgtagctaatgggatttaaatggggtttaaaaaattagttttcagatagtttgctgttactctgtaggaattctactgatttttgtatcctgcaactttactgaatttatgtattaattctaacagtttttcgatggagtgtttagggtttgctataaataagataatgtcatctgcaaaccaggacaatttgatttcttctccaatttgtataccttttatttctttctcttgcctaattgctttggccaggactcattactattttgaatagaagtggcaagaataggcatccttgtcttgttctgaatcttagaggaaaagcttttagcctttccccattcagtataatgttagctatgggtttgacatatatggccttattttatccaggtatatcccttctatacttaatatgttgagagtttttcacatgaaaggatgttgaattgtgtcaaatgcttcttctgtattagttgaaattatcatgtgatttttatccttcattctgttcatgtgatgcattacatttacagatttgcatatgttaactcattcttgcatctcctggatgaatcccacttgatcatgatgaataatctttttaatgtgctgttgtgtttggtattctagtgttctgttgaggttttttgcatctgtgttcttcagaaatattggcctgtagttttcattttttgtagtatccttgtctgtgtctggctttgatattagtgtaatgctggcctcataaaatgagattggaattactctgttctcttgaaatttttggaaaagtttgagaacagttggtattaattcatctttcagtctttgttagaattcagcgatggagccatcaggtcctgagcttcctttttttgctgggagactgtttattactgatccagtgttattactcattattggtttgttcagattttctatttcttgataattcaatcttggtaggttgtatgtgtcaaggaattattcatgtcttctaggttgtttaactgtttgaatataacggtctataacagtattttatgattctttgtatttctgttgtatcagttgaaatgtctccttggtgttcaggagcatattgtttaatttccatgtatttgtgaattttccgaagctttttctgttattaatttgttgttttatactattgtggttgaaaaagatacttgatactatttcagtcttcttaaatttgttaagacttgttttgtggcctaacatatgatctgttctagagaatgtttcatacacagttgaggagaatgtatattgtgcagttgttagatggaatgtcttatatattatttagtctagagtgtacattaagtctgatgttcctttattgatattctgtctggatgatctgtccattgctgaaagtgggttgttgaaatctcttactgttttttgtattgcagaatatctcttcagatctattaatgtctgctttatatataggtactttgatgttgagtgcatatatttacaattgttatagtctcttgctgaattgacctttttattatataatcaccttctttgtctctgaatttttttaattttattttttgtggacacatagtaggtgtatatatttatggggtacatgaggtattttggtaaagaatgcagtgtgaaataagcacatcatggagaatggagtatttattctctcatactctttgagagtattctctcatactcatattctctcatactcattctctcatataactctttgagttacacacaatccagttatatttttaagttattttaaattgtacaattaagttattattgactatagtcatcctgtgtgctgtcaaatactaggtcttattcattctttcaattttttttgtacctattaaccatccccgcctccccctgcaacccatcactactattcccagcccctggtaaccatctgtattagtctgttctcacactgctgtaagggtactacccaagattgggtaatttataaacaaaggaggtttaattgactcacagttttgcatggctggggaggcctcaggaaatttacaatcatggcggaaagggaagcaggtactttcttcacaaggcggcaggagagagagtgagagagagaaaagggaagagcccccttataaaaccatcagatgtcatgagaattcattcactatcatgagaatagtatgggggaaactgcccccatgatccagtcaccttctactaggtctgtccctcaacaactggggactacaattcaagatgagatttgggtgggggatgcaaagcctaaccgtatcatcatccttctactctctgtgtccatgacttcaattgttttgatttttagattccacaaataagtgagaacatacaatgtttgtctttctgtgcctggcttatttcacttaacataatgatctccagttcaatccatgttgttgcaaatgactggatctttatttttatttttttgagatggagtttcactcttgttgcccaggctggagtgcagtggtgcgatctcagctcactgcaacctccgcctcttgggttcaagcgattctcttgcctcagccttctgagtagctgggattatgggtgtccagcaccatgcctggctaattttttgtattttagtagagacagggtttcgccgtgttggccaggcttgtctcaaactcctgacctcaggtgatccacccaccttggcctctcaaagtgctgggattacaggcatgagccaccatgcccagctgacagatgactggatcttattcttttttatgattgaatagtcctccgttgcatgtaagtatcacattttctttatccatttatctgttgatggacacttgggttgcttccaaatcttagtgattgtaaacagtgttgcaacaaacacaggagtacacatatctttttgctacactgatttcctttcttgttggaaatatacccagcagtgggattgctggatcatatggtagcttaatttttagttttttgaggaacctccaaactgttctatatagtggttgtactaatttacatttccaccaacagtgtacaagggttcttttatctctacatcactagcatttgtgattgcctgccttttggatgtaagctattttaactggggtgagatgatatctcattgtagttttgatttgcatttccctgatgatcaaagatgttgagcatcttttcatatgcctgtttgccatttgtatgtctttttttttcttgagaaatgtctattcaaatcttttgcccgtgtgttaatcagattattcgatttttttcctacagagatgtttgagctgttccttatattttctggttattaatcccttgtcagataggtagtttacaaatattttctcccatcctgtgagttatctcttcactttgttaattgcatcctttgctgtgcagaagctttctaacttgatacggtctcatttgttcatgtttgctttgggtgcctgtgtttgtagggtattacccatgaaatttttgcctagaccaatgtcctggagattttccccagtgtttcttatagtagttttatagtttgaggtcttatacttgagtctttaatccgttttgttttgatttttgtatatggtgagaggggattagtttcatccttctggatatggatattcagttttcccagaaccatttattgaagagactgttctttctccaatgtctgtttttggcacctttgtcaaaaaatatttcactgtagacgtatggatttatttctgggttctctcttcagttccattggtctatgtgtctgtttttatgccagtcccatgctgttttggttactatagctctgtagtatagtttgaagtcagttgtgattcttgaactgcctcagcctcccgagtagctgggactacaggtgcccaccaccacgcctggctaattttttgtagttttagtagagacgaggtttcaccgtgctaggcaggatggtcttgatctgaccttgtgatctgcccgcctcggcctcccaaagtgctgggattacaggcatgagccaccaccacacctggccataaatgggattattttttaaaaattcttttccacgttgttgacaattggcatatgtaaatgctaccaatttttgtattgtaatttggtatcctgtaactttattgaatttgttgatgagttttaatagttttgtggtggagcctttagggttttccaaatataagattatgtcatctgcaaaaaaggataatttgacttctttctttccaatttggatgccctttatatctttgtcctgtctcattgctctagctaggacttgcagtactgtgttgattaacagtggtaacagtgctctagctaggacttctggtgctatattgaataacagtggtgatagtgggcatcctggttgtgttccagatcttagaggaaaggctttcagtttttctccattcagtatggtactagctgttggtctgtcatatatggcttttattatgttgaggtatgttccttctatctcaagcttttttgagggtttttaatcatgaagggatgtggaattttatcaaatgctttttcagtatcaattcaaatgatcatagtttttttccttcattctgttgatacgatgtatcacattgatagatttgaaccatccctgcatcccagggataaatctcaattggtcatcatgaatgatctttctataatgtattgttgaattctgtttgctggtattttgttgatgatttttgcgtgagtatttatcagagatattggcctatacttttcttttttttgatatgcgtttgtctggttttggtatcagggtaatactggccttgtagaatgagtctggacatttggaagagttccctcgtcctctgttttgcagtagttcgatttggattggtgttagttctttaaatgtttgatagaattcaacagtgaagtcatcggttcctgggcttttctttagtgggagacttcttattattgcttcaatctcagtacttgttattagtctattcaggtcttggatttcttcatggttcaatcttggtaggttgtatgtgtctaggaatgtgttctattcttctagattttccaattcattggcatacagttgcgcatagtaaccactgatgatcctttgaatttctgccatctcagtgataatgtctctgttttcctttctgatcttatttatctgtatctttttgctttttttcttagtctggctaaaggtttgtcaattttgttgaacttttcaagaaaccagtggtttgtttcattgattgttcattttttaaagtttcaatttatttgttctctgatctttattagctctttccttcaactaattttgggtttggtttgcttctgcttttctcatttttttaagatgcatcattagaaggtttatttgaagttcttcctttttttgatgtagacagttatagctataaacttccctctttgtactgcttttgctgggtttcggtatgttgtgtttccttaatcatttatttcacgaaatttttcaatttccttctcaatttcttcattgacccactggtcgttcaggagcgtattgtttaatttctctgtatttgtatagtttccaaaattcctctttttaacaatttctagttttattccactgtggtcgagaagatgcttgatattatttcagtttttttggaatgttttaaaacttattttgtgacctaaaatatggtctgtccttgagaatcatctgtgttctgaggaaaagaatatgtattctgcagccattggatgaaatattctgtaaatatctatgaggtccattaggtctatgatgcagattaagtctgatgtttctttgttgatttttttgtctagaaggtctgtccagtgctcacagtgggggtttgaaggtattattgtgttggggtttatctttctctttagctctaataatatttgctttgtatatcttgatgttccagtgttgagggcagatatatttaaaattgttgtatctttttgccgaattgatccctttatcattatatggtgactttctttgtctctcagagttttctgtcttgaagtctatttttccactataagtatagctattcctgctcttttttgtttgttttcttgtttcagttggcatggaatatctttttccatctctttattctccgtctatatgtgtccgtgtaggtgaagtttgtttcttgtaggcaacagatcaatgggttttgctttttcattcatttagccagtctgtgtcttttgattggagagtttagtccatttacattcattgttatcatttctaagtgaggatgtacttctgccattttgtaatttgttttctgatcttctttcttcccttcctgtctttctatagtgaagatgattttctctgttgctatgatttcatttcttgcctttttttttttttttgagacatggttttgccatgttgcccatgctgtaggatcttttctttatccttagcctttgggagtttgattatcaaatgccttgacatagtcttctttgggttaaatgtgcttggtgttctataaccttcttgtacttgaatattggtatctttctctaggtttgggaatccatttcaatacattttctaccctatctctttctctacctcctctttaaggccaataatgcttagattcgcacctttgagcctttttaaagatcctgtaggcatgcttcattgtttcttattctttttctttttggcttctctgactgtattttcatataacctgcctttaggctcactaattctttcttctgcctcatcaattttgctattaaaggactctgatctgttccttagctccaattgcatttttcagctccagcgtttctgcttaatctgaaaaaattatttcaatctctgttatatttctatgatagatttgtgaattccttctttgtgttatcttgaatttctttgatttttctgaacacagttattttgaattctctttctgaagtttcacatatctctgtttcttcaggaatggtccctggtgtcttattgagttcatttggtgaggtcatattttcctggatggtgttgatgctagtagatgtttttcggtgtctgagcatcaaagagttaggtatttactgtagttttcactgtctgggcttattagtacctgtcctttttgggaatgcttttcagatatttgaaaggacttgggtgttaatctaagctgtatctactttaggggcaagctcctcaagcccagtaatgctgtggttcttgcagactcatagaggtactgccttgatggtcttggataagatctgggagaattctctggattaccatgcagagactcttgttctcttttcttactttctcccaaacaaacattctctctctctctgtcctgagtttctcctaaacaaacagtctctctctgtcaccactccctggctactgcctatgttcactcaggctctggagctgtaccatcagcaggtggcaaagccagccatgcctgtgtccttccctttagggtggggaggtccctcagaccccagggttggaggttcagaggtgccatccaggagtcagggaccttagaattctacctgttgttctgtcatactgcccctgagctggcagttgaaccacaagacacagttcttcccactgttctctccactttccaaaggcagaggaacctcaccccataactaccacccacccaggctacgaggagtactgccagactaccataatattcctttaaggtccaagggctctgaagtcagcttgtgatgaatgcttcctggcctgggactcaggcttcagggcagtgggctccccatttggccagggcaggtttagaagtgctgtccaagagtcaagttctggaatcagggactataagagcccacttagtgctctacttccctgtggacatgctagaacctaaggtgcaagacaaagtcccctttacttttttctctgtttttctcaagcagaaggagttttttcccatagccactacagctagtaatgtgctgagtttcatcggaagccagcaagtctcaggggctcacccaaggcccttgatgtagtacctgggtatcactgctggttatttcatgtccaaggctcttcagatagcaggtgatgaacgctgctgggattgggttttttccttcaaggcagtgggttcccttttggctcaggttgtatctagaaatgtctaggagctatggcctggaatggggacctcatgattctgatggtgccctatcttgctttggcagagctggtatccaagatgtaagacaaagtcttccctactcttcctctcctctcctccagtggaaggaagggtgtcttttggagctgtgagctatgcagactggggttaggggaggggtgatactagcacacccctggctgccccagctgatgtctcagtatgtcatgtttccccccagtccactgtctctgggcctagttcatcactatgacttgcctaagagttgcagtccttatggtctagactgcctttcacatttacttgtacatagcactgtagcccttggtggcaaggtctgcaggaactcaaatttgtaccgctggggtcagggatttccctttggccagggctggtttaaatgctccctccatgggcgggcatcagcaggagttgggtcaggttttgctatctcctctaacaggacagcactaagttcagtgccccacagttgctgtgttctccctccccctgtgcccagtgatgcttaccccaccatgtcactgatgccaggggttatagaggggtggtattggcagttcaggactgtttttttttttttctatctcttcagtgcctctttcagcaataagaagttaaaaccaggactatgagtgttcgcttgatttttggttcttacaaaggttttctttttctgtgtagatagttgttaaattgatgttcttgcacaggggacaattggtgaagctttctattccctatcttcctccacctacctctccccttgtctctttttacacttttgaacttaaagtctgtgttgtctgatataaaaatagctactcctgctctgctttggtttttatttgcatgggataacttttctcttcactacatttttaggtaaagtgagtctcaggtgagtttcaggtaaacttttctccttactggtaaagtgagtctcttgtagggagctataattggggcgttgtgtttttgttttgttttgttttgtttttcttccattcagccactctatgtcttttgattgaaatactcaatccatttatattcgagatatttatctttagataaagactttttactgccatttggtgattgttttctttctttctttctttctttctttctttctttctttctttctttctttctttttctttcttttttgtagactttttgttcctgtcttactctcttttaatcttcctttgtgattaataatattttataatggcatactttatttccttactttttatcttttatgtatttgctatacttttgcattgtgattaccatgaggcttatgaaaaacatcttataaaggctgttttaacctgccaacagcttaactaactgcattaaaaaaaactttacacttcatctccttctcccatatttacaatttttgatactacagtttatatctttttaacctgtgtattcttttaaaaattattatacctattattgtttttaatagttttgtcttttaaccttcatactgaagatgtaagtgatttacatactgccattacagtattgcatattttgtatattttacatatttgcatatttgtacttacttttttcagtaacttttatactttcagatcagtatgttttatactttcaaatgtttttcttactaattaacattcttttctttcaggttgaagaactctttagcatttcttgtaagacagatctggtgacatgatattctttgatttttttccatcagttttataattttcctcatagatcatgtacatattttattggattaattttaagtacttcttgttattaatatgaatgatactgagttttaaatttaaaatttcaatggcttatttgtggtatgtagaaaagcagttgacgtcttgtatattgactttgtatacaggtaaccttactattcttggttattaattctaagaagcttttgtttgttttatcaaatctttggaaatttctgcatatgtcattatgtcacctgaaaataaagacagttttatttcttccttctcaatctgcatagctttcattttattttctaagtgtcttattgcatttactaggactttctgtacaatgctcaataggaatggtgagaagggacattcttgttctcttcctgatcttagcaaaaaagcatctagtttcttactattaacatgaagatgttagttgtaggtctttgtaggtgttctttatcaaggtgaggaagttcttttctattcttagtctgctgggagtttttatcatgaataagtattggattttgttaattgcttttattgatacgatcttaggatttttcttctttagctgttgatgtgatagagtaattaattgatttttgaatgttcctctgcggttatttagttagcactctttactttctcgtgccttgccattttgcttcatctattccctaataaaaatcttcgatcactatgtttttgcatctttaatatatgaaccaccagttgaagtccctgccttcagcttgctcactcttcaaaaacaggacatttgactgatttttgtctaaaaattttgatgtgggttttgatacagaaccattgaaaataaacggtatgaaggcataaattatatacaacagaatgaacgtattttgagtggtagttcaccaggtttgaaaagtgttatacatccacataatcaccaccagaattatgatatgaaacattttcatcaccccagaaactttctcttatgccctttataactcatcgtttcccctcacttgtggttcctggcaaccagtgatctattttctgtcattatagttttaccttttcttcagtttcatatacatggaatcacttagtacatagtcttttgtatctggcttctttacgtagcataatgccttttagatttatgtacatcatgttagcagttggttcttttttattgctgagtagcaatctgttgtatagatatgctgcagtttagtcatgagttaatggatgtttgggttatttctagctactggctatcgtgaattgttgcgggaagtcagggaccctgaatggagggaccagctgaagccatggcagaagaacataaattgtgaagatttcatggacatacattagttccccaaattaatacttttataatttcttatgcctgtctttactgcagtctctgaacataaattgtgaagatttcatggacatttatcacttccccagtcaatactcttgggatttcctatgcctgtctttaatctcttaatcccatcatcttcgtaagctgagggtgtatgtcgcctcaggaccctgtgatgattgtgttaactgcacaaactgttcgtaaagcatgtgtgtttaaacaatatgaaatctgggcgccttgaaacaagaacagggtaacagtgatgttcagggaacaagggagataaccattaggtctgactgcctgggagtcgggtggaacagagccatgtttctcttcttacaaaagtgaataggagaaatattgctgaactctttttctcagcaaggaacagccctgtgaaagagaatgcgttcctagggggaggtctctaaaatggctgctctaggaatgtctgaattatatggttgttgataagggataaaataagccccagtctcctgtagcactcccaggcctattaggatgaggaaattcctgcctagtaaattttagtcagactgattgtctgccttcaaactctgtctcctgataagatgttatcaatgacaatgtgtgcccagtggggcatgaaacttcattagcaattttaatttcgccctggtcctgtgatctcgctctgcccccatttggcttgtgatattttgttccccttgaagcatgtgatctctgtacccacaccctattcgtacactccctcccctttgaaaattgctaataaaaacttgctggttttgtggcttggggggcatcatggaaactgccgacatgtgatgtctgccccggactcccagcttttaaatatctctcttttgtactctttccctttatttctcagaccggccaacacgtagggaaatagaaaagaacctacattgaaatattgggggtggttcctctgataatgaataatgaatttgattacaatttttttggcaaatatatgctcccatttcacttggaaaaatacctacgaataggttcgctgggttgaaattaccaagctacttttccatccctaccagcaatagatgaatcagttgctctatacccttgttagcatttggccttactagtttaaaaaaatttagctattctagtgtgtgtgtgttgtggtatattgcagtattaatttgcatttccctaatgactaatgtttttgtgtatcttttcatgtgattatttaccatttgtatatcttcttggtcaagtgtctatttgaatatgttgctcatttgtaaattctgttacttgtcttactgatttattagagttctttatatatattagacaatttttttatcagatgtgttttgcacatatttctttcattctgtaatttgttttcattttctgaaaaatgtcttttgaagagtaaaagtttaattttatgaagtctaatttggcaattcttttcctttatgatttatatcttttgtgtcgtaataaatccttgcctaactcaatgtcacaaagatttttttcctttgctcctttagatgttttatagtttagattttacatataggtctgttatctatttgtttttatctataattgcaggtagaggttaaagttcctgttttttggcttaaaaaacagaaaacatttattttatggtttctgcaggttaggaattaaggagtggcttgtctgggcagttctggctaagactttctcatgaagaatcagatactgtctgggcatgtagtcacctgaacacttgactgggtggggcaagaatctccaaaagcgctcactcatatagcagtcaaaatgatgctgttgttggaaagtaacatcagtttctcttcacataagtttctttagagaggctgcttggttgtccttatgatataatgtctagcttttgccagagagagcaacccaagagaccaaggtgaaagtttcagtgccttatatttcctagccttagagtcatacagtattacttacacagtattctgtaagtcacagagttaagcccttatttacattgtgtgattctactgtattctatagaagacttccaagaacagtgatggggtcatctctatctcagctgacatgaatggataaagagaagagatcacatgcaggagattttgggggcagatctagaagctgtgcacattattttctgctaagcaagaaccacaggggcagttggggaatgtaattgagctgtgtgctcaaggagaagaataaataggtgtgagaagcatctaacagaaagttacttgaaaacaagatttcaggtaatgtcatccaaaaatgccattttttttagaaatgaaaaatacgtgtaactagaactgagagagaataaaattggtaaaatgacaggtgctactccataagaatatattatacacttcagtgtcacatcatttggccttttgctctaatttagtgaaaaacagttttcacgtctgtcctactatgtttgaagaaagataactgatttggtttaagaatctgttttgtggcatatatattagatatttagtatacgtagatttatattttactcattttagccctgagaaataactattatcatctgtatattatatataaggaagaagattcaaaaaaatttaagtaaatcatttgagatcatagggataataaacaaaattcaaatctatgtaaatctcacctgaaagcccatgatttttcatgataaacaaaataaagatactctcctttaaatcactgaatctatataactacactcttaattgcttaaaagatagtatttttaatgttccctttccagatgagacattctagatcttatatattcttaatattctggatctgtctgaaattgcagacttctgatagaaagatataattgaatataatatgaaaatagaacatgaaactgtatcttccactattgtttagggagctttcatcatatttggaagcatttttgcaaagtggtttcaagcatgcaaataaactagtatgttatcaatgaactctaggtatagattattttaaattatgtcatccagtagccacatatacttctttaaaggatcagttgtagaaaaatctacaactggaaaccaaaatattctcttcaaaatgtcttttagacaacaaatacacctttagtttattcaccatgcattttttatgataaattactcaatgttattaaaggcttgaaaaggtattttatgatccagtgataattactttagtggtgaagaaatctgaaagttgtgtggatatgctctataatggaagagtcatttacttatgaaaaacaacattactagtaaactgataaactaagaagtaaatggcaagccaaatgaccccacagttttggcgtgttattaacctgcaaattatccagaaacatcaactgctaggatcttaaaatcatgtaggcgaatcattggaaagtcatttttttttagtcttagtaaagagctaaattagatcaatattcattttttctcatggccattttgacagttgtcttgaaacagttatactgaaatgactacctcaaaatgtaagaaatgaggggtgcagaagagatagattagagatattctggagataaaattagtgaggcttataaatgaattggatactatagatggcagaagaaagagaggagaaagactcaaaggttataatgcaatttttggtttaggtaactggatgatcttgatgccagcaaatgagataggaaacacaggggggaggaagtgtgggtttggaggtgggaggaaaatgtattcagttttaaatattgatgagtttgagttcactgtggaacactgaaatggaactatttttcagttattagaaatagtcttaaactgtgagaaaaactttacaactggagataaagtcttcagagtcatcagtatgaagcaatgagaatggctgaaattatctttgaggaaaatgtgggagaggtgggttaaaagtagatgttaggacatcactaacatttaaggggtaggtccaggaagagaaagccctagctaaaggatctgcagaaaaatgatgacaatatgagagccaagacagggatagaataagggatggagattgtcaaagaagaagtgatattcggtgttgtcaaataaacaaggaggtttaataagataaagaccaaaatctgttcttacaagttcattagtttggggggattatggaacctctacaagggtgattttaataaaactgggaaagaaacctcattgtagtgcattgaggattgactaaagataaggaaggagagaacagtgtttaagtaactcttttaagaaatataagaagaggaaagagattagattgagaatactgaattatttctggccaagagaggacaattttagggtgtaaaagacttgagcttctatgtggttagaaaggaagaactaaaaatagagagaagttcacccatcctgcacttaaccatacagtttcctgacatgcttctgtgtcttagcaaatgctatttactctgcttagagttttttcaacaaaggcatgttaatagtgggggaaagaaagtaattttagcatcgtggcagtttctcagacatctttcaaaatattttctatgacctttttagtaggttactttggcaaattatatttaaaatgcaatgtggttggaacaagatggcagagtttctttcttcactgatagtacccccacaaaaacatcattttgcacaactatccacatatgaaagtaccttcataaaagctaagggaacctgaacatgcaaccaaggctgtaaagcccccatgaactgcaaagatgaataaactgtagttggaagataagattattggttctctgtgactaagatgcctctttctacaagccattacagtaccacacgtggaagtttctcctggactcatggtttctatattggaaaaaatgagttggagctgcacatttggcttccccacaatcctgggtcccttcacaggaggctcacttctgcactggcccattgggagcaacacaagtcctgatggggcccaaccatctgaggccagctaggaacaaacagaagatgtgggactagcagcagccggtgtgtggaacttggaagtggctcatgatacctgccataggagctgcactaaaggggccgtttatgggcatcatgctgcaagaagcacattccacagatcctctggacttgagggcctgactggctctcccacatggcctaggggcccttcagggaccttccgtgggtctatcctttgcatcagtgacagagccattgtgagactcgtgtctaacctgggcttagggtgccttctagcactgaaatagaatacagcagtcagctcagattcctaaacaagcccactaaaatagactgatcacaaacaaacctagactacaaagactagaataaatatctaatttgttaatgagtagacagagatgcatgtccacaaataataggaatatactaggaaaaatggcctcaccaaaaggacaaagcaaggtcctaacaactgatcctaaaccatgtagatgaatgatctggtggacaaagaattcaaaatagttctttgagtaaaactcagtgaacttctagaaaacagaaacaattcagaaatttatcagagaaatccaacagagaaattgggaatcatataaaaaatcaaatagaaatcctggagttgaaggatataataaacaaaatgaaaaatgcaatagagggcatcaccagcagaattcatcaagcagacgaaaaatcagctcgaagacaggctcttcaaaactatatagttggaggagaaaaatgaaaagtggaattagaaggtatgaagaaaactgttaggatttatggggcaccatcagaagagcaaatctgtgtatcattgatgttcgagagggactggagtaggggaaggggatagaaagctttttcaaagaagcaataaaagaaaatttttgaaaactggagaaatatacaaatatccaggtataacaagactagatttaccaatcaggtttaacccaaataaaacaactataagatatattagaaacaaactgccaaagacaaagagtggatattgaaagcagaaagagaaaagcaaataacaaataagggaatttccatactcctggaagcaggcttctcagcagaaacctgacagatgagaatgagtagaatgatatattcaaagtgctgaagggaaacaatcaaacaaacgagaaacctgtcaaccaagaatactgtacacagtaaagctattttttttaaatgaaggaaatctgaaggcattctcaaacaaaagctgagggaattccctgtaaccagatctgccttgcaaaaaaaggtgaagagagtttgtcatactgagagaaaaggatgctactgggtaacatgaaaaaaatctgaagatataaaacccacaggaaaaagtaagtgtccaggcaaattcaacatactctaatgcagtgattgtgggacataaaccacttatggtttaaccttcgttgttaggaagggttaaaagacaaaacaaaaataatagcaactacaataatttgctaaggtataaaaagatgtaaattatgtatataataaggtataataatataataaggtataaaaagatgtatataaaaagatgtaaattatgatatcaaaatatgaaatatgggagagcaatggagttagtgttttttttgaacaaaattgtcagcttaaaataatataactgtaagatgttttttgtaagtctcatggtaactacaaagcaaaacctttaataaatacaatacaaataaaaagtaagaaatcaaaacatactgatagagaaaacctcctacctggaaaggaagacagtaagaagagaggaacaaaggttctgcaaaacaagcagagaacaagttgataatatggcagcatcaagtctttacctattaataattaacttgagtgtaaattgattaaattcttctttgaaaagacgcagagtggctaatggatagaaaaataagacctaactatatgctgcccccaagagactcacttcacccttaagaacatgtgtagactgaaaatgatggatgggaaaaggtattccacgcaaatataaactaaaagaaagcagaaattcctatatttctatctgataaatggaatacaagtaaaaaattagaaaaagaggcaaacagggccattatgtaatgttaaaggggacagtagagcaaaaggatataacagttgtaaatatatatatatatatatatatacacacacatatatatatatatatatatatatatatatatatatatacccaacatcagagcacttaaatatataaagcaaacattaatagagctaatggaatatattggaatacagtaatagtagggaatttcacctcactttcaacaatggacagatcatccagacagaaaattaacatagaaaaactgaatttaaactgtactctatacccaatggacctaacagacatttatagaacattctgtccaacagcttcagaattcacattcttctcaactgcatatgaaacattctccagaatagatcatatcttaggctacaaaataaggcttaacaaattcaaaaaaagtgaaattatatcaagcgttttttctgactgtaatagaagttgaaatcaacaacaggaggaagtttagaaactgtacagatgcatagaaattaaacaatatactcctgaacaaccaatgagccaatgaagaaattaaaagggaatttaaaaaatttcttggccgggcacgttgtctcatgcctgtaatcctagcactttgggaggccaaggcaggtgaatcatttgaggtcaggagttcaagatcagtctggccaacacagtgaaatcccgtctctactaaaagtataaaaattagctgggtgtagtggcaagcacctgtagtcccagctacttgggaggctgaggcaggagaatcacttgaactgaggaggcggaagttgcagtgagccgagatcatgccactgcactccagcctgggcgacagagcaagactccatctctaaataaatatataaataaaagtttcttaagacaaatgataatggaaatgcagtataccaaaatagcaaaagcagtccttagagggaagtatacagtaataaatgccatcattaaaaaagaagaaagatctcaaataaacaacctaactgtctacctcaaggaactaggaaaactaacacgtctcaaggaactaggaaaacaaaattgagggaaggaaagaaataataaggatcagagcaaatataaatgaaataaagacttaaaaatacaaaaaaaaaaacccaggaaacaaaagtttatttttgaaaagataaaattgacaaacctttatgcagactaagaaaataaaagagactaaataaaattagaaatgaaaaaggaatcattacaactgataccctagaaatgcagtggatcataagaaactgctatgaacaattatatgccaacaagttggataacctaggagaaatggataaatttttgaacgcatacaacctaccaagcttgagtcaagaagaaatagaaaatctgaacagactgatgttgagtagcaagattgaagcagtaataaagcctcccatcaaagaaaattcaaggacctgatggtttcactgctgaattctagaaaacatttgaagaactaatacaaattattcacaaaatattctaagaaactgaaaatgaaggaactctttcaaacccattttatgagaccagcattgtcttgatttgaaaaccaatcaaagacacaacaaaagagaaaactacagactggttttcctgatgagtatagttgtaaaaaaaataaaatactagcaataaagattcaaaagcccattaaaaaggtaattcaccattatctagaaggattcaacccaggaatgtaaagatggtttaacataagcaaatcagtaaatgtgatacatcacattaacagattgaaggataaaactatgtggtcatttcaattgatacagagagagcatgtgacagacttcatctttttgtgataaagcttccagcaaattatgttcagaaggagtatacctcaacataaacaaggctagatatgataaaaccacagctaacatcatattaaacaaggaaaatttcataataataatttttttttaaaaaaagactgatttgaataataataaagctttggtctcctgcaaaaaaaaaaaaattgaaaactttttctctgatttctggaacaagatgtggatgcttacttttaccactgctattcaatatagtcctggaaattctagccagagcagttaagcaagagaaagaaataaaaggcacccaaattaacaaggacgaaatcaagttgtccctgtttgcagacaatatgattatctatacagaaaaccctaaagactccaccaaaaactcttagaactaataaacaaattcagtaaagttgcagaatacaaaaagcaaaatgcaaaaatcagtagcatttctatacaccaataggaaactatttgaaaaatcaagaaagaaatcctatttataagtcagatgcagtggctcatgcctgtaattccaacactttcggaggctgaggcaggaggatctcttgaaggcaagagtttgagactaggctgggcaacattgggagacgttgtctctaccaaaataaaaataaaaaaattaatagggcacagtggcacccacctgtagtcccagctactcaggagactgagggaggaggattgcttgggcccaggagtttggcactggagtgaattgttattgtgccactgcactccaccctgaatgacagagtgagactctgtctttaaacaaacaaacaaacaaacaaaacacctacctaggaatatacttaaggaagtgaaagatctcttcattgaaaattataaaacattggtgaaagaaattgaagacaatataaatgaattgaaagatatatcatgttcatggatggtaagaattaatatttttaaaatgtctatactacccaaagcaatctacagattcagtgcaatttctatcaaaattccaatgacattcttcacagaaatagaaaaaaaaatttaaattcatatggagccacaaaagaccctaaataggccaagcaatcttgagcaaaaagaacaaagctggagacatcatgctacctgattcaaaatctactacaaaggtatattagccaaaacagtatggcattggcataaaaaatagacgcatagacctatggaacaaaatagagagtcccgaaataaattcaggcatttacagccaactgatgtttatgaaaggtgccaagaacacacaatggggaaagaacagttttttcagtaaatggaactgggaaaactggatagctacatgtaaaagaatgaaactaggcccctctctctctctgtatgtaagtcaattcaaaaggattaaatacttaaatgtgagacttgaaactatgaaattgctagaagaaaacacaggagaaacactgtaagtgattggtctggacaaagatttattttagacaagacctcaaaaataagagcaacaaaagcaaacataaatggatctacatcacactaaaaagctcctgcacagcaaggaaaaaatcaacaatgaagagacagcctatgacattagaaaatatttgcacattatgcattcaatagcaaaaaaccccaaatagtctgatttaaaaatgggcaaaagatctgaatagatatttctccaaagatgacatacaaatagtcaacaggtttatgataaaacgctcaacatcactatcagggaaatgcaaatcaaaaccataatgaggtattgccttactgtggttaaaatgtctattatcaaaaacacacaaaaaatgttagtgaggatgtggagaaagaagaactctcttttttttctttttattttattattgttatactttaagttttagggtacacgtgcacaacgtgcaggtttgttacatatgtatacatgtgccatgttggtgtgctgtacccattaactggtcatttagcattaggtatatctcctaatgctatccctccccctccccccaccccacaaccgtccctggtgtgtgatgttccccttcctgtgtccatgtgttctcattgttcagtttccacctatgagtgagaacatgcggtgtttggttttttgtccttgctatagtttgctgagaatgatggagtctcgctctgtctcccaggctggagtgcagtggtgccaaaaactcaaatttcatggattgactttgttcttagtagaaaatctgtttgagaggaaatttgtgaagtagcaagagaaaaaggaaagcatggtaaagttagtatttcattatataggtgtgacagctggcacccagttttctcatttggttatttaagtgagcctaaacaagttgtcagtattcaaggctataattgtacagttgggtattttggcaagtcccaaatgtgtaattcaggctgtcataagtggacaatctaataaagtacatcttaagatcataagaatgttttttatattgcttataagttagttgaggaaggattggtcttcagtgttgtttatactctttgaaggcaattttatctaaatttttatttatttatttatttatttatttattttttgagacggagtctcactgtgttgccaaggctggagtgcagcagcatgatcttggctgactgcaacctctacgtctgggttcaagcgattcccctgcctcagcctcccgagtagctgtgattacagatgtgcaccaccacgcctggctaatttttgtatttttagtagagatggggttttcccattttggccaggctggtctcgtactcttgacctcaagtgattcaccctcctcggccttccaaagtgttgggattacaggcatgagccaccgcgcccggctgagaaacaggaactcttatatgctattggtgagaaggtaagttagtacagctgttgtggaaaacagtgtggaggttccccagaaaattataaaagttaaaaaaaaactgatccggcagtctcactactggagtatttatccaaaggaaatgaaatcagtatgtcaaagagacagctggacttccatgtttatttataatagccaagatatggagtccacctaaatgtccatcagtggatgaatggataaagaaaatgtattatacatacacaataaaatactattcagtcataaaaaggatgaaatcctgttatttgggacaatatggatgagcctggagggcattatgcaaagtgtaataagccaggcagagagacacaaatactgcatgatctcactcatgtgtggaatccaaaaaattgatctcctagaagttgtgagtacaatagtggttaccagaggttggggagaatgaggagagggtagatggggagaggctggtcagtgggtacagtgttacagttaggtaagaggaataaattctgctactccgttttacagtggggtgactgtagctaactgtaacgcatcggatatttcacatagctagaacagaggattttgaatgctttcccaacaaagaaatgataaatgtttaaggtgatcatatgctaattaccgtaatatgatcattacacaatgtatacatacattaaaacatcacattgtactccataaatatgtataattattacatgtcaacaaaaataagtaaaataaaaatgcgtttaatgcagagtggctgagtgaagagctcagcaagtccacttattccaaagtgacgattaaagtggattaaactgtcaaaaacagccatttcaggactttggaaagcgactaaaattatacaacagattgagaagcaattattcacgaaaaactactgaaccttatgtctatcatattttagcccctgaggctgctcccactacgcccattttcaccactgacttactatcatggtagtttttattagggtagggcaacctgtggaaaccagtagctttgctgttgatgctagggaaggctcacttgatctggagcagagcgtggaacaaccctatgtttccacagtattgttagaaacagtagtgatttttgtagcaaaggagtgggaagctcagtcttgcaagtagcatgagattataatcctggttggggaaagctacagattggccaggattttaacatggagatctgaggaattagtggagatcctacaattatcactggtcatctggaaggctctctattatgtgcaaggctctgcacacactcaggagaaaccagagagggcctgcctaactggtcatatgtccatgttgagaccttgcacatgtacaatgcagacatgtttccagaattctgtccctaaatactttcgcttctttcttttctgttgtatgaagggaatctgtgctccaggaaatgacggatacccgattctcccacaaaatctacagtcttttcttgtcagtaagtggcggcttttaggctccaagtataggaatttataatccaacctctgtctgaccctatgttttctgtactggattattgtgatacctcaaactggtcttcctgccttccagccttgtcccctcccctggagtctgtgttccacacaccagccatattcatccttttgaaatgtgtcagatgacattattcctcttctgaaaatcctttggtggcttctcattttacttagccaaagttctgtttaccatgattcacaaaaccatacataatcttgctgtctgagttttacttttctgacctaatgttctaccactctcagcctcataaattatacacttgtccttttgctgttcttccaacaaacaaaccagatgaactgctgcctctgggctattgcacttgctcttccctctctacctggagctctttttttccaccaaataggcacatggttctttctctcccctttttccagtctttctgtgaatgctatcttcttagtgaaatcttgccagctcagtaaatagtatgaataataataaatgaatgaatgaatagcaataaagggatagtaatgtcaatgaatgtttttcttttaaaataccttaaaattattcaataatgagaaagactagaaaagcagagataacatttctggaattgcactttaaaacatcaaaaacataaaatacaattttcaattaattattcttatatatggtccaaacaggagcaagtcactgaatttttgtttttctcttaaaattttttcacttctattcttaacagtttttcactatttgatatgtcaccttgtcttttgaaatatgtattagccatcacctatataaaaaaaagctacgaaaattacagagtaggaagtaatagtttcttttcttttatagatcaggtgtttcatacattttcaatacactttattattagttctgtaattgacattttgtcaacgcaaacatcaaaagttagagctggaggtggcataaaaatgctttcctgctgtggggaattagagtattcttttatttaattattttcaacaatttgcctgtcaaagcaaaagtggaagttcaagtcattctaaattgtcttgccttagcctgtaatttaactaaaaagggatacagatttaaagttgcttttaattttctgggagagatctaaagtaaaatgaattaaggtatctttgcctatctttcaaatgctgttcaaaaaatgaagtgtgttaaagggcattaatttgaataccaataatcttagcagaaagttaagtccaccaatactgttttatgaggattattttaaaattaatttgtcacctgtatatactcccacatgttctggattgcctctgttgaagttagagagctacttggttttgcttcatctgaattttaaactggctttctgtttgttggtctcatacttgcatttatacttgtaacatggatagtaaactgcaggaagaaactatttgaagagaacaaatgtctaatacattgtgctatcctaaaggctcagttctgggttagtgtgccctggaagagggcatatttgtgtattaatttgattcatgtaacaaatatttgtgtacctgctgtatttttagcactatgcttgattctgagagatgacaaaataattctatttctgttgcttaaaagacatatgcccaagtaattttaagtgtccaggttcatggtaacattaggtaagcttaacactttgttgtaccttttaggtttagtaaaatctgcattttttgttgttgtttttgtgtttgtattggctaaaatgctatcttaaaaaaattttccccctgagttgtcatagcttttactatagaaacaagtttgcaaatgaagattcttttttgagacagggtcttactcttttgcctaggctggaatgcagtggtgtgatcatggctcactgtagccttgaactcctgggttcaagtgaacctctcattgaacctcctgcttcagcctcctgagtagttaggaccacaggcatgtgccactaccccaggctaatttttaaattttttgtatagttgagatcttcttgtgttgcccaagctggtctggaactcctgggctcaagtggtcctcctgccttggctttccaatgtgctgggattgcaggtgtgagccaccatccctggctgaaaattgtttatacttggatgaaaaggaactagaggatatagaaaagaaatgaacttttaaagaaaagataatcatatagtgcttatgtgtggcaggcactggttaaggaaatgctttttaaactttaaatgtgcacatgcattacctggagatcttgttaaaacgaagctttattttataggtcaggggtagggcctggtctgctttcctaaaaaatgtctggataccactgctcctggttacaccatggtttgagaaacaagagtttaaattgcctacctatattagctcatttaatcctcttatcaactctatatggtaggtacaattattatatccattttacaaatgaagaaatatgtttccatgcaataatcttggcatgatagatgctgtttctttaccagataatttcagtgtttataaatgtgtgtgtgtgtgtgtgtgtgtgtgtgtgtgagagagagagagaaagagagagaaagaatggaggaggaaggactttaaagtattgttgtattattgcatttttacattatgtattctgacaaattaaaatgattaaaaatatatctgataaggaagaatatttgagaaaaagtggagggagagagtgtatttgtatttgttttctattgctgcataacagattaccaaaaaaaatttagcatcttaaatcatcacacatttactagatcacagtttccatgggtcagaagtctggacatgtcttagttgagtcctctgttcagagttcagatgactgtaatcagttttgtttagggctgtagtctctttgaggcttggggtgctcttcaaagctcacatgattttggcagaattcatttcgttgcggctttagaacccacggtagcttgcatattcaaggtcagcagaaaatctcagggaagagtagaaagtagaaaggataacattttgacatttgtgaaaacaagaattacatgtgcaagcagaatatgaagtatggttatgaggcagtgtttgaggttggagaggcagactgaaagcaggccatgaagagcctccacagaaacatagaacattatggactttaattgtataaagcagtggaaaatcactggagggatttgagctaggacatagcatgagcaaagattttcgtgaggaagattaagctggaagtaagctttgtaaaatgttaacagagaagaacctgtgatatgtaagtctcatttgaggggataaaagcctgaactagggtactggccctagaaatagaaaatgactgattttaagaaaattattgacatgaaaaggtgtctgagtcagacctctctttaattgccatattcaaggactgagttctgggttagcttgccctggaagaggctatatttgtgtattaattaattttattaatttaaaaaatatttgtgtacctgctatatttttagcattatgtttgattctgagatgacaaaaagttcctttaagattgcttatattttaaataggaataaacagtttaaatcattacagaagttaaggaatactgtgaaacattgcagtttgagttgcgtttgactcaaatatagtacatgccaaatgtgtggcttagatcctaagtgctgtgggactaattaagggtattatttgggctcttgacctttttctctacagataaccagtggtatttcaaaaaacaatttaaccatgcttgagtatgatagggtctcatatcaactagactcaagcatttaatgtgaattttctcccctgtgatttgtatttgatttaaagctctgaaatacaaaatagcaatgttaaatttatgattatagtctgttaaggtttaatcttattctagcctcaatcatatgtaatcattatgtattttaaaaatacaacaacagtttcttaagagtggcaattgacagcattcaacgaaagtatcttaaattttcaggtgtctgggttgtatatcttttaccagtaaaaatcctcatgcagttttaaggagtaattgacctttgacaaagaatatattttaatcacctcctgtagcaatgtttttgtcactggagagtttattatcctgtttttaactggtggaaaatttactgaaatgtagtgttttttttttttaagtggtactattcttgaatttggtggattgaaatttgattttaacctatttagtgtatgtgggaatgatttctattatattaaattgtaaggtatatagtctggtattttattatgattaataatatttatttattgctataaatatactctcatttttaatgaaattgttcctttggaaaagtgtaatattgtacacttaaaaattctttcatatttaacatttttgaagcaaataaaatatgaattggtactctgaaaggagcctcaggttgtcaaattaggactcctgagctaagaatgggttttgcacttttaaaaggttgtaataaaaaaagaagaaaagtgtgttacagagctgaaaatatttactatttggttctttacaggaaagctggctgaccccagtagtcacagcatatttgtgaatagatttaagtatgttttatgtaattcctgaaagtctgtgaaatgtactgtatgactatacttttcttgtgtacatatcatgttactttggtacattttattatataatagattttctttggattagtgcttcaaaataaacagttcttatacaactttttacatggatagtatttataatgaagttttagcgtatttctagtagaaaatatctttaaaaaattaaagtttttttttgcattttgaaacatgcagcgcaaaaactcaaatttcatagattgactttgttcttaacagaaaatctctatgaaaggaaatttgtgaagtagcaagagaaaaagaaaagcatggtgaagctagtatttcattatacaggtgtgatggcaggcacccagttttctcatttggtcatttaagtgagcctaaacaagttgtcagtattcagggctataactgtacagttgggtattatggcaagtcccgaatgtctaattcaggctatcataagtggacagtctaataaagtacatcttaaaatcataagaatatttttttatattgcttataagttagttgaggaaggattagtcttcagtgttgttaatactgtttgaaggcaattttatctaattttttttttttgagacggagtctcactctattgcccaggctggagtgcagtggcgtgatctcagctcactgcaacctctgcttcccaggttcaattgattctcctgcctcagcctcccgagtagttgggattacagacgtgcaccaccatgcctggctaatttttgtatttttagtagagatggggttttgctatgttggctatgctgatctcgtactcctgacctcaagtgatccacccacctcagcctcccaaagtgctggaattacaggtgtgagccaccgcacccttgaatgtaaaaatattttatgaagcttaagtttcaactttatagtaaatatgagttgtgactatgactttttgtattgtatgcttttagaaaagagttaataagttttatttttaaatacttctatttggttattaaattttttaggtttagtttttcttggtgacctcttttttcttttggtgtttgcacactaatgtcaaatttagttcacttagtactttgtagatatactatttacatgatatgaaacattattaatgtaaagagacattgccaagaattaagtgaacatgtttctctttatttctttctaatttgtttaaaactcttcctttgagaagttaagaaattagttctgaattagccagtaccccatggaatgttatccttagttcttccttttctttttttcttcaacttttaagttctggggtacatgtgcacatgatttgctgaaaagatcagtctgtcacctggatatgaagcccagcatccattagctattcttcctgatactcccccttccccactccccagacaggccccagtgtgtgtttttccctgccatgtgtccatgtattctcatcgttcagcttccacttatgagaatatgcagtgtttgcttttctgttcctgcattactttgctgaggataatggcttccagctccatccatgttcctacaaaggacatgatcttgttcctttttatggctgcatagtattccatgatgtatatataccacattttatttatttagtctatcttgatgggcatttgggttgattccatgtctttgctaattgtgaatagtggtacaatgaacatacagtgcatgtatctttataatagaatgatttatattcttttgggtatatacccagtaatgggattgctgagtcacatggtatttcttcttctagatctttcgggaattgccacattgtcttccacaatggttgaaataatttctcaacagtgtaaaagcgtctcttttccttcacgaccttgccagcatctgttgtttcttgacttttaaataatcaccattctgagtgacgtgagatgatatctcattgtggttttgatttgcatttctctaatgatcagtgatgttgattttttttttcatgttagttggctgcatgaatgtcttcttttgagaagtgtctgttcatgtcccttgccactttttagtggggttttgttcttgtaaatttctttaagttcctggtagactctggatattagattgttgtcagatggatagatagttctttcttaattcatgttattttcatgtgatgataatgtgtatacaactgtccatcatttttctaacttcagtgtgataagtgcctcacttcgcaactccccaaattctgaatgctaatatgatgcatctttgccatgcttcgtgttacaaaatgttgcttgaaagatgaagattaaaattaatttataatttatcttagagacattggcaccatgctggttgtatgatttctttatcaacacttctgtaagtgttgtagaataggatggcattggataggagagaatattagaagtaggagggaagttcagtttaacaacttggatgaaaacttgaccgcttactcatgtattttattgacattgttcagagtacatgttttgcacagatgttttatttaaaatccctgaagtttgaactgaaatggaacttttcctgtccattaaaatccttttttctacttaatgtaattcatagaataattgggaattgggtgaaaatctttgatttctaaagttttaagctattaaaaaatttcattcttatctttgtttttcaaggcaaataattatcttatgacctgaagatttgttttgcttaatgaaatgtgtttcaaaaggagagaaatcttacatatctacatgcaaagtagtcgtattctgaaaaaagttacacactgatacttatctgaaggttggaaggcttaatttaagtatctttcttgataagtacaaccagcctttaaatgatggataactgaactctgtacttgaagggtcagtggagctggctaaatgttacagtttttcatagaaatttgacttaatttttaaaatctttcaatttatgtgtaagtatattttcctaggtggttcagtaaagcgtgtgttttaaaagattgtctagatgcagcatgctaaaagagggaggtaagaatgtttattcattatggctacagtttaatatgttaatatgtttaatacatattaaacattaacattttaacattttaatcaataacattttaaatggtagcctaataaagagaggggattggtcagaaacaggatagagttcttattgttgttgactaatgataaaccaaatgcaatagaaaatccccaagtggattttctctgagataaactgataatataatagcattttctatttttccctagtaagtattgttgatggttgtcagttcgtttttcccaagcacatgaattagctaacgtgattctctgtactaatcttagtttttgactgagaatatcatgtacttaaccaaatctttgagatatttaaataaattaacaaaactgtaaaaatcatctttgtaaagctagtcactgatttatgatttgggaagataagcagctttgtattacttagaaaacaaagaaaaatatgtagaatttctgttttttcttttttattgtttaaaaatttaaatcaacatcagtgtgcagatgggtagataaaataaaaatttaaatcaacagatgtaaaatggaccattcctcttccctgcccaccaattctaattctcagaagaatttttttttttttttttgagatggagtcttgcttgttgcccaggctggagtgcagtagtgccctctcggctcactgcaacttccgactcctgggttcaagtgattctccttcctcagcctcctgagtagctgggactacaggcacgtgccaccatgcccagctaatttttgtatttttagtagagacagggtttcaccatgttggccaggatggtcttgatcttttgacctcaggtgatctgcctgccttggcctcccaaagtgctgggattacaggcatgagccactgcacctagccagaaattttttttaacagtttatgtattgttttccaagaggaatattctttatatcctgcttggcaacttgtttttcacctcaaacaatgttatgaacactacattaaacgatttctccctctttaattgcacagtattctgtggtgtggatatagcataattttatttttccatttctcttttgagggtcctataatcattttccctttttatttcctgctattacaaatatacaaatagtatgtactctgaaacacaaacacatatctggaattgaaattgttgtggtatggagatctgtttttgtataggtagtaccaaatttctgtccagaaagattgcaaatatatgccctttcctattgtgtatctgagtaccctttgtctcataaatttgccaacagtagatattatgtcttttcaatttttaccactctagttcacaataaatatctcattttgtttacatttccctgattacaagtgaggcttagcaagttttaaatatttatcgggctaatacatttgattttttaggtagcctatatgctgtaaaacctcattaagaactgctctttctgtcagagatttaatttgacaatacctatagtcaaattttaaaaatctgattgggttcattagtctgcctgcatattagtctaaaagaaagtcagaaaagtaggggaagagccatgaaaaatcattccttctttcccttcaaaaggagtgggtactccttttggatttttatctgttaagcagtctatattgttttgggctctcagcacattatagatttacagatcaaaattactaggaaaaccagaaataatccatcctgtttgaggggaggggatttgtgctttcccctagaagtctcttcctttctcttagatgtttattgagtgtcttctctgccagcactgtagctgtgtagctgctggccatttaggcctgtttcatccctgactgacagcagctttacttggtgtggtggcaataaatcaaatcaaaatgtagtgccattagagtaagacatcttaatcatgtttcaactgacctaagaaatttaaatgttctggaggatgatctctagtgagagctggagaccttatagtttgtcaggaatgttaaggtatatagggtgtctaaaagcatatagtacttgaaacttattttcgtggtgatctctggagaatgctctctgtaatgataataacaacaataggagttagcttttattgagcatttacacctgcctgggattactgtcagcattttacatctgttctgcatagtgtgaggaagtactttctggcctttggactttcgttctcataagtagttgtagaaggtctgcggctacacaaagtctacttctttagggaccttgtgtctaggagtgcttgtatagccattttaccctcttttgctgcctatttagtgattaggattcagactaaaaaaatgatttagtgattaccttggtgtgatcattcacacatcatggtgatagtgatacagctgcatattttcagtgaatctttgaattagaagagatagagtcatctactgcttccctttttctgaaatagaatccctataataccttgtgagtgcactggccactgtggaaacaggctgagtgactgattcacaatggaattaattccactttctagttattaataataaggaaaatatgtatgaaacactttgtgaattatccacttaccagaagctttttaacttgatgtgatcccttttgtccatttttgccttggttgcctgtgcttctgggggtattactcaataaattgttgcccagaccaatgtcctcgagagtttccccaatgttttcttattgtagcttcataggttttggtcttagatttaaatctttaatccattttgatttgacttttgtatatggtgagaggtgcctagtttcatccctctgcatatggatattcaattttcccagcaccatttattgaagagactgtcctttcttcaatgtatgttcttggcacctttgtcaaaaaagagttcactatagacatatggatttatttctgtgtcctctcttctgttccattggtctacatgtcttttatttaatgccaaccccatgctgttttggttgctatagctctttagtataatttgaagtcaggtaatgtgattcttccagttttgttctttttgcttaggatggccatggctagtctgagtcttttgtgattccatataaattttaggattgttttttctatttctgtgaagtatgtcattggtattttaaaagggattacattaaatctgtagagtgctttgggtaatatggacattttaacaatattgattcttccagtgcgtgaacgtggaatatctttttattttttggtgtcctctttgatttctttcatcagtattttatagttttcattatagaggtctttcgcttgtttggttaagttaattcataggtatttaattattttttagattgtttgctcttgacttacagaaatgctactgattttttatgttgatttttgcattctgcattttactgaatttatcagtttgaatagtttttttggtagagtctttagtttttccaaatataagatcgtatcatctccaaagaaagataattggcttcttccttttcaatttgagtgccctttatacctttcttttgtgtaattgctctggctaggactttcagtactatgtcgaataactgtggtaaagttgggcttccttgttgtgttccactatcttagaggaaagactttcagttttcacccattcacagtgatactagctgtgggtcttttgtatatggattttattgtgttgagatatgttgcttctgtatccagtttttttttgaggggttttatcatgaagggattttgaagtttatcaaaattttttaagcatcaattgaaatgctcatatggtctttgtccttcattctgttgataatgtatcagattgattgatttgtgtatgttgaatcatacttttatctcgaggataaatcccaattggtcatgatgaatgatctttttaatgtgttgctgagtttggtttgcctagcattttgttgaggatttttgcataattgttcaacaggaatattggcctataattttcttttttaaatgtgtttttggttttggcatcaggacaatactggccttgtagaatgagtttggaagtattcctttctcctcctttttttgaaatagttccaatgggattgatattaattcttctttaaatgttgggtaaagttcagtgatgaagccatcagatcctggacttttctttgctgaagactttttaattacgactttgatctcattacttcttattggtctattcaggttttggatttcttcatggttctatcttggtaagttgtctgtgtctgggaatttatccatttattctaagttttacaatgtattgacacgtagctgctcatagaagtctctaataattcttcaaatatctgcagtattggttgtaatgtcttctttttatctctgatttcatttatttggggcttctctttttttttcttagtctgtataaagttctatcaattttgtttatcttttaaaaaataacttgtcattttgttgatcttttgcatttttttcatttatttctggtgtgatatttattatttcttttttttctcctaattttaggtttgatttgttcttgcttttctagttctttaagttgcatcgttaggttgtttgatgttttttctacttttttgatgtaggtgcttatagctataaactttccttttagtactgcatttgctgtatcccataggttttagtatgttctgttttcattttcatttgtttcaataaattttaaaatttccttcttaatttcttcattgactcactggtcattcaggaggaagttgtctaatttccatgtgtttgtatagttcccaaagttcctcttgatttttagttttatttagttgtgggcagagaagacacttgatataatttcagtttttaaaataaatttaatacttttttttggcctaactgatgacctatccttgtgaatgatccatgagctgaggagaagaatgtatattctgtagccactggatcaaatgttctacaaatgtctgttaggtctatttggactgtggtgcagattaagttccatgtttctttatttactttctgtgtggatgatctgttcattgctgaaagtggagtgttgaagtctctagctattgcattggggctgatctctttctttagttctaatatttggtttatatatctgggtgctccaatgttgggtgcatatatatttacaatcattatattctgttgctgaattgacccctttatcattacatagtgacccctctttgtgtgtgtgtgtgtgtgtgtgtgtgtgtttttttctttgagactgagtcttgctctgtcacccagactggagtgcagtggtgcgatcttggctcactgcaagctccacctgccgggttcacaccattctcctgcctctgcctcctgagtagctgggactacaggcacccgcctccacacctggctaatttttttgtattttttagtggagatgcggtttcaccgtgttagccaggatggtctcgatctcctgacctcatgatctgcccgcctcggcctcccagagtgctaggattacaggcgtgagccatacagtttttctcttgaaatctgttttgtctaattatagctcctcctgttctttgtggcttccatttgcatgggatatcttttctatccctttattttcagtctgttttgtgtttttacaggtgatgtttatttcttgtaggcaacagatcattgggtcttattttttaaatccatttagccactctatgtgtttttattggagagtttagtccatttacattctgtattattattgataaatgaggacttattcctgacattttgttatttgttttcttgttgttttgtagtattctctttcttcctatcttcctttctgtgaaggttattttttttggtggtgtgctttgagtttttgctttttattttttgtgatcttttgtatgttttttgacttgagttaccctgaagcttgtaaataatatcttataacccactattttaaactgatgacagcttaacactgattgcaacaacaaacatactattaggttggtgcaaaagtaatcgcagtttttgccattactttcaatagcaaaaactgtgattacttttgcaccaacctagtaacaaacaagcaaaaagaaaactaataaaaaatccacactttaccttcatttgccccacttctaaactttttgttgtttctatttattttttatttatttatttattttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaagacagaggaatttttcttagtgcagaacaaaatgaaaagtctcccatgtctacctctttctacacagacacggcaaccatccgatttcccaatcctttccccgcctttcccgcctttctattccacaaagccgccattgtcatcctggcccgttctcaatgagctgttgggcacacctcccagacggggtggtggccgggcagaggcgcccctcacctcccggacagggcggctggccgggcggggggggggctgaccccccccacctccctccaagacggggcggctggccgggcggggggctgacacccccacctcccggacggggcggctggccgggcagaggggctcctcacttcccagtaggggcggccgggcagaggcgcccctcacctcccggacggggcggctggccgggcgggggggctgacccctcccacctccctcccggacggggcggctggccgggcagaggggctcctcacttcccagtaggggcggccgggcagaggcgcccctcacctcccggatggggccactggccgggcaggggggctgaccccccccacctccctcccggacggggcggctggccgggtggggggctgacccccccacctccctcccggacgaggcggctggccgggcgtggggctgacccccccacctccctcccagacagggcggctggccgggcagaggggctcctcacttcccagtaggggcggccgggcagaggcgcccctcacctcccggacggggccactggccgggcaggggggctgaccccccccacctccctcccggatggggcggctggccgggtggggggctgacccccccacctccctcccggacgaggcggctggccgggcgtggggctgacacccccacctccctcccggacagggcggctggccgggcggggggctgacccccccacctccctcccagacggggcggctggccgggcagaggggctcctcacttcccagtaggggcggccgggcagaggcgcccctcacctcccagacggggcggctggccgggcggggcgctgacccccccacctccctcctggatggggcggctggccaggtggggggctgacccccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggctgggcggggggctgacccccccacctccctcccggacggcacggctggccgggtgggggggctgaccccccacctccctcccggatggggcggctggccgggcggggggctgaccccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggctgccgggcagagacgctcctcacttcctagatgtgatggcggctgggaagaggcgctcctcacttcctagatgggatggcggccgggcagagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcattcggcagactgaggcaggagaatcaggcagggaggttgcagtgagccgagatggcagcagtacagtccagcttcggctccgcatgagagggagaccgtggggggagggggagggggagggggagggggaggggttgtttctatttatatcttattatcttgtctaactcttgaaaagttgtagttatttttaacaggttcatctttctacccaaaatgtgagtagtttactagtttacaaagcacaattatagtgttatcattttctgtgtttgtgtacttactattactagtgagttttgtatcctcagataatttcttattgttcattaatgtccttttccttcagattgaagaactccctttagcatttcttgtcggacaggtctggtgttgataaaatctctctgtttttgttgatctgtgcaagactttatttctgcttcatgttggaaggctattttcactgaatatactatcctaagattttttttttcctccagcactttaaaatgtcatggcactctctcctgtcctgtaaggtttccactgagaagtctgcttgccagacatattgcagctccattgtatgttgtttctttattcctgctgcatttaggatcctttctttattcttgacctttgggtgttagattgacctctgggtgttatacaaccttgacctttgggtgttttgacctttgggtgttagacaaccttaaggttgtcttctttgagttaaatctgcttggtgttctataacctttttatacttgaatatttttatctttctctacgtttgggaagttctctgtgtgttttttttgttttgttttgttttgttttgtttgagatggagtcttgctctgtggcccaggctggagtgcagtggtgccatctcggctcactgcaagctccacctcccgggttcatgccattctcttgcctcagcctcccaggtagctgggattacaggcgccggccaccacacctggctaatttttttgcttttgtatttttagtagagacagggtttcactgtgttagccaggatggtctcaatctcctgacctcatgatccgcctgcctcggactcccaaagtgctgggattacaggcgtgagccaccacgcccggccgggaagtactctgttattatccctttgaatacacattctgcaactgatctctctctctctctgcctcctctttaaggataattactcttaaatttgcccttttgaagctattttctagaccttgtagttatggtgcattcttttttattctttttttcttttatctcttctaattgtgtgttttcaaataggctgtcttcaaggtgactaattctttcttctgcttgatcaattctggtgttgaaagactatgattcattcttcagtatgtcagttgaatttttcagctccagaatttttgcttgattttaaaaaaataatttcagtctctttgttaaatttatatgatatgattctgaattctttctctttgttatcttgaatttctttgaactttctcagagcagctatttcgaattctctatttgaaaggtcacatatctctgttacttttggattgattgctagtgcttcatttagttcatttgggagttgatgatttcctggatgatcttaattcttgtggatgtttgttgggtgtctgaacattgaagagttaggtatttattgtagtcttcaagtttggatttatttgtaccagttcttcctgggaaggctttccatgtattcaatgggaattgagtgttgtgagttaagtctttggtcactgcaggtatatctgcgttagagggcaccccaagccatgtaatgatccttgtggaattttagaggtacctctttggtggtcttcggtaagatccaggaaaattctttgtattagcaggcagagactcttgttctcttcctttactcttctccaaagagattctctctctgtgtgctgagctacctggtgtttggggaggggtgacacaaccatttctgtggccaccacctttgggactgttctttatcagacctgaagccagcatagcacaggatctcatccatggcctgtggctctattgcctggctactgctgatgtttattttaggcccaagtgctcttcattcagcaggtgatgaatcctaccaagagtggattcccttttcccttttgacctagagtgtgtcgtgaaatgttatctgagagcgagggcctggaatgggggcttcaggactctgcttggtgctttattttactattgctcagctggtatttaagttccaggacaaagtcctctttactctcccctcttatttcctcaaattggaaggagtatccaccaaagctgcaagctgtgctgcctagaattacaggaatggtgacataagcactcccttggctgccctacctagtgtctatctagatcacttgcacctcatgtctccttgctccaagcccagcatagcaccaggacttccccagggattacagtccttgtggcctagactgcttttcaagtttatttaggacccctaataaagtttcaagtttataaggacccagagtgctttagcccgtggtggtgggtctacctggaactcactgactgctgggatttcctcttgctagggctggtctaaatgctccctcctttggcatgggctgaattttgtcctgtgttactttctgctgtaatagggcagcagtgagttccaatgcaaagtttcacagtcactgtgctctgtcttccccaagtacatggattctgtctctgcaacacacaggcactatccagggatgagggagtgatggtgtaggcagttcaagaccatcttttttcctcactgcagtgcctctttctttgatagctactctttctttaccatgtctggtattcgaatttgctcagtaactcattttggttcttttcagcagtacaaatagactttaggaggggattatacaaaaatctgaatggagatatgaatgtggtctcactgttacttccttgactatctgatttcatgttgttgttttggctagtattgtgggcatttctcttttattattgctttgtattcttccttttagaattccatgcttggttgaagacagtgatctgcccagttagagatgggctctaacatctaacatctaacagatgttaacaagcttctttttcatccattagttacgtttgagctatcttgatgggttctttcttctcttccaccactttgcttcttttttttttaaattcaatttaatttttattaattttattaattaattaatttttaccttgcagctccagctcaaaggaagctttgcttctagtcacctccaacacttgcttaatttttttattctaattgattggctgccttataagaagctgttctttgaataatatgtttaaaactaattctttctgtagctatttatgtatgttctttcctatcatctgcaaagtgcttctctcctttgccacttcacaatttactttaaaaaaagagtcatagataataaattcaaatagatattcctaagttactgaatgatagccatatgctacccttatgattaagaaagcattttcctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaaattttgtataaggtgtaaggaagggatccagtttcaactttctacatatggctagccagttttcccagcaccatttattaaatagggactcctttcctcatttcttctttttgtcaggtttgtcaaagatcagatggttgtagataaggatgtggagaaataggaacacttttacactgttggtgggactgtaaactagttcaaccattgtggaagtcagtgtggtgattcctcagggatctagaactagaaataccatttgacccagccatcccattactgggtatatacccagaggattataaatcatactgctataaagacacatgcacatgtatgtttattgcggcactattcacaatagcaaagacttggaaccaacccaaatgtccaaccgctatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacactgcatgttctcactcataggtgggaattgaacaatgagaacacgtggacacaggaaggggaacatcacactctggggactgttgtggggtggggggagtggggagggatagcattaggagatatacctaatgctaaatgacgaattaatgggtgcagcacaccaacatggcacatgtatacatatgtaactaacctgcacattgtgcacatgtaccctaaaacttaaaagtataataataataaaatttaaaaaaaaaagaaagcattttccttaatattgttagctgttcttcagataagatgtttgactgccctaggtctcgagtatttttgacgggtttcaatgattaatgatacgtttttattaatcacttatgcttagcaactgcagggattttttaattaaaaacttgttattagattcagaatgacagtgatgatgcttaagttgggaaagaaatcatttgagttgtggtcttttctaccttgaatcttctctctgtaataaatcaccctgcttttgacagtgggaaatgttataatatttaagaaattaaagatgatttgtgttagctttaatggtttacatttgtatgtcagcttttctgtagaacaagtatagtattctgattctgtcatttgagaaacgagagattatattgcatttaaggtcatacacatgtggttttggtctttcacagttcaggatgacctaatttacatggaggtaatgaaaatagatcacttttatattattctagttagacaagtatcattattaccttttcagatctgtgcttcttcctacaggtttgcatgattaataaggttttgggtttttttcccctggtgtggttagaggaaagtttatagaacctattgttgcctatattattttaagcaaggatttgtttactaaaaacagtaaaattaagagaaaaatctctgaataccttcaatcacaacattttatttgtgttctacttggtagcttttaaagtaattctctggttaaaaaaagaaaaaaaatgagattttgtgtgttttcaccccaattttgtgatttatttttaactttatttgaaaacaaaaaagaattgtgtgtatagatatttcttttataatgtcaattaatactgattctgaaaatttccttttattattaggatgaaaaacattgctaatagaaacacaattttttttttcaaagcagagagtgaccaaagttgagagaaacagccctgaaattattttgattgaagtatcatacatatttattttgtttgatctaaaaatttacatctattgtatcctattttggtgttgcacaattagctactgatctctgcatgttaaaaatcagtggataataagagataaaacaaactgggaatgtgtttttagttacctttgaagtgataggcataaaacagaagactcaataacaataatagtaattcaaagaatgacagctaacacttggtactactgtgtgtcagttactatgtttagtacttcatatatattttcatttaatttttacaacactatgtaattgagagtattatttccattgagcacatgtttagattgaagaaagtggtagtcctactgtatgggtctgatgacatcttgtatactctgtgtagtactggtttttgaaggataacagtaaactgcagtagatgaggaaaatgttcatgaaagggagttgaagttaggcatattaaaggagacttcaccaaattctgctccctaagttaagcgtagtctctcagagatctcttctaatgttaaaatttatagaggaagttgggactgctagttaagaatgttttaacttccattcttaacatcttcatactttcccaaagtctcagtcaaaagataaagtgtcctcttgatcagtcacatccccaaatctgggcactttcatattcttaaggaatgtacacaattctttgtctttgtctctctattgtttttcctcaccctaagcgtgtgaacatattccaaaaataaagcactaataaaaaaattcttttatttatttcacattcgagtgtcatgtactagaagctactatataaagacaaataagatatagtcccagcactcaaagagcctggcttctaggaaagagaaaagacatgtaaacatgaatgttgtagatattaaacacacaagtaaataaaaccaaacatgttttcattaaagttttatatgtattatagtagaagtctacataggagcaaaaaggaaggactggccagttttccaggaaatggaggttgataaagggagcataaggcttgaattgactctgcaattctctttagctatattaacctgtctctcatctttctatatttcctgagttgggtaaagaaaagtatacatttaatgtctccactttcctctcatgtattcctcaaacctgtgccagtaggcattcaagtttgttaaatgataatggcttatgatagctaacatttatagagctcttgccctttgccaggcaccctaataacatgtttcacatatagtaacttgcttatttcttacagccactctctaagataagtactgttatcgtccccatgttagatacagacaactgaagcacagagaggttaaataccttgaccagtatcacaactaataactgttggaactgggcttcaaatctaggccgtttggctttgggacctatgcattatgagtgactggcgaacaaaattctctaaaaaggaattcgaggaaaagagacttttttttttttccagtgaacagtttgcaaaccagggaaacatagccttcggtgtaaaatgaagaatgcatttcagagaacaaagagaaggtttggattttatagaaaaatatgcttcccaaattcccaatcaggtccatttatgcaaatgaaagatttaaattcatgtagttccaaatagttggcacagtggagttctgagtcgttgctacaactgagccctcattggctgtggcaggtgagtcctgattggttgatttccaagctctaaaccagagatctctgtcagatgtttctttcaaatggctggcgggtggtgtagggtttttggtttatttatcttggcacagacatcaggaactggtttggcttgattgtagaaagggagggcctgtgacactttcacatctttctgagaacacagagtacgtgactgcttcttcacccaggatggcctcctggttctgttttactttgagcatctcagccacagggagtccattttgtctgttggataggggtatactttaacagactgaatgaacctagttgccttttacccatgtctgcacacaaatgcttatatactaaagttcatttatttccaaggcatacatttttcctagttttaatggattttcctttgtcctctcccttcactcattcaggaaattttgaatactcttatggccaagtactaatctagcattggaaatacagaaataaaagtggccactactatcacgaagctcatagtatgatgggagaaaatgtagaggaaaattataattataatatgacgtgctaagtgctatgatggtatgggcctaggggggcagtatttaacccagccagaagagggtaacccctaacctgaattatgatggaaaagtaggatttagctaagcctctttctattatttgtcctccctatttttttctatgtataatgggatacagttgctttttcaaaaccttcaattacccctttacgtatctgcacggttgcattgttccttctgttatcttctttgtcatgttctacttgcaagccttctcggtgtgtcttttactgtactttggtctccagtgtctttttcattcttatttcctttttagtttattcatcctatctagaaacttgtcttatctgctacagtaggaaatttaatttacttttcttcagctcctttcttcctctctggcaggctgccaagtgtttaaaacactcatgattattggtttcttcagagaggaagatagatctgggtcatacgcttgatgtcactgggatattcatttcatttttgttctttctgggcatcaaggggaattttaccccttgaagtctctcaattaaatcttgcccccaatttactgtttcttgggcatgttcctttaatgcgcctagcttttctatttttggcatgagtgcccaacatttactggatattggcacttggcacacagactggtgtctgctgaatgccagatatagccttctttacaaaacatgatgggaaaaattatgagggaaggtagtatttgactctggattcaaacacaggttgaattctaaccttttatcatttattagcacggtaaccttgggcaagttacttaacctctctctgcctcaattttctcatttttaaaatgggcaaactaatagtgactacctcattaggtttttagaggattaaatagattaatgcctttaaaattgagaacagtgagtggaatatagataaaaaaggaagacatttcataagtgcctggggttcccagcctctttggccaagtactgtttttccatccaactgtttggcccctgatttgcttttacctctcccttacttgttcatcagggatctggttttacttcaaattgtgcttattatcttttattttcctgtggttctcctctgctaatctaggtttttatagttctaatatccttttgtagtggaaaataatttgggagattgacaggaagacaataattgttgttaacagtgagattttatggcacatcgttggggtttatagtaataggtttttgtttcatatagcaatagggattgttcaaaagttaaaatttttttttgccatgcttatcattatgcatacttataagagattagaatatttcagaaatataaaactcagaaataaaagaagtattctctaagtatttagtgcttgctatgtgataagatactgttggaggtactgaaacataattgctattaatagtttggcattatttcttacagtttttttaaaaagatctgtatagtcataaaagttatgttatttatgaaaataagaatgataatgttttgttttgcaggaaaagtcaacactaataatatgctctagagaaactaacgcttacttagatgtttttaacattatagtaaactaatatgccgagcttcaaaatgacccaacatataacttgtagctgggatattttggtgcatttggcattatactgtaatttacagtatacaacatctgaggacttttagcagtatcttggcacaacagactgactcctcccatcccatcagaggtggagggaggaactcttttctccccataaattcttgatttttaattaattaattaactagtttttctagttttcatctcctctcttaatattggactttgatatttaccttttttattcatttaatttattttttaaaaatgttttggccagatgtggtggctcacgcctgtaatcccagcactttgggaggccaaggcaggtggatcacaaggtcaggagattgaggccatcctggctaacacggtgaaacgccgtctctactaaaaaatacaaaaaattagctgggcatggtggtgagtgcttgtagtcccagctactcgggaggctgaggcaggagaatggcatgaacccgggaggcagagcttgcagtgagccgagatggcaccattgcacacattggtctctgtgtcttttttcatgcaagtcccatgctgttttggttactgtagctctgtggtataatttgaagtcagtaatgtgattgctccagttttgtttttttttttttttgctcagaatggctttgactattctgagtctattgtgatttcatataaattttaacatgttttttctatttctgtgaagaatgtcattggtattttggtagggattacattgaatctgtagattgctttgggtagtctggacatttaaatgatattgattcttccaatccatgaacatgaaatatatttgtattttttggcatccttttcagttttttcattggcattttatagtttttattatagagatctttcacttctttggttaagttaatttgtatgtatttaattttatttgtagctattataaatgggattacttttttgatttcctttttaaattgttcactgttggcatatagaaatgctactgatttttgtatgtttattttgtatcctgaaactttattgaatttatcagttctagtggtttttttagtggagacttcagttttttccaagcataagatcgtatcatctgcaagcaagtttaatgtgacttcttccttttcagtatgaatgccctttatttttacttttttaaaaaatacttttattctaagttctgtggtacatgtgcagattgttacataggtaaatgtgtgtcatgggggtttgttgtacagattatttaatcatccaggtattaagtctagtaccctttaattacttttcctgatcctctgcctcctctcaccctcagccatccgatagaccctagtgtgtattgttcccctctgtgtgcccatgtgttctcaccattcagctcccacttacaagtgagaacatgcactattcagttttctgttcctgcgttagtttgctaaggatgatggtctccatctccatccatgtccctgcaaaggacatgatctcattttttttatggctacatattattccattgtgtgtatgtgccacattttctttatccagtctatcattgatgggcatttaggttgatttcatgtctttgctattgtgaatcgttttgcagtgaacatccgtgtgcatgtgtctttataatagaacaatttatatttctttgggtatacccagtaatgggattgctgggtcaaatggtatttctgtctttaggtctttgaggaatcgccacactgtcttccacaaaggcagaactaacttacactcccaccaacagtgtataagcatttctttttctccacaaccttgccagcatgtgttatttttgactttttaataatagccattctgactggtgtgaaatggtatctcattgtggttttgatttgcatttctctaatgatcagtgttgttgaggtttctttcattgattcttggccccatgtatgtctttttttgagagatgttcgttcatgtcctttgcccactttttaatggggttgtttttctcttgtaaatttatttaagttccttatagatgctggatattagacttttgtcagatgcataaattgcaaaaatgttctcccattctgtaaattgtctgtttactctgttgatagtgttttgttgttgttgtttttgctgtgccagaagctctttagtttaattagataccatttatcaatttttgcttctgttgcagttgcttttggcatcttcatcatgaaatatttgtgccgatgtctcgaatggtattgctgaggttgttttcaaggatttttatagttttgggttttacatttaagtcaataatctatcttgagttgatttttgtgcatggtgtaaggaaggggtccagttttaatcttctgcatatggctagccagttatcccagtgccatttattgaatagggaatcgtttccccattgcttgtttttgtcaggtttgttgcagatagttgtagatgtgtggtcttattcttgggttctctattctgttccattggtctatgtgtctgttcttatatcagtgccatgctgtcttggttaccatagccctgtagtatagtttgaagtaatgtagcatgatgtctccagctttgtttctttttgcttaggattgccttggctattcaagcttttctggggttccatatgaattttaaaatagtttttttgtagttctttgaagaatgtcaatggtagtttaatagaaatagcattgaatatgtaaattgcactgggcagtttggccattttcacaatattgcttcttcctgtatatgagcatggaatgtttttcatttgttttttcatctctgatttctttgagcagtggtttgtagttctccttgtagagatctttcatttccctagttagctgtattcctaggttgaatgtcctttatttctttctcttgtatgactgctttagctagaactttcagtactttgttggttaacagtggtgacagtgggcatccttgttttgttctagatcttagaggaaagactttcagtttttccccattcagtatgatactagctgtgggtctgtcatatttggcttttgttatattgaggtatatttcttctatccccattttttgagggtttttattatgaaggaatgatgaagtttattgagtgctttttcagcattaattgaaatgctcatatggtttttgtacttcattctgttgatatgatggatcacattgatttatttgcatatgtcaaaccattcttacatcccagggataaatcccatttggtcatgatgaatgattcttttaatgtattgttgaattcatgtttgcttgtattttgttgccaattttggatcagtgtacatcactgatattggcctacagtttcccttttttgatatgtcttttggtatcagggtaatactgaccttctagagtaagtctggaagtattccctcttcctctgtttttcagaatagtttgagtaggattggtattagttctttaaatatttgatagagttcaacagtgaagccatcaagtctcaagttattctttacttagaggctttattacgacttcgatcttgttacttattattgttctgttcagcttttggatttcctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggcctggatttcttcatggttcaatgttggtaggttgtatatgtctaggaatttattaatttcttctagatttttccatttattggcatatggttgctcatagtagccacaaatgatcctttgaatttcttcagtatccattgtaatgtctcttttttatctccaattttatttattttggattgtgctgggtcacccctgaaacgagcatgtctcagagcccaaggtcaatggtgtactccatgggtatcagtggtggttgttcagggcccaagagttctttagttggcagatgataaatgcttccaggactgggttcttccctcaaggcagtgggatccttttcggcccagggtgtgtctagaaatgttatccaggagctggggcctggaattgaggcctcacgactctgcccattaccttattctactgtgagtgacctggtgtccaagatgcaagacagagtcctctttactctttgctgtcctctccttaagcagaaagaaggagacactttcatgctgggagcttcactgcctggagttgggggagtggtgacgcaagcactcccttaaccatgctagctggtgacttcgtcctttgttatatgtgagagtgactctttgttttctcaggatcccaaagtgctcattcaaagccatctctgtctgttttccaacactgtttatgtcaaattgtaggagaacacccgttggaactttctttacattctcttgctgccgtgttttaaagaatgaaggtacagcagtatgaattaatcatggtttctcagttgctgggcacctgccaccctatttcactagctctaagccaaggctagtgctaggagttgcctaggaattgcagtctttgcattctagatgcctttcaagtttacctaggatcccagagcatttcagcccgcagtgttgaggcttgctgagcaactcaagttccatctgctgcgatggatgtttccctgctggctagggctggtccaaatgctccctctgtgtgtgggagctagctgaacctaggatggctctatcctccgctgtgacagggcagcagtgaattcaatgtgaagtcccccagttgctgtgttccttatccccaaagtgtacaaattgcctttctgcaccacacggtggctgctgagggatgtgggtggggtggtatcagcaactcatgactgtctctccatccttcctcaatgcctcttttggtaatacaaagttaaaaccatgcgctgtgattgctcacctgatgtttggttcttatgacagtgtttttctttgtgcagatggttgttaaaatttggtgttccagggagtgtgggggtgtgattggtgtaggcttctattctgccatcttactctgccctctgaactttaatttataccataccagaaatcagagtgaaggtaaacaacaaggttacaatgtaactctattataaattttgatttttttttggtgacaaataccagtatatttttgtctttggatctataaattatttaatttagcaaactctaaagcttataaaatttaacttctcaagaagtctagcactttatggctattaattttactatcaaaatatccaggttactgaattcattttaataattataattcttctaaacatcatttgaagaattatttgtggacactagactcaagactacactaaatccaaacagtatacctaggacctgagttttgagtttttcatctcagttatctgtccttcaagttactacttcctcttatgctttcttttactaaccaaattttcagatttttacattggaccttctcctccaaggccctatgggacaactttgtaaatatgcatttacagcctttaaacaccaacattttaaactgagactaattcctgcaaccacatttcttgttaaaagttcagcactaggctgggcacggtggctcatgcctgtaatcccagcactttgggaggctgaggtggacagatcacttgaggtcaggagtttgagacccacctggccaaaatggtgaaacctcatctctactaaaaatataaaaaaaaaattagccgggtttggtggcgggcccctgtagtcccagctacttcggaggctgagacaggagaatcacttgaacccagaaggtgaaggttgcagtgagccgagatggtgccactgcactccagcctgggtgacagagccagactccgtctccaggaaaaaaaaaaaaaaaaaaaaaaaaaaaaagaagtttagcactaacagtatctttctgccattttcttctgctcaaggaactaaagaagtcaaacagataatggttctgcctgagccatttgtgaagtctaagaacagttacgtatactccctgttattctttcagggcattattttatccttttttttaaaccttgaaaaataggtgttacttagccttataaaattttgaagtaaagtttctgaatttctgtgaagaactcttcaagcaattcagcttttcaaacacagtcgtcacacaatagtccctgtaacatgggatttattccacagttaaaaagtgacttcctcctttgttatatgtgagagtggctgtttgttttctcaggatcccaaagtgctcattcaaagccatctctgtctgttttccaacactatttatgtcaaattgtaggggaacacccgttggaactttctttacattctcttgctgccgtgttttaaagaatgaaggtatagcagtatgaattaatcatggtttctcagttgctgggcattgtactgctccagggttatcaatagatacagtcagattcctgcgtttgtgatagatgtctggcattgactagttctctttgctactacatctagcagttgttccgtgttcaactgggcctgaaccttcttcaggcctcttccgaaaagaaaagttacctgtgaagtgtctttctgatggcttaatttatttcctctcctggtaaaactggacataatgttattttttctgtttagctggttaggtctcttgagaactgcaactggtttcctatgcacttcattttgtttcagaaggcttgcctttctttttaacactggaaaatagtgttctgtattcttgtcacttagacgtggacaatacatacataggactaattccttttccaattccagatgattttctaactgcaagtccagtgattatccataaggatgtctctttccaggcattactcttcctctgcagcttagactggttttaccaaaaccagaattctgttggagtacccattgtattctcatcctaaattgctggagtcttctgtttagttttggaaaattctgcttttttcctttctttcaattcagtttgatgacaccagccaaagacataccaattttgtcaaggtgtttgttgctgcgagctttcagcagctgtgacaaggtcactgtggcttctaccaactgggtaccaaactggttcatggctggaaatgtggtgctagaacagtcagtgcggaaggccagagttggaggcctgccatctctcatgcacacacgcaagcagactgccgggcagcatccttgtcctcccacccgtggttgccagcatagaccaatttatcccattcctttaaattacttgatagtgttctctggaatactcttgaatataccataatttagttagtaaaacatattgatggattgctgatagttcagtttcttactattacaagcagtgatacactaagaatcctgttacaaatatgtctttcgagtatgtgtttctggagaataaatttgatcaaatgatatattaacttagcatcttaataaattcaaaaagattgttcttatttaaacatcagccttcttacctgtttccttatgcttttaggaaaactaggtattatcaatttttatactctctgtcaatgtaattggtagatacgtttcattgttttaatttgcatttaaaagattcatgaaatggggttttctataacatttttattttagtcatgttttacatattgtgacctgtactgtgtcgatatccttagctcagttttctattggatttttctttattctattgattagtaagattgtggtatattagtgaaaatagccatttgtcaaatgttggaaatttttttgcttttaaaaaatatacatactctataccgtcatagattttttaaaattataggtagtcagatttttaaatctttttaatggtaacttgattttgttcttatgcttaggaattcctttccctacaagagtattatgaatttgaaagattttctgtcatcagtattattgtctaatttttattataatcaagatttataatatctaggaatgtttatttccttttctcttttttgttttcattgtgttcctagattttggtctctaatttggcatgtacaacataatcaaatagcctgaaaccttggcacattattagttactgtggatcagaatagagtattagatgggatgatcttggatcctgcttaattgaataccaatttataagtacctatacttggtaccaatttataagtgggccaactatcagtccttgtttgcgtgacatagtctaagtttaacctgtcttccagaataatttttttttttgagatgaggtctcactctgtcactcaggctggagtgcagtggcacaatcttggctcactgcaactgtggcctcccaggctcaagtgatcctcccatctcagcctcctgagtagctgggactataggagtacgccaccatgcccagctaattttttgtaattttgatagaaacagggttttaccatgttgcccaggctggtctcaaacccctgagctcaggccctccttggcctcccaaagtgctgggattacaggcctgagccactgcacttgaccaagaataatttttaatagtcctctttcactataaaaagtgcctcagtttaaataaaaaattataaatgttatagaagatagttgtttacatgggatagttcctcagggtattgtaacactaaagctttagttgtttctatttatatcattcagttgtttctatttacattacttctatagtagtaatatttcatttgctttaacttttaaaatatctgttattttcatgatgaacttattacaagcttcatacagttgcttatgtgaggtatttctagaacagtcatgctagtgtgtactctctttgccttcattttaattaacagaatgatgttcactttttgcattaaatgtcccttataattcttatttacctagtattgctttaaagatgatgaaacatttgtctctgtatgtggacatattttggttatattttactaaatgtgtcatcaaatcttttttgtatggctgtgacctaatgttttaacctggccaaataaaccattacttattacattaatgttttctgatgttgcatatacttggatcattggattttgtggtatgctaagtaatactactgttcttaacacagatccccgtgggagccactaaatgccaatccctcttatactgtcacagtgttgataaaactttggtacttgttatctgccagatagattttcagctatcttattttattccgatagtacttctccagccttttcttatgtagtactgtgtcaaagactattttataataggtacattgtgtctattgttctttctttcctttctctactacctctgctactgcttaaaaggtttatagagtttagtattggtcgttttcaccaccgattataaactgtaaatcaacccatattgtttcttaaactattattttacattttgaggtgtttgtaaaattgccatataaaaaggccagtttcaattttcctttagttaaaaataccttttttttttttttttttttttttacaaatacatcttaagaaacctaactttttttttttttttttacatttccggttgtttgtgtgtttatatcataatatgtatgtttctcagtgttatatttaggtatatatgtttggcccttaatttttatgtttgttggtcccattaataaaatttgagaatatctggtgagtagaacaccatatgggaatttccagttgtgctaccattagcctttaaacattagtctttggatacagctatttatttatattttcaatttcatgttatgtaaactgtatatgagattttcataaaagtttgttcttttaaaatatctaggcactgaagataaattaatgaaattcttactgttatttttgcaatgcatgtaataatatgaagagaagctggttttattagacatggagtcatgtttattgtatgatatataaagtatctactgtaatatataaaataatgtttgttggtttttgcgtttcttctgcagagagtgataatgaactctcaagtggaacaggtgatgtgtctaaggattgtcctgagaagatcctgtattcttggggagagttgctaggaaaatggtaaaattttatttttcatactgaaaattctatatttacatagttgatgttaatttgttgtattaaaatctgtgtgttaaaataggttttaaaggattaatattaaaatctatcttaatatcttaatattgtttaaaaacttaaaaattaaaatataatttatagatactctttatgtttggctaggtcttccccccaagtatggttttatttaacttgcttttagaagatgtctttgtcttattatttcactcagaccgtattatttgtcttattatttcacatcatttagcacagtcaattttatgctatattgccaatgcatttaaatgtctactgttaaagggttatgtttttttaaaaccaagtctattaccactaaaatgggctgtatagtttagaatttctcattttacgctgattgttaactgacacagcttgtttcattctttctgactaaaagtattactttaaattttggcgtattttatgtggaattacaaaaaaagtactctgtttatatttattatattaagtactttttatatttatgatacattttttaaaatggtaattatgactatcatatgttggtgtaatgaaaaaatcctgccaacaaaatacttccccatattagtatagacatagaaattcaatttattgttgaatatgcactcagattacatgcatgcgggtagtccaggggagactacaaagtctgggcggaatttcacagttcagtagaagaaagaataatttaaacctcttttatcctttcaagagaaaagtggatgctccttatgatagtctgtatgcatcttgagagtttccttagttgtaatttaggaaatatgtatttacagttccaacggttggaatactgatgatttttcattgtaaaatctggagattaggtttatcaaatttggaccaaagtattgggcctgttattgtttttaaggagataaaccctgaatggccagctgcttctcctttttaagcaaagaaaatttcattttatgtatccttacacatatcacataaaatgaacacatttcagagaacttatttaactcattaatgaatgtcaacataaaataatcaaaagggtcagaatctaatttaaaggtaatttattcaatagcaaaatatgagcatggaccacccagaaacaccacctctaaaggaatgcagtcagtggtccaaagtagggaagttaagatttcatttatataggcagaggcacaggagtttttagcaggattatgacattattcatacagggctggtgcatagttacagcagtttggttggttataggcagtgcttttttcggcggggggatgttaaaaattttttttaactttttttatagagggtacaataatcgtaggttttctgttatctggtctaagtgaagcagaatgacaaaagggatgttaacctataacaagggtcattaatgaagaaggcaggaggttttggtccttgacatcatttaattctctctagttatcgtacaaaacaagaaaaatgtgatttaatgtataatccaagaacagaagttgtaaccatatgtgactcagataacagtcacgtctctctcaagacttaaagtgttgttgtttttttttattccaacagcttttaggttttattttcacatggagcaccaataaggtattagagccaatcaaaataaggatttgatttagagatttattttctttacctggcaattcatttgcactaccatgaatgggagtcatttgcatagctatggacagtaaactttgcattgccattatgttatatatgttgagagttgtaaactagcctagtcaaagacaaaggcacacacttctatgttgtcacccaattcccagatgttccagccattctattgaaatgatgttcagttatcattttgtccatttcaaaaatcttacacaattttaccccacattatatccagaatctaacttactcatttgcaagcattgtccacctaaatgtacctcatatgtttttatctgttttatttagggttactctcttcctttaagatgaacagttctctttttagatggtcctgagttaggacagtttcaatgtgggatggagagcggcaggaagtgagatgggagagtgtgttctagttagaggcagatgactttttcagtctcagaccaggctgggaaacaggaagcatgctaaactttttaaacagaagcattttaatgcagataattggcttacaatgtgttagaaggttgagagagcagaaaggagatattatgattggagtaacccaagtagtaggaaacagctatggcctatgggactggagaaataaaatgaaagaagtattgttaccagagtctaggaactcagaggaggtctgaggagctgatgcagggatctctgaagagggctgcatcctggttgcttagaattatgaggatcctcatagcagctagtgtttagaaagaactgtcagggcaggggacaactgtttagttccacacttctgaagagatacccagatcttggagcaggtggggaggaccacatcattggtgctggtacttgttagcctggctagtattagtatttttcaggagttaacgatatagctggtgctggcaatggaattccttcttccattcttctgccttccaactgtacatcactattactcatgggcagaacctaacctgaaagccagtgggcaagggagtttgggatatgtagtctgcagattctcagcccttacatctttgagcagaatacagaagggtggacttgtagctgataggcagtgggtaaatgactacaaaagggtaaaagctgggcctaattctcatttacccatttatctggtccaattgaattaggctttcctgatacccaatgtttttagatagagatttatttattaggagcactgataagaaaaaaaacagcaccaacaacttgtcctaatcttcttcatctttggtctgaaagtgtacttttatggtccaaccatgtggatgtgattgatagtattggatgtaatggtagcgtatgcattgataccacagcttggctgctactgttacgtggtttcttcctttcccacttcaagttatttgctgggggaaggcttaggaatttacatggacctccatgcatcatagaaataagcaacgtgtctcctgcggcagctctactctctggacagagtttatttgtccctgattctctggtgaagaacaggggcatagtcttccgttgtggccacttcataaaacaaggactcccttcttactggctctcacattactgagaattgggtgcttactttttacgggcccaacacattctttctagtatagcaaaatacacaacacctaaaactaataccttatactccaattgaaattaatcagcaaaacagctcctagatatcaatatataggtattgtagaaactaattttctttggataaggtgtttcttcttgtccgtaatttactcccaaaggcaaaataatttcaacttgataagatctatcggaggggaatataatttaatgggaaaaatacattacgcttaaactcagaactgaattagacttccagttgtagtgctaacttgataggtagcttgcacaagttatttaacatttttaggttccatttttccagtgaagcttttataaacctgctcatgtatgcatgctttgtctttcagaagtggaataatgtttgcaaagtttttttgtgtgttttgtttttctttttcctagcccttagattgagaaaataccttaatttttattgtctttttatggtttgggattatatcaccattcttgaggaatttacaataacagtctgggctgtttcatttaagagaatatgtacaaacatctcactttcttgattcttagatgaaatttagttaaaagtcgacatgcttattgggagatatggcaaggtgagaatgtttgggaaaggaagtagagacagacattggatttttgtcagtcaagtttcttttgattttaaattatttattcattacattttctacatggcagttaatattctaaaactataaacaaaatttaatatagaaaaaatattatgcttttcttttttgcctttgcatgctcttatttcaaaatagatttaaaattcatggcatattatactagaaaacaagtctgtcaatgatctaagcttctatctttagatactaggaaaaaagagaaaaacccaaagcaagcagaagcaaggaaataagaacagaaataaatggaattgagaagaacacttcagaaaatcagtcaaactgaagctgatttttataaagattaatatgtttgataaagataaccatctaactagactgaccaagaaaaacaagggagagagagaacacagatacaagaatcaaagaggctacatcattacaaatcactacagacattacaaggatataaaataatattataagcaactcactgtctataaatttagaagcttaggtgaaatcgacaaacacttgaaagtcataaattgccaaagcttacttgaaataaataacctgaatactcctgtattagttgacaaaattgaattcatagtttaaaagttttcaatagagaaaatttgaggccaaaatggcaaattctaccaaatatttaagaaaaaaataataagactgggcacagtggctcatgcctgtaatcccagcacttcaggaggctgaggcgagccgatcacttgaggtaatgagtttgagaccagcctagccaacataatgaaaccctatctctactaaaaatatcaaaaaaattagccaggcatggtggtgtgcacctgtaatctcagctacccgggaggctgaggcacaagaattgcctgagcctaggaggcagaggttgcagtgagctcagattgtaccactgcactccagccagtgacagagcaagactctgtcagaaaataaagtagagtaaagtaaagtaaagaaaaggaaagaaggaaggagagaaagacagagagagatagagaaagagagaaggaaggagagagagaaagaaaaagaaagaaggaaagaaagtgaaggaaagaaaggaagaaagaaagagaaggaaggaaggaaaggaaagaaggaaggaaggaagggaaagaaggaaggaaggaaaaaatatataaattctacataaactttccagaatatataagtgaaggcaatactttccagctaatttatgtcatttgcttaccatgatatcaaaaccggatgaaaatattacagaaaagaaaattgcagacgagtgtccctcatggatatagactaaaaaagcctcaacaagtcctagcatatcaaatccaacaatatataaatttgaaaggataatgttgcatgactacgtgggacgtattttgggaatgcaaggctgctttgacatttgaaaataaatcagtgttattcacttatatcaataggctaaagaagaaaaaccatataatcatttcaatagatgcagaaaaagcatttgacccaattcagcattcattcttgatttaaaaaaaccaaaaaacaaaaaaacctctgagcaagctaggaatacaagggacctttcttaacctgataaaaggtacctatgaaaaacctgcagctaacatctaacttaagaatgacagatcccaaaactgggaataaggtagggatatctactctcatgactcttactcaacttagtactagaggtcttagcaagtgtaacaggcaagaaaaagaaataaaaggcaaacaagattggaaagaaaaatataacactgtctctatttgcagagatgtgattgtctgtgtagaaaaccccaaggaatctacaaaacaaacaaacaaaactcctagatctaataaatgagttttacaatgttaaaagatacaagatcaatatgtgcacatcagtttcatttctatacactggcagtgaaaaattggaaatagaaattttgaaacaaaaaagcaccataaaggaaaaccatgaaatatatagaaatcgaacaaattgtgagctaaatatatactttgacatactagaaaacagtaatcaaagacatcaaagaagacagaaataaatgaagatatatgctatgttcatggaatgaaaaaatctcaatattattaagatttcagtcattcccaaactaatcttaaaattagtgcatttccaataaaaatctcagcagattttttggtagcaaccaacaagctgattttaaaatttatataggaagcagagtaactagaatagccaaaacaattttgaaagtgaagaacacaatggaaaggcatattacctgatttctaggtttactgtagcactacagtagtcaaaagagtattgatacaaggatagacactgagattagtggcatagaaaagagagttcagaaatagagccacgcaatctaaacagacattttctaaagaagacatacaaatggccaagtagcacataaaaagatgctcaatatcattaaccatcagggaaatgccaatcaaagctacagtgagataccacttcatacccactacgatgtcaatcattacaaagacagataataacaagtgttggcaagaatgtggagacattgaaagcgtagcatagcaactgcaactcttttttttttttttaagattttattattattattttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccacaacagtccccagagtgtgatattccccttcctgtgtccatgtgatctcattgttcaattctcacctatgagtgagaatatgcggtgtttggttttttgttcttgcgatagtttactgagaatgatgatttccaatttcatccatgtccctacaaaggacatgaactcatcattttttacggctgcatagtattccatggtgtatatgtgccacattttcttaatccagtctatcattgttggacatttgggttggttccaagtctttgctattgtgaataatgccgcaataaacatacgtgtgtatgtgtctttatagcagcatgatttatagtcctttgggtatataccgagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctgactggtgtgagatggtatctcattgtggttttgatttgcatttctctgatggccagtgatgatgagcattttttcatgtgttttttggctgcataaatgtcttctcttgagaagtgtctgttcatgtccttcgcccactttttgatgggattgtttgtttttttcttgtaaatttgtttgagttcattgtagattctggatatcagtcctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagcgagttttcccagcaccatttattaaatagggaaccctttccccattgcttgtttttctcaggtttgtcaaagatcagatagttgtagatatgcggcgttatttctgagggctctgttctgttccattgatctatatctctgttttggtaccagtaccatgctgttttgggtactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtcattggtagcttgatggggatggcattgaatctgtaaattaccttgggcagtatggccattttcacgatattgattcttcctacccatgagcatggcatgttcttccatttgtatgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactaagttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggttgaagcccacttgatcatggtggataagctttttgatgtgctgctggattcgttttgccagtattttattgaggatttttgcatcaatgttcatcaagtatattggtctaaaattctcttttttggttgtgtctctgcctggctttggtatcagaatgatgctggccttataaaatgagttagggaggattccctctttttctattgattggaatagtttcagaaggaatggtaccggttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatatatccatttcttctagattttctagtttatttgcgtagaggtgtttgtagtattctctgatggtagtttgtatttctgtgggatctgtgatgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctctcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactctgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctctttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtgtaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattgtccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagcttgtcaaagtcattctccatccagctttgttccgttgctggtgaggaactgcgttcctttggaggaggagagacactctgcgttttagagtttccagtttttctgttctgttttttccccatctttgtggttttatgtacttttggtctttgatgatggtgatgtacagatgggttttcggtgtggatgtcctttctgtttgttagttttccttctaacagacaggaccctcagctgcaggtctgttggaataccctgcgatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcctggctgctttgtttacctaagcaagcctgggcaatggcgggcgcccctcccccagcctcactgccgccttgcagtttgatctcagactgctgtgctagcaatcagcgagattccgttggcgtaggaccctctgagccaggtgtgggatataatctcgtggtgcgccgttttttaagccggtctggaaagggcaatattcgggtgggagtgacccgattttccaggtgcgtccgtcaccgctttctttgactgggaaagggaactccctgaccccttgcgcttcccaagtgaggcaatgcctcgccctgcttcggctcgcgcacggtgcgcgcacccactggcctgcacccactgtctggcactccctagtgagatgaacccggtacctcagatggaaatgcagaaatcacccgtcttctgcgtcgctcatgctgggagctgtagaccggagctgttcctattcggccatcttggctcctcctcgcaactgcaactctcatatgttgctggtggaaatacaaaatggtgtagccattttggaaaatagcatggtattttataaaattgaagacccttcttataccaccccagcaattccagtcccactgctgtgtgtttaccaaagtgaaattaaaacctgtatgtgaatgtttatgatagccttgctcataatcaccccaaactgcaaacaacccaaatgtccgtcaaaagtaaatggatcaaccaactgtggtatattcattgtatggaatgctactgagcaattaaaagaatgaactgatatacattacaactgatggatctcaagtgcatcatgttaagtgacctatgccaaagtcaagtgacttaatactatgttattccatttgtatgaaattctggaaaagtcaaaactatcatcataggaagcatgtcagtagttgttaaggactggtggtattgactacaagagggtccagggaatttgggtatggggggaatgagggaactatcctgtatcttggttatggtagtgctcacaaacctatgtgcatttgtcaaatctcacagaattgtatactaaaaatgtgaattttactctgtataaattgtgccttaaataaatgacaaaaaagaaaaaaaagccctgagttttaactgcagtaggtgctgaagcaagaatagtgtcactaaaccaaaaaaaaggaaaaaaaggaaaaaaaaaaagaaatttatgtcttatacatagatggctatttgaagtgtgttcttttctcttgtcagaacagtgccttcattataccttgcatatccatttttctctctttattttgtaatatttattataggtaactctgtcttaactaacttctctcttcttatcctgcaaagttatgtcaagtgcacatgacctccttaaagtcactgttgttttagagacatctcctgcagtttctagagtatagtaggtgctcaattcatatttattgactgaattttttgatgaaatatctcttaccactacagatttctgtccaattttatgaacattttatatatctatatttggtaattaattatcttgtcttatatagtgttttaagaaatctaagttgtaatattctctattaggttatacatagatttatttatcttatatctggcttcatcttgaaccctgggaatgttacttgactaatttgtgtcttgatcatgtcatggtgagatattttgatttagccattttaaaaacatcattctgactgcccagtgaaaaatggattataagggaacaaaggtggaagcaggcagattaggagaatgctattgtaaataatccaggggagagataattacatgttgcactaggctggtagcagagggtgacatgtgatcggattctggatatattttaagagagtactgactgtatttgcttctcttttctgtgtggcctgagaaaaataaataactggccactgatgtcagagtttttggcttgagctactagaagacttgctgtttactcaaatatagaagagagatttggaggataaaatcaagattttggagatgttgagatgcatttaagacatccaagtgactatgtccattaatcaatttcatgtaacattgagttcaaggaaaagatagggaaggaaatatgagtttgggagtcatcagtatatagatggtttttaaagctgttagaatgaaatgggcgagattacttacggagtgagtttagatgaagacatcatccgaagacatcatccaaagactgcaccctcgaccactccagtgtttgggagttggacgtatgaggaggatcaggcaaaggagcccaagaaagtacaaccagtgaggtgggaggagaatcaagatagaaatccagtaaactaagtctatcaagaatgacacagtagtcaagtgctgataggtgaagtctgatgaagcctagaattccactggattcaacaatttaggtgtcactggtgatcttaagaacagtttcaatggagaggcaggaatgaaagcccagctggattggaaatcagcagatatagatagctcttaaaaatagttttgctataaaaggatgataggaaacgaggacacattagtaagtggatgtgggttgagagttttttattaaaatgggcaatatagcatgtttgtatgttgttagaaaggatgtaacagaaaatttgatagtgtcagagaaagaggacataattgtaggataatttgatgaataggcaagaaaagatgtatatgttgactagtggaggggttgaatttgggagcagagatagctcattgtaacggaaggaaaggtgaggcatggctacagaggtaataactgacagttcagtgtacttactatgtgccaggttctgttctaagcactctccatgtgttaatttaattgttgcagcagctctctgaggtaggtattattatatcttcattttagaggtgagagaactgaggcatagctatattaggtagctagtgtaaaaatacagaaaacaaaatggcagcaactaagtaacttgctcaagatctcacagccaataagtaatttgcccatgatcatatcaagtaaatgacagagccagtttctgaatctaaaccactctggttttagagccagaacagggtgtgtgtgtgtgtgtgtttgtgtgtgtttgtgttttcttttttttttttgagatggagtttcactcttgttgcccaggctggagtgcaatggggcgatctcggctcactgcaacctccacctcctgggttcaagtgattctcctgcctcagcctcctgggtagctgggattacaggtatgggccaccacgcctggctaattttttgtatctttagtagagacggagtttcaccatgttggccgggctggtcttgaactcctgacctcatgatctgcctgccttggcctcccaaagtgctgggattacaggtgtgagccaccgcaccggcctagattagtttttataagagcatgtagaagttctagtgagtaagtgaataaactaggaaaatcgataaccctggcccaggcagtacttgaagcttctagtcatgattttaaagagagattatgagaatggcagtatggtgggtaagaaaacaaaatattttgatgactaaataaacagtcaaatagagatctccactcagtttctaaaatgcaagatttattacttgcttcaatataaatttatgaggcatcatcttagactcttagagttacatagaaaacaacatagtttctacctttgaggtttataatcaatgtaggtgggaatgcatactcataagagattatttaacaaagtaactgaaacactgaggctgtttcacatttcttgaccactttttttcctgtaaaacaagtcacttcattcattcattcattcaacttttaagtcttaatcatctattctttcttggggactttaacagacactgctgatttaaagatgagtaaggatagtttctaccctcaaggtttaccatgttatagaggcatgcagacctttaaacagaaaattgtgatattatcaataaatccttctgtaagcattgtagacctaatggaaatttttgaatgtacacagaaataaaataatacaatgaagtctcatgtgcccactgcccaacttcaataaagacaatatctaacaaatttctttaagctgagactcccattgggtttttcttttttttttttggaaggtaatattggagtaggaagaacattgattaacagagaaacaaattgggaagtaattgcatgggttgatgatatttataccagactcactgaccctatgtacagagatgaggctccaaatgggaaaagacttctgaggtagaaatgacagggttgctcagctgaaattcagtgtacatttttttcagaaataaaatatttctaataatatttttattaatggactttaggaaattatttaaagatctgagggaactgttttaaaaaactaacataattgattcttagacctttagaaaacttgttggattttttacaattcaaattttttttatttgggccattattataattatgtcatgatatgaaaagggtaacatttgtgtaaactacagaagtataaactactatgtcttttatacgaggattgtcaaatatttttaattgtgctcaaatttctttttgaaacattcgatttagaaatttcctaagtgtcgggaaaaataggtaggcatttacatatagacatttttgtgatttatgtaggtaaagcacctgtcatgtggagtcctacactttgtgctttggggaaatattttttaaagtgaggatacagtatatatgctcagtgaaattttaaacgtgtttgaaaagattttgaacttactcttaaatagctagatcattcttttaaaaaagcaaaacatgaataaagtcagaattcttataattaaatacactatcagaaagatgtaaaggaaaaatatttcaatactaatttgaaatcattagaaaaaataaaaataatatagaaaactaagaacagactgtataaaaagttcagtactggaggtctttataacagattggagatacaggtgtattgaaataactacatgaaaaaagcacataagctaaagaaagaaaggttgagagagagagagagaaaacatttgggataggagaacttgtaaaaacaaaactaaacgtggtagcaagatttcttttatatgttgaatatattcagaatggtaatgctgatgatttaactattatttaaataatttaaaggattaggcagaataatatctggataactgcttcaggttttgagatgcatggaaaacttaaaaaagtttaaagacaaaaataaaggtagtgcttactgtgaatacttagtaagtcaacttttagcaggaagaatatgcaggaagattttctaaccaaaaagactaagtgaacattggaggaaaataattgggtattggattattacatcaagtaaagtcaccttcaaatcggtcattcttttttattgagtaagagaaaattggtacatagccacctacttccacctcctatcaaaatttctgtaattccattggtgacttttcagtggtcacattcaatgacttttatccccctcatctcttgctttttctgctgtttttattgaataagagaaaattgatacatatttagtaggcattttaattgtattttcatggctattcattacttatcagcagagtgggaaaatgtattctgaattaatatgcttttcatcttcataatgacctttaatctatcctttttcttgaaacatttcttaatgtaggtcgtataacttctccgtatctagttcttctcattattgcgggatggagaaatctccgacctttcttgatgccacctcatcttttaatttcagttatagtcttttcctttctagagagaactttttcaaataggtcatgctgctggtgtcatattctcatatctcatagccacctacttccacctcctatcaaaatttctctaattccattggtgacttttcagtggtcacattcaatgacttttatccccctcatctcttgctttttctgctgtttttgttagaaataactctttccctttgaaattttatctcccaatagacatctttaaaagtagagttcttatatgcctaagtagtttcaagaaaatcctctttgaaagcaaaggaaatccactagatgagtccatgacatttttttgatcctattaaattcagtgagaatgtttgcttctaaaaaagcattcttttttgtttagctttagtaattgacatattaatttcatttcataattatattcattcacttaccaaaaatgtattaaatgccttttatatgtggggcactgtttctaggtgcttaagatatataagtaaagaagacaaagattcttgccattgtggagtttctattcatgcattaaaacctagccaattactgtatgattaatagatatttgatttatgtatgactttaaaaataattgtattaggtatccgtcttgtttctagggtagagttcagcatgtatcataactagttgcctattttcaagttcctgataactgcagttaatgtatcaaagcaatggcaatgtgtaattacattttaatcagaaatattgaaagcaatgattatttttataaatttctcttttatttatttggatcttctctgatcatagatatatactagcagcatctagcttaatatttattagtacttctcaagtgatagggtgctgtatgcagtataattgctgtactgttacttgggataaccagtaaaataaggctgttaatcaagcagtgttatgagtgacccagttctttttaaatgcctgtctctaaagataaatagtgctttgatttttaagagaggagaaaagacattttcattatgcctggccaaacaagtggctgagggtcagctagaaactgaatgtcaattgagttagattatattatggtaaagtattcattggggactgttgactattaatcttaaggagtatgtttatgtacgtgtgtatgcatgtgtaggaagagatattcaaactttaaaatatagttaaatcattatgttattatatatcattatataaaatattacagttaaatcattatgcaaaataatctgggccaaccgagtatttaatcaagctgcttgttactttcattctgcctacaatgttggaaatatgttatagtaggtccagtgaatgttaggaggctattgcagaagtctggggaggataaagttggttgcagttgagatggaagtgcatgaactttgtagaggttgagaaaataagatgtattagacttggtggtggattagtaatagatgatggggcaaaaataattcctaggtttccagtttggatggagtgtggtaacaatttctgaggtggaataccctggaaaacgaccaggttagggagaagaaactgagttcagacttgggcatactgactttgaggtgcctttgagcttctagaacttgggatacatgtttataggtgataatgcctagagacaagagaatgaaagaaaagggcaagagtaaagagagataacttcaagcccttaagaggttaatagaggagaagcaatcaacaatggagtttgtgaaggtggataaagaagtagtgctttgtcactgaagccaagggaaacagattggtccacagtgaaaggagtgaaaatatgtcttgaatccagtggggcatggagagaagtcatagatcatttaagtgaaaacttttcaaggagagatgcagaagccatgttgaactgaattgaggtaggagttggaggggaagaaatagagatagtgcttccataccaactcttgaaatttgttgcacagggtaagagtgtgatggagaattgcgcatggcattgaagaaaggatttttttcaatgttcttaatttttaaattttgagacagagtttcactctgatgccctgcctggtgtgaccttagctcatttggtctcaacctctgaggctcaggtgattctcccacctcagcctcccaagtagctggaactacaggcacatgccaccatggccggctaagttttttgtattttgttttttttctagagatgaggttttgccatgttgcccagtctggaactggtctggaactggtctgaacgcctgggctcaaacgatccgcctgctttggcctcccaaagtgctgggattatggatatgagccactgtgcccagccaagaaaggattctttcacatgcagttttaattaatttaatttattggagttttaatagctgtagagacacagtgatgacttgctgatctctatataacatgtaacatatactatatttaactactttggatttcccttacatgatattataaattattggactcataatttagaatattttgcatttaatttgagaggaaatgacctttgctctttgtacatcattgcttttaattaacccagttttctatactaatacccttaacccatatgtttttcctattcaacagtataatcacagccaaacattaaattacaaaaagatccttttatgactaatcctggctctcttgtggcataatattccttgtcaaatagtttattcaggtggaagtcttctgaagaataattaatactcttcctctacttgacatattttgtgaagcataattatctatgatgtttttccaaattaactaaaattatgttttaatttaaagccacgagagaagtttaaagaattgaaatgacttcttgtgttttatgattataaaagaatttaaaatcattataaatatttcagacagcataggaaaataaaagggctactttcccttttaattctattacacagatattttggagtatgttcttccatattatttttctatgcatgtctaaaagcaggtttcaaaatagcggttatggaggtgtatttaaactaacacctatttactaatttgaaacttgcttttgtcacttggcagcataactgttattttaaggtatggtagcacgttaagtcatataaactctgcctttctctagtttatttttgcttcaagcccatcagtattatcagcttagtttctctaacccaacaatacaaaagcttagctagaaaaggctaaaagaaaccattaaatctgatggtttactaaaattattaatgggatgagtttacttgaacttgtttcagttgtggaagttttagtttttttctgagatagcccaaatatgacagtatggggaaagcaaggaatatattttcagaggaaggtatgccaatactggggtttgagctagaggtagaagagtgtgtataatctagtgaagcaggtgggaggccacttttagaaaatagacatgtggattctatgactttcgaggctcaaaacttgaaaccagagcctggggtgttagatcaaaccagagtacattgtcaaggtttggagtcccagtggttgcaccagagtcagctctaatagataaaaaatgagcaacaaatacaagtaaagtctgagcaaaaaggcatagaatatagttccagattcaagctaggcaccaggaaaaagatgacaaatgaaattgcattcacaatattgagatatgcaattcagtttcttggtcagatgggcatagtagcatatttactatgttgtgatcattgattttaggaggagagatctttgcctttgttctgacgctgcacacctttgggatgtggtaaagcctgataagtatgtgttgcttccccagcaagttggagttgttgtgtaggttctggtgattgtaggaaagggttaggtccttcctttaatgagcacttgctgttgtaacaagtcagggagacaaattcagacatgtaaacaataatgaactcttcttactagaaaacctatcttaggttgttttaacttggaggttcattgatatctaagtttatgcttgaacaaagaattccaagttaggtcatcaagagatagggcttcctggaggacctgggagtcaggatgtggccgccaggtaaaacttgactataatatgtatgccttatgcctcctatactgtggagtctgtctttggcacttggcccagctcagcttggcctcagagaagtgggtatagtcaaggtgtgataggcctatgatccgttttcaacatcatttcctgaaccctatttcctaccacacatcattgtccagcttgctgtacattcatttcagggaatccagatggttctttttatgccttgaaatgttgcctagcaatatataactaacacgttaattattatgagtaagtccataggatgatttttaaaagtaagtgagaagaagaacaagcttttcctggaggtagaattacctggttcaccaataagaagatgagatcaataaaaaaattgaagatataactgagcttaagcagtactattgtttaatgcccccccacaaactgttttctcttgacccaagcttacacttttatataaactagtatacttttcatggcaacagcagttcaggagttgtaaaggaagtgtgaatggattattttcttgtcttctcaggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggtaggaagaagttcttttcatattattttcattggatgacctattaaataaatcctagttttcatagctcccataagtcataaatgctttgaacttcttcatgaatatattgaggtcgtgaagtcagtacttctaccttttgttctgaacacttgtagtggtaaacaatgcacttagtcatctatgaacattgtatgccttggtttttatcttttcattcaagtgattttataatagctatttaccaaattggaatatatttatatttcaagtgttttctaacttttcaattaaccttttttaattgtatgagatttatatagttataatcatacatagttactcttgtataattttacaataacattaaaatgaaattaaaaattcttctgtgcttatgtcaccttacatttaaataatgtagatacttgccctttttctgtcaggggcccttggttccactgtaaattcctttgcttatgtctaaatacctggttttagagcataagtaaaggtaggtgttggccttgaccctggactcaccaccctaggtcttaccacctaattacttaatctactctaagtactgtattttaaaataatagtaaaattttattttttaatttaaaggaacctctcctcataaatgagatttttataatcaagactttgttcctcagactatatgaacttttagaactttttatctgctgtaatttctttttacttttctttcctctttgcctccttcccttccataaatattttctgagtgcctagtataattatcactgctgaattcagttttttttttttaatttaactttttttttttaaattgatggcctctgcattggaatatgcaagatgatccattggtgtgtgggaaaaaatgtccaaagttccatttgtatttcttttaaataagtacaccaaaggatactaagctgtactaatatttggtgtgccatagtactgaggctttatgaggtccttgggtccagtggccactggtcccacatggttcaggagtgaccttagggaagaatggaacttacacactttggaggaataattgtggggctcacactcgtatattaacttccaaaatattataggtttcttgcagtttgcatgtgttagattaagtggatttacaggttatctagatgtaacttaatcctcataaaatgtgtgattggcttaaaaagattactatcacaggatgctgcatgtcaagttttttttttaatttaatatgttccttcagggaagaattaatattatgataatgacaaagcaactacttttggaaacaaactcatgtaacaaagatggacattttgaaacatatggcggtttaaacacctctgtgatttttttcattgaaataacatgcatcactataaaaaactcttacatcttcacacttaaaaacctggaatcagaaactttaaatatgtttaaaacttatacaagtagttgcagagaatttggaactgattgttaaaagcatataaacacaacaccttctgatttgttcatatgaatatctagaagctggtgtggtggcatatgcctggagtctcagctattgagaggctgaagtgggaggactgcctgaggccaggaacttgcacctgtgactagccactacactttggcttgggcaacatagcaagaccctgtctctaaaaaaaaaaaaaaaaagaaagaatacctagagaaagtagatatttcctagccaaatttcaacaaaatgattgatgagtgggactgaaaaaatgatgtacgtctacttgggtctgtggatctttgtaagtcttttttagatatgataacaaaaccatgaatcaaaaaactgatgcagaaacaagttttcattgttgttttataaactgctataacaaacatattaaaaatagtgacccatattttatgattatttttatataaaatgtttagaataggcaaacctatagagacagaaagtagactaatagttgccaggggttggaggaaaaaggaattgggggtcactgctaacagatatatggagtttgtttttagatgatggaaatattctggaattagacggtggtgacagttgctcaagattatgaatatactaaaaaccactgaattgtacacttctaaatggtgaattttatgttatgtttaacacaatagaaaaatttcacacacacaaaaaaagatccatattcaatattgaatagtattttatagcatttttaattatcttttttacatcctatctaaatttctgtgctttataatatctataatatattagtataatagcacttgtacatgataaatatatatatgttagatatttatgcctagaagtttttatcgatggagtatctgattgaaattttcagagatcataactctgggtatcaaattactttttcttgtaaataataaactaaattatatacttttattggctgccatggggtaggaggtaactgccataccccttttttcactaagaggctttcataattcatacctttaaaaattttaagggaaaaatgtaaagaataccatcccctgatattatttatgaattcttgataaacagtgtatgttcatatagtgagaaaatttttatcatttataccaaacaccatggtagttttaactatacaacttgcaaaaaatactttaagatcaagagatagggctgggctcagtggttcatgcctgtaattccaacagtttggaaggtggaggtgggaggatggcttgagcccacgatttcaagaccagcctaggctacatagtgagacgctgtctctacaaaaaaaaaaaaaaaaattagctgggcatggttgcacatacctgtagtcccagctgtttgagaggctgagatgggaggattgcttgagcccaggagatcgaggctgcagtgggctgtgattgtgccatcaaacttcagttcagctggggtgacagagtgagacccagtctcaaaccacaaaaaacagaatggcaaaaatcattttcattgaataaaatatatggaagatacttggaggctgataaattacattttttagatttcttccctctggagttctagctgtgatttactttctgccagtgaagattgcggggaggcaaaagccatattttctctggcagtgtggttggcagatacctgggcttcaccagttgtgaggtttttgcatctgcctctgggcatttcattctcaatcacttgccttcactctggggttactgtttcctgtggtttcctatcctgagtggccacagcagccttctgattctctggactgtagctgtggtgacacacctaaagagctggaagggcaaaagactgctacagcaggatgttcagtcttcagtcttttgccctttcagctctttcagtgtttaaggaccttcattcctgcattacatcttttttgaaatagtttacctgattaaaccctgtctgatacacttggcatgtatttttctccttgttttcacaagatggcttttctacacccagcattacatttagaaaagaagaaaagaaaaacaaagtctactcaaggtagccagacttgaggctaagagcccagtcctccagactgccagctttgttcaagacttctgacatcagccacaatttgggggttcttagtgccaccctgacttcagaccaactagcttcaaacttgtagatcctcacagacttcctcaggtttgataatttgcgagaataactcacagaactcagtaaagtgctatacttaaacaattgtagtttagtgtttttgtttgtttgtttttttagtagcaaaaagatacaaatctgaaccagccaaaggaagacatgtatagggcagaatgtgggactaggagaattccaaatttgaagcttccatcattctcacggatatgttaccctcctggtattatcctcaagggctcattacctgcctagcatcaatatgtagcaatatacacttggaatattgccaatcaggaagctcacctagttttggtgtccagagtttttattggagttttattacataggcatgattgattggatcattacctatctggtagaactcaatctctacgctccccttctttcctccccagaggaaaagaaggtagggacacagccaaaccatattgtattggggctgttgcgtggctcaaaaccccagtgctgtaatcacatggtcggtctttgtggcttggccagcctacgtcatgagtcttcttcttagtgtaaactatctgggggcttaccatgaatcatctgattaacataaactatcagatgtggttagaggggcccaccacaaataacaatcctgttattcaggaaatttcaagggttaaaaggttactgtccatgggctggaaaaaaggctagacctctctttggcatttctgaacccagtctatcacccttttaaagactttttcttaagcaccaaacaacaactccatctatatattcttgaccagaattctggctactatcttcatggaaaactagaaatgttttttaaaagatagacacattgatttatccctccacccccgaaaatctaggctttttgtaaacaggaaagagaaaataggtattgagtagaaaactacctttctgttccccaactgcctcttaatagtgacactagttgagatctattatggaatgaattattctaaaaatatatgtaaacttaatttattttagaactgtaaatatttactaattgccacttgagattgattagcaatgtgtaattcagttagtataataaatattttcacattcagcttataaatctatgacaactttaagtttttaatgttatttctattgttaatacagttatcaaaaacattttcatacaaacaatatagaaatgtgtggctctaatcatgtgcgtttattcagggtctcaaatcataagacttctttgacataaagtacagtggtatatttaatttcattgtcttccttgcattatagtaaaatgaataatgtcattttttctaaaaatgattttttcctttcactgtccttggggtagcaatgagatgacaagtgcctgtagccaagagtgtatgtgggtactttggtggtgaatacatctgagcttatagtcactaagtggaaagggcatgaacactcaagagtattttctgtaagaagtgcctgcatatttggcacttgttggtcatggttcagcagctgttcgtcctttcttttggtccagttaatttttcctgtcttattaagggaatggcaagatttcaaggttagttaatgaaatggttcagcttgaacaaacaattgctttataaaaaattgctttataaaaaccctaccagaggcctcagattacacagggaagaaggaatatgaagtattttatatttgtctgttctcacactgctataaggacctacctgagactgggcaatttataaaggaaagaggtttaattgactcacagtttcacagggctgggaggcctcagcaaatttacaatcgtggcggaaagggaagctaacacatccttcttctcatggtggcagaaaggagaagaatgagcaggggaaatgccagatgcttataaaaccatcagatctcgtgggaactcattatcacgagaacactgtggggtaaaccgcccccatgattcggttatctccacctggtccctcccacgacacatgaggattatgggaactacaattcaaatgagatttgggtagggacacagccaaaccatatcatatttcagaaaatttacttaaggtttggcttccatgaaaaagtagtctaccatttaaatctatagtaggaatgtactggtttagaatttgaacccacaaatcacattctgaagcattctttcaggggtggcaaatatacagccagcaggctaggtggagcctacaaatatgctttgtatggctatcaatacatcaaagaatggtatacacttagggattaaatttatactttcttttgccatgggcgtattactctattacttactctctatcttttataccttttaatgcctgtttggtcctcaaatatattcgattttgtgactccattataatactatgtcagcagccattgcttgcttcagaggagggggctatcacagtgtgcttgcaattgattaatgtctgcttccccagcagactttaaaatccacaggagcaaagaccacaactgtattgctccttatgaaatagcctatgcctggcatagggcctgcctgacacattctagatgataaataaaattttttccctcctaagaggagcataaggtcatagttgacttatttgtatagttatttattctgtttttcttttccatcaactatagccttatattgtgttaggtcctggataaagcttttaagtatgaagcaatgtcttttttgtaggaaacctattcatcttgttggggagagctataagcaatggattaatttgagcagctgttcctggtgaactaacctcttctctttttgccagggaggaggtggcagccattaagaattagtaccctagagaattttgcaatggtagtgggtcatgtagattgagtcaccttgaatcatggtaggtcaatgattggcctgccatggtaggatagacagtaatattgaacatagaatagggccgggattacaatgtggaacaattatactttatatggtcttgttggttttataatctatagaaaataaagttcttcatatcattttgactggtagtaaatgactctagggaccaaagtttaaaaaagggtgaaaatctctggatgagattcaagtgaaaatgaagcaggttaggagctgtagaccaactgataacctcaatctggaaccaaggaccaagcaggaccagtcagaagagctgttatatgtaaatccgtgttgaatcactctccacttcagaaggagctttcaggcacaccttgccttggtaacagtggtagcttcgctttaggaggagattttagtgctcactatgcaggaagaccctgggttcgaatctcaaattctgctacttactggttggtgaccttgggcaagctccttaactatcttcagtctcacttccttttttggtaaaataggcataataatatgtatcttacaggattgttgtgagaatttagtaagataatttatataaagcactcaatgcatgcctaatacatgataagcactcacccgtgatggggaatgaggaaaattataaagcaatatatgcataaatgaagtttgaagtaagctttcggaattaacatcatcagaaagtactataggaaatatggagattactgtgggctcttgaggtccgtgcaggtttcaagacattcatctgagaaatggggagaaagaaaacaggaagtgtgtagcaccctgttatctacttgtaccgctaattcattcattatttatcaaacagtatctcttctgtatcagaggctatgctaagcactagacatgtaaagaagactaatacctataccctatccttgaggagtttacagcccagtgggggaagatagtcaaaaaggcaaagaagcagcgataacatggttaagcactgtgacacaggtatgagcaaagtgacaagtgaggacaaagactggatacagccatttctgcctaggaacagagaatgggagtatgtgtttaggctgaggcaatgccatacataaacacacagagttgtgaaaggtcctgccatggtcaggggctgtaagaagttcagtatgacccatgggagtactctagactctacagtctaagtgagcaaagatggtatctgggttttgctcactgctctaaccttagtactcaatgctaggactgcccctcagtagatgctaaacgcttcctgaaggatttaatggggtatgtgggagacattatgtctagtgctttcatatatcctttccatgtaagcctcacagcttctgtaatatgattcccatttttaccatcaagaaaactgtcacatggttactaaatagtagaatccgtgaactcaaaaacccaaaactagaatgaaagggacaactcatccctacttttggtcttgtaaagatcctttagaaaaactctatatttttctgatcatcagttattaagagtaataaagaaaaggttgaagaaataaaagcactatctcatttctatatactgttcattgtatggaaatgaaaatttataattcagaaactattctatcaggaaacacatataaaccttagaagtcagtgagtaagaaagaagttctaaagcgcctaacttcaagtcatctcttttaagatgagtcttgagccttcaaccattgtctgttgttacatgattcctgccactgagttgtagggtactactgctgctgatgaatcactggaagacttttaccacatatttctgaaatcctatgtcctttattgtttatcattgagatgtttttattattcctgttaagctgcatttttcataacgtttgaggtgatctgaaacgacaatagaaggatcatgaccttgttcctgtgtagaaacaagcaaacagtatttagagcttctgaaatgagtacttcttaattgttggcttgaggacccactaagcaatgatcacattttcacatattcttagccatttgaaatggagattgtgtatgttttagggcaagtcaaattttatgtagcatgacagaactgtgtgtgtactttcagtaattgtatgacatatatggtatagtttgcctatcatatctgctggtttatataacataggaaatattagattgtagttgtgtggtcttttgtaaaaatgatcttgtatgtaacgtgtgtactgtatactttgttaaaatcaaaagatgcttttaattgataagcttttagaaataataatgccatgaggtgtttctctctaccacttgaattcctgtttttctcccaaatgaatcttttctttcgaaagtgtatgtggttatatatgagagtgtgtgtgtgtgtgtgtgtgtgtgtgtgtgtgtgtgtgtatatatatgtgtataccatttcttttcttctctcttttttttttttaagagacagggtctcaccatgttgctcaaactggagtggtggctcttcacaggtgtgatcatagtgcactgcagttcattcttttaaaaggatttaagtgctagtgtttgatagacctggatttaagattcacctctcccatgtattaatttgtgatcttggaacattgtcccaacattctaagcctcagtttcatcatttttaaagcaggcttaatagtagtatctaccgggatttttgtgtaaattacataaaatgatgaagtgcttggcgtatagtaagtactcatgattagcttctgctatctttatcaatatgatattacatcatgaacaacagtaatagcaatgttaatattaataatggatattggtgtcagggcatgtttctaatttaatacatgtgttaggtaacttccagttacaaagtttttataagagcacatgatgtgtataatagctgattatactgaaatacgaagtgtcagatttgtatttttctggtttgggatttttttttttttggttggtgaatatcatggagtatttgcattctaaaatttgactttgtattggttatatgaattattttagtgattatgcaaattcaactatatagtaaagtcaaattatattctctaaaaatcactcctaaatactgtgttatataatcaagactagaaggcaggtattactctcattcacttattaattcacttattcaccaactcttgattgatcaacttttatgggctaggctctctattgtttctagggctatgtagatcaaaagacttcacacccttgaggagtccagcctagggaaagccaggcttatgcactgatagataactttattatgatacaagttataataactgtcttaatcaaatgtgtagaatacagaagagatcgtgacagctctgcttgagtgagccagggaagacttcacagaggagagaatatctgaggtgggacttgaagaatatttctgagcaggataggagagggcatgtagtatagggagtggcttatgtagtttttcagcttccatttaatgagttagcttgggttatccagaaagcctttgagagttaaatcagtatgttccttccttcccctactctcatcctagttggccagcttcatctatttatgcatcaatgcgttaaatagaaacttaatgtaagtttattcttgttagaacaaatacatatcatggtaagcctcgggaaatatatgtcatgtcaaaatgatagcacaaaagaatatttaattggtcatctagggttgatgtaataaggttttaacctattaaagcatctattcagttcatctttaagtacctattgtgtgtcaggtactgtgctaggataataatacatattaattttttaaattaattaactgaaaaaatatcgattgactaaagtaaaacaatataaacttgcaaagaggcagcactgttttataaactccagagagcatttgtttaaacctgtatcagacagcaaaaagggcaatagttgcaaatattaatttggtagttgctggcaaaaattctttttgaaataataaaaaacaactgcaagagtggcccattttaagattctgaaaattctctgctttcttgagcattatatggacagaaaaattttccctgcatttattcacatcagattactggtactgctcagagtaaagcctgtcttctttctgttctccagtgtataattgtagcagatggcttttaataaaacatttagctaaagaagaatttttactctgggttggtggaatgtattataatgataatattggaaattctcaagaggagatgtttaatttggtatttttcttttgattgaataatgtttggtgaataattgaaaagtcaaattatagtatctgctacatcgttttttatttgttaagtttcaaaactaaattaaatcatgtagatgagtcatgtagccaagtaaatatttgctttttctttacatggtttactttttaaacattaaggcagtttatcctagtaaaataacactcaatactagattttattgagagtcagagcatcgcttaattatatggctgctctgttctctgtcatcaccttgtctaggtgtaggctttgagctttttgatagaatgaggttattccagctgtgtctgtaccattggtatttataaaaaccacaggctgttgtataaaaaccacattactgatataaatacaaaatttacaaagatctcatcagaaaatgtatagttactaaaaatttactaaccacaacaatgaggcaggcaaggagaataaagagtactcattgtgttgtaatgtaaatgccttgaatatgtaggtactggaaagtctttattaaaatgaactaagaattggctgggtgcggtggctcacacctataatcccagcagtttgggaggctgaggtgggctgattgcttgagcctaggagttcgagaccagcctgggccacatggtgaaaccctgtctctacaaaaaatacaaaaattaactgggtgtggcgacacatgcttgtagtcccagctacttgggaggctggggtgggaggatcacttgagcccgggaggcagaggttgcagtgagccaagatcacgccactgcactccagcctgggtgacagagtgagaccctgtatcaaaaaaataaaagaaaaaaagaaaaaagaaagagaaactaagaattaatgaaagaggttctttaagaaaatatacaatttattttctcttttcttgcataattatatatttgcttatggttaatttttttacagaataatttaaatcaaattttcttgatccccatcctttgagatctttcatttactgtctgtctatagtgatatctacatatataaaaactgtaattatatgtgaatttgagaagtaacagttttcttctcaactctccaacactgtgtataaaatttaaaatatactctaagtattttcatgtacttaagtgatatattctattattagtaacaaatatagtttttgttatccttcaaatgtgtttaatagttttgaggtaaattaaggaagatataactttttaatattaccttcattttcatattatggaattagagtaggagtatactgttttgaagaaagatgttagaggttattgttgagcatagatcatttcatggcttacatggtttactttttaaaaacttaaggcagtgttagtcaaataacaatactagatttcactgagagtcagaggattgcttaattatacgactgccttgttctttgtcatcaccttgtgtagttttgtaggctttaatcagtaataaaatcagtacttgcctgggcatggtggctcatgctttaatctcaatactttggaaagccaaggcaggaagatctcgagtccaggagttaaagacgctgtctctacaaaaaatacaaaaattagctgggtgtggtgccacatgcctatggttacagccactcgggaggctgaagtgggaggatcacttgagcctaggaggctgcagtgagctgtgattgtgccatttgccattttaatgacaaaacccacaattacttttgcatcaacctagtctcatattttcaagagcctgggattacactcctgtattccaatttcataataactttattgacattagcacatatttctagaacatatttaatttatgtttcattgggtaatatggtgtggtgagttctctctagggattttgctttgtctttgatttacttttccatttaaatttatgaaatttatgtttagatgtgtttactattgattacggctgaggtgaaaaaagggataggcagctgatacccatgaggcacctacctcctgccccaacatgttatacatttctgcacatgttttggtcacagttccattttgcagcctcttatttgattgcttcatgaatctgtttctcagtatcttctttcatttttgtgtctctttatgtttttttttttgtctctccattatatctttaattttcttttttacctgcctccctttcttaattgtccaaaatctagagttgactcttaaagaatgcaggggttagtggctggcttccatctcaaggcagttgaaaaattgtgtataaccttttactccccccagatctaactattaatagcctattgttgagtggaagccttaccaataacataggcagtcagttaacatgtatcttgtattatgcaaaaagtccaaggattttgcatgtgctgatgtagctgcattgacagcttcatgaatttcctctttaattattattattatcattattttttactgttgtccttttgctggattcatttatctcaaagtagtggacatccgcagctgcagacttcagtgtgtggtacttattcagaattcagctttttcttgtaatgtgacttttctgtgcttcttgaaagcacttttagcttcactagtggcacttcatatgggtcacatggtgttactcaagttttatggtattgcactaaacaatgagaaatatgtgagaaccatgatcactttttacaatgataaaatgtactggagagatgaactgctcacatggagatgattagcattacacggcatttcaagcagatacactcaccacaatagcaacccgagatggggttgaaaattttacagttgcatagtatgtactacatttaactttatatagttttgatgtaatactgcatctttatgtttgttttgtgtttttcaaattttattttagattcagggggtacatatgcaggtttgttacctgaatgtattgcatgatgctgaagttttgggtgtgaatgatcctatcacttgggtaatgagcatagtaccccagtacttagtttttcagcccttgtctccttcagccttctgttagcctccattgtctgttgttgccatctttatgtccatgactacccaatgtttatctcccactcataagtgagaacatgtggtacttggttttctgtttttttgttaatttggttaggataatggcctccagctgcatccacattgctgcataggacatgatttcattcttttctgtggctgcatagtattgtatggtgtatatataccacattttctttttccaacccactgttgatgggcacttgtgttgactccatgtctttgttattgtgaatagtgctgcagtgaacatgcaaacgtgtgtcttttcgatagaaatatttgttttcttttggatatatacccaatagtaggattgctgggttgaactgggtagaatggtagttatttgagaaatctctaaagcattccacagtggctgtaataatttacattcccaccaacagtgtctacgtgttaattcccctttctctgtagccttgtgagcatctgttgtttttttttgactttttagtaatagccattttggctagtatgacatggtttctcattgtgattttgatttgcctttctcagattagtgatgttgagcattttttcatgtttgttggctgcttgtttgtcttcttttgagaagtgtctattcatatcttttgcctgctttttaatggtgttatttgttttgtgcttgttgaattttttaagttccttatagattctaatgttagacctttgtcagatacgtagtttctgagtatgttctcctattctgtaggttttctgtttactctattgatagtttcttttcctgtgcagaagctcttcagtttaattaggtcctacttgttaatttatgttttcttgcaattgtttttgagggtttagtcataaattattgttacaggaagtcagggaccccgaacggagggaccagctggagctgcggcagaagaacataaattgtggagatttcattttaatatggacatatgtcagttcccaaaattaatacttttataatttcttatgcctgtctttactgcaatctctgaacataaattgtgaagatttcatggacatttatcagtccccaaataatactcttataatttcttacacctgtcttactttaatctcttaatcctgttatcttcgtaagctgaggatgtacatcacttcgggagcactataattgtatgtaactgtacaaattgattgtaaaacgtgtgtttgaacaatatgaaatcagtgcaccttgaaaaagaacagaataacacgattttcaggaaacaagggaagacaaccataatgtctgactgcctgcggggtcgggcagaatagagccatatttttcttcttgcagagagcctataaatggatgtgcaagtagggaagatatcgctgaattcttttcctagcaaggaatattaataattaagaccctgggaaaggaatgcattcctggggaggggtctataaacggccactctggaagtatctgtcttatgcagttgagataaggactgaaattcaccctggtctcctgccgtaccctcaggcttactaggattgggaaaccccaccctggtaaatttgaggtcagactggttctctgctctcgaaccctgttttctgttgtttaagatgtttatcaagacaatacgtgcacagctgaacatagacccttatcaggagtttttgattttgccctttgccttgtgatctttgctttgccctttgccctgtgatctttattggcctcagaagcatgtgatctttgttatcctttttgccctttgaagcatgtgatctttgtgacctactccctgtttgtacaccccctccccttttgaagtccttaataaaaacctactggttttgtggcccaggtgggcatcacggtcctacagatatgctgtgtcacccctggaggcccagtaaaattcctctctttgtactctttctctttatttctcagactggccgacacttagggaaaataggacttacgttgaaatattgggggtgggttcccccgataaattatttcccaaggctgatgtccagaatggtgttccctaggttttcttctagatttttagagtttgaggtcttacatttaaaaattttaattcatctggagttaatttttgtgtatggtgacagataagggtccagtttctttcttctgcatatggctagccaactatcccgtaatagcagggataatgtgtggctaagtcttttcaccatttattgaataaggagccctttccctattgcttatttttgttgactttgttgaggatcagatggctgtaggtgtgtggctttatttctgcgttctttattttgttggtttatgtatctgtttttgtaccaattatcatgctgttttggttactgtagccttatatatagtatgaattcaggtaatgtgatgcctccagctttgttctttttgcttagaatgctttggctatttgggccattttttggttccatatgaattttagaatagtttttttctagttctgtgaaaactaatgttggtagttgaatagaaatagcattcaatctcttgctttctttgggcagtatggccactttaatgaaattgattcttccaatccatgatcgtggaattttttaaaaattgtttctgtcatttcagatttatttgagcaatgttttgtagttctccttgtagaaatcttttacctccttggttagatgtattcctaggtatatttttttgtgtatgtggctaattgtgggattgtgttcttgatttggctctcagcttgaacgatattgctatatagaaatgctactgatttttgtgtgctgattttttatcttaaaacttttctgaagtcatttatcagttccaggaaccttctggcagagtctttagggttttctagtataggatcacatcatcagtgaagagagatcatttgacttcttcttttccaatttggatgcctttctttctcttgcctgattgctctgggtaggacttccattactatgttgaataggagtgatgagagtgggcatccttgtcttgttcattctcaaggggaatgctttcagtttttacctgttcagtatgatgtttgctgtgggtttgtcatgaatggttcctgttattttgaggtatgttgctttgattcctggtttcttgagtatttttatcatgaagggatgttggattttatcaaaagcttttttcacatttattgagatgatcacatggcttttgtttttgtttttgattctgtttatgtgttcaatcaaatttattaaatttttgatacactgttgagtttggtttgttagtattttgttggggatttttccatctatgttcactagggatattgggctaagttttctgtttctgttgtgtctttgccaggttttggtatcagattgatgctgactctgattttatttacttcaaagtaatttttgatttctgccttaatttcattgtttacccaaaagtcattcaggagcaggtcatttaatttctatgtaactgtgtggttttgagagagctttttgatactgatttctatttgtattccactgtggtccaagagtatggtttgtgtgactttttaaaaaatttattgagacttgcattgtggctgagcatgtgattgatcttggagtatgttctgggtgcagatgagaaagatatatattctgtggttgatgggtagagtatcccgtagatgtttattaagtccaactggacaagtgtcaagtttaagttcaggatttctttgttagttttctgctttgatgatgtgtctaatgctgtcagtggggtgttgaagttccccactattactgtgtggctaagtcttttcataggtatagacatacttgtttataccccaaacttgggcgtgtatatatttaagatagttaagtcttcttgttgaattgaactctttatcattatgtaatacctttatttgttcacttttacttttgttggcttaaagtgtgttttatctaatataagaacagccacccttgcccatttatgttttccatttgcatggtagatcttcctccatccctttatattgaggctttgggtgttattatgtgtgagatgggtctcttgaagacagcagatgtatgaatctttttatccaacttgtgattctgtgccttttaagtggggtgttttgaccatttacattcaacattaatattgataatgtgagattttgatgctatcataaagttgttagttggttgctttgtagtttctattgtgttgtttcctgatagggtctgtgggctatgtacttaagtgtgtttttgggtagaggaggtatctttccttcatttccatgtatagaaatatcttaaggatcccttgtaaaactggtttagtggtaatgaattcccttagcacttgctcgtctgaaaaaggttttatttctcttttgcttatgaagcttagtttggcagaatatgaaattcttagttggaattttttttctttaagaatgcttaaaaaaggcccccagtctctcctggcttgtaatgtttctgatgaaaagtccactgttagcctgatggggttccctttgtacatgatctgacctttttctctagctgtctttaaaatttttttctttagcattgagcttggacagtcttgtgactatatatcctggtgatgttcattttgtgtagtatctcacagatattctctattcttgtatctggatgtctacctctctagcaagattagggaagttttcttgaattattcactcaaatatgtttttcagattgtttactttttctcctttctcaggaatgccagtaattcatagatttggtcattttacataatcctatttttatcaaagactttgttcatttttaaaaattcttttttctttatttttgttgactgtattagttcaaaacactggtcttcaggctctgagattctttcctcaacatggtctcttctgttgctaacacattcaattgtattttgaaattccttaagtgaattttttaatgactgaagctgtcattgatttatttttaaagatatttctctcttatttcctggcttgctttagacgtttgtgtcgattttcaaccttgtcttgaatctcattgagcttccttgcaatccatgctttgaattctttctgtcatttatgagtttccattttagttggggaccattgcttgacagctctaaggccatcccttggtagtgtcactacattgagatttttcatggtgccagaattcttgtactggttccttctcatctgaagacactggtacttctaatttttgtcattattttctcgcaggtatgattgtttttctttcttcatttccctatagtgttattttattttttctgtaccctcctccccccctttctctatgggtgagactgcagagaattctggttagggtcttttggctttgcttctatagccctatgcacttctttgggcaagttttatattgggctgtgcaatttaatgtacaagccagtagatgacgctaggcagccaatgcagttgggtatatacttgattcttgtttattttcggaagctctctgttgtgtcaggcagtgtactgattctttgaatgcacagtggtcgagctccctgcttaactaccataggacagaggccatgaaggcagggatagaccagcacatctgcccacacgtcccctgatggcaggcacttaaatttctctcaactgtgaatggcaccatgtatggtctgtaagtgtttgtatatgtaagtttttataaattataatttttaatgacagatttgtatatattttatggcagtaaattataacagactagtagctacatatatttcgtgcattcatgatataattttttcttaatttttttgatatttctaggccacatggttggcatgtttttcatgttatcacagatcttcaaaaaattttccaatacagtttttaaaaaaaatccacatataattggacccatttatttcaaactcatgttgttcaagggtcagctgtagttctgaaaagtgatattcattatgtgttgttttttatttgctgttttactttccctttcagtttctcagattagtctgcttttcggttgtatgacttttagttgatttttaaattgacaggatagtaggctgtcctactatctaggatactgtcctactatataggatcctactatactaatgagagaaactgtgttctttcattgtactttatatgcccagggcctggtactagcccttaataaataagcattgaatgactctatgaattaaacttagtgctccatgatttttttttaaaggagaagtgaattgtctgtggcactgtaattggagaatttgatttaaagttacaaattttggtagaaaactttaagttatataccatagctgattaattgaagtcttactttttttcaccacatttaatgagtagatcctggggaccagatacaaactagtttttttcactataattactacttatgaaatagaagtgtagttgctaatatgcacacctcaaaatatgacctatcatacatctattgaaaactagtttcctagtttttactgcctttttctatcaaatagaaaaaaaaatggaaaaaccatttaatggaaagccattgagtgaatttaagattattgttggccttggaaaaattcagttcctctgtgaaatttcttgagcttcttcaaaaatattctatgtaaataccatattggggatattattgatactgtaaaatctttttagactttaaagctttattccataaactggcttgtgatttaattaatatattgttcttttaacattattcgttagattgtttcaaagtatttcaattaattcaatatgttgcaatgttaaaataataactataccattttattaggattctttattcagttcctttttccctgtattaaatctttacattttctagattaacaatttattttatcagtaatacttccattaagcacataatagacttcaattttctacatacaaacatttttattcctaataagtgatgaacaggctcagtaaaagttgctaagaatgtttgtattgctggattggaatatcatggatatgcatactttttttttccataggagagagctttaattgttactaaagtcaggaaaattcagtcacttttgcactttgagaagctgatctctgacatgtttatgaaaactgcttaatcttttaataggtgacaaattttttgaagacagcatcatgacgcttctaccttgatacctgcaaaaatgatgtgaaaaggagcaattttcattttgctctttatatcttcagttctggtgtgaagtagaatggcaattttggattgaaagcttatcttaatttttctacccatctgtctagttggcatttagatattctaagtaaggctccatttcttcatagagattctttaatcgatgttactgtagctttctttctttactttccagggacctcagatcttattttcaaagctcaagtatttgcaggggtgattctggtatgttcacataatttttgactcattcagtcttataaatttgacctgggattcaaaatgcttattgatctttattttatactatttaaaatcaagactttctgcataaactataccagaaccttaaattaagtacttaaggaatttccctagaaaatttacatatatatatatatatacacacacattttttttttcctgtttggcctgatgatatgtctcttgctgtgagctgcagtttttccaactcacttctgctgtgacagaccatatcccatttggacaaaaaatagattgagcttaatactaggaaaaagattatgcttaactattactatgaagagaataattgttcatcccagtggcagactgtagtcttgcattaagtgttctgggactaattaatcaggaaacaactattattaaaaaggaaactgctcatcagctgcctgcttgggctattccacagaaagaaactgtagacctggctacttggactccatcttgtagcatcattctttaactgcttatgtcccagttaaaagaggtaatttaaggatttttagcagaccttatttggtagtgataaactttaatattaaattaatattaatggacttgttgagtataaattaacataaaaacaataatattgggttagaatattttggtcaatctggaaggcttcttaacttctaatcttaccacattttaaatcctggaacaagccatgctgcttacatataatcctagtagacagcatttgagtgtgtatgtaaatatatataaacaaacgtgtttgtcatgcaagatgaaaatttaaaaatctaaccattactgaattaagtatatcatattgacatttctgttgacttactagtttatttggcttaactaaagtcttagagaattactatataagagagtattttaacttaacaagagtatgtgcattacgtatgtgttatatgtgttgtttcccaggctgctttgtgtttgtaagatgattattatatctaggatttgaggtgtttcttaatttaccaaacgggaattgattataaactaatgagaattttataattgttcttgatgttgtttttgttaattttacctcttctttttttgatgtttgtcctaatacgtatacaccatcacaagtttattagtttctaaaataagcaagtagttggatgaattaggaaggtttttggcattactttcaatggcaaaaaccgcaattacttttgcaccagcctagtaagaactggaaagctactctcagtgaagactggaattttaacttattcttcttatatccttcccacccttctgtccccaaccaccatttattaatggacacataatacgtatactctgagcatatttttatgaagccaatttgaattgtggcccattggggattaatttattctgtgctattgtagtatttcaaatcagttatagttcaaggtgctaaatcttatacaaatgatgctgcattacagtctaatgtttacaaacttcatggcacgcttagccagggaaaacaatcttgcgaatgttgggggtaattgccttttaataggtagatgcagttctactggcttgtttgtttaaacaaaggaagaaacttattaaatgcccaacttatatgtgatgcatctaatggaaacaagacagtatcttgaacaagaacagtgataaagcctagagccatgggttttattcaagttttgtatctctgggcttatatttttaatagtttgttttaaactttgggtatatggatttgtattaattgctataacttactcaaatattcaccttactggaagtattgttgtgtgtgtatttaacacagtcgttttaagaatcacatattaatttacttttgtgactcattagtggactatattgatttcaaataataatattacagttaacatagaagtctaaaagctgagttacccagcccaagtcaaatagaaaatgtgttttagaactggaaatagaaacgggagttactaataatgtgtctgtgatttctaactctctttttgatgttttccactgaacattacttggagcataatatcatagagaatttttttatattgtgataaaattgcttatcaaagtttccattaataaatagtacttccacagactaaacactaagaggcaacttattggctctccagaggtgaaatttcaaatgctgaggcatggctgcacatatgcagaacttgttttgcttgttggttgtgttgcttaccggtgcttagtgcctgtcttccttggtgtatgtgaggcaatggatgaaagctgtacatcactccaaaatgatgctgaactgattctagtttgacacttgaattaccttctttcctaagataacacgtcttgttcagtttcaatgaggtagtagatattatttccacagatattgtttatggaactcaatgtagaatgattttttaccatataagaggaaaaattatcttgttgctaaattctatccagtttggaccagtacaatggtgtcttaagtcactggataattattgaatgtaaggtccctgtgatggcacattaatgctttgagagaatggttataattaaatcatgatgatgtctttttatcctggatagagatagtctataagaatgcctgtagcagtggagtgtccttgaaatatgagggaaacacatgtcttaccttagtaatcttaatggttctttaaggattctatgatgcttcaggggcactatgatgcttcaggggcactccaagcaatttttaatgagtccttagtctcatgaaaatatggcaggaaaattatacaccaacatttcatcattttaatcctgtgtagtgtctaaattttagaatacagtctgggtgcggtggctcatgcctataatcccagcactttgggaggctgaggcaggtggattacttgaggtcaggagttcaagaccagcctgggcaacatgatgaaaccctgtctctacgaaaatgcaaaaattagccaggtgtggtagtgtgcacctgtaatcccagctgctcaggaggctgaggcaggagaatcgcttgaacctaggaggtggaggttgcagtgagctgagattgtgccacttcactccagcctgggcaacagagtgagactccatctctaaataaataaattaattaagaatacaatataaggtaccaattccatacctctcttcattcaagtcttgatttaatggttagagtacttagtttttgataatctattcttggtttatttacattcagttttaattttactgctgcctgttatttgtcagaaacattacctaggacagatctcaaagtttaatgtgcattcaaaccacctgcggatcttgttaaaatgcaaattcagtagatctgggatagagcttgggattctcatttcgaacaagctatcaggcaatgtcaacactactactagttagggatctcactttgaaccaagggtctagatcatagactgtaaactctagaatgtttctgaaatattttttggattattattagctcagtgaattcatgagattatttctggctcactttagttttaagaaaataaatatgctaaaaatgtacactatatcttactattttctttaaaacagtttttaaaattttctgtaactgtggtttgctttcattgtaatagagagttcatagcttaatttgttattgtaaaaagatggacacatagtataatttaaaacttaaaatagttacagttcactatcaaaagaatattatgtaaataaatataaaatgaactatgaaagtgagctaaagttacttgccttataaggtttaagttattttttcttaatttatgctttatgtaacaactaaatcatctgacatttgtcttttatttgatgtgaaagtaggaagaaaagtcagagaatcaaagaagcagaagatgattcttttgaatgtttttttctcttgggttttggctgtccgctttcatttttgattccggctgcttctttaacttttttcacatgtatagaggcatttaaattttccatttgagcccaagaaacaagaattagattttacttccatgaatcttcattcttatactattaatattcaacacagttaaaaccataatacattttacttcccaggaagaaaagttttgtttcccattccttctctcgggttatatactgagagaagagggctttaatgaaaaagccaaccacattaatttaaaatgttctatcatggagctagtagtttaacacagagtttaaggttcttggaggcccaacctcctttttttttttttttttttaaatggatagagatgtagccagaaagctagaaaggtattgtgacaaacagctctctgggaaaacctggccagtgtttttgctgtggaaatgtagtggcacatactaaaagcattaactcagcctctttattttcactaccttttagtaatcattcccaagaagaaaaagagttaagatgttattcatgatatagttgattactgacatagagataatgatatgaatcttgaacatacaatttactaatctagattgttgactgagagaacattaggttgaatgttaactaatttaatatgttgggttgctttttaaatgacattcatcatttaagacatctctagtattattctaaattatcaagaggatttataaactagcttttaatttcattcctgatatgccttttatgctgcttagttttgtttgagtatccagtgtggattctgggtgttttgtttttttttttttttgagacggagtcttgctctgtcacccaggctggagtgcagtggcgtaagctcggctcactgcaagctccacctcctgggttcacgccattctcctgtctcagcctcccgagtagctgggactacaggcgcccgccaccacgcccggctaatttttttgtatttttagtagagatggggtttcaccgtgttcgccaggatggtctcgatctcctgacttcatgatctgccctccttggcctcccaaagtgctgggattacaggtgtgagccaccgcgcctggctggattcaggttttatagggcatgaagcttatataatttggaggcaacagctctttaaggacaagatcccattgtgggtgtgggtgcaaattttacaaaagtatataatgatgtgaatgtgtttctagggacccttctgggacagaatgaagacaagctaagcttcatcttctgctactatcacaaactgagatgacacttcatatttttttttatcttgaagggtagtccactatatttggaaagagcataggcttatgttacaactgggattcaaaaatgggccttctccatcttctttgctaccgttagagtcttacgtacatctttttcctaggcaacaacagctttcaaaatggtattcacatttccatctttgtttttttacacactccttccctatagcctgttctctacagtgcagctgaagaaccctttttaaaaatgtttcagtgacatattcaggatatagaataaaatccagaatttttaaactattttcagtgttcttcattcattcccaaaatctaagtttctctctgctgtcatttctcttgagcctgaaataatttttttagcacttcttatggttcaggtctgttggtgaaaacttctcttagatttcctttatttgaacattctctattttgcctttattctttattcttgcagggtgttttcactggactactgagttgacagtttttgctttcagcattttgaaaatgttccactgccctctggtcttcatactgcctgatgaaagtttgtgttttttgttgttgtttgtttgttttgtgtgtttttgtttttgagacggagtctcactctgttgcccaggctggagtacagtggcacgatctcggctcactgcaaactctgcatactgggttcaagtgattctcctgccttatcctcctgagtagctgggattacaggcatgtgccaccatgcctggctaatttttgtatttttagtagagacagggtttcgctatattggccaggctggtcttgaactcctgacctcaggtgatctgcctgcctcagcttctcaaagtgctgggattacaggtgtgagccaacacgcccagcctctgatgaaagtttatcatcattccaggattggtttcataggcatgtgacctatgttgttgcataggtacccgtacttagaaagatcctgtgtttcattaaatgttctactattgctatcttgatacgcttaatggcttttgaacaagggccctgtattttcattttgcactgattctgtggtttcttctattttatatatattatacatgaaacaaaccagaaaatcttctctgcctattgggtaagaattgtcttgtatctaggctgcctgtgctagataataaggatcatcaagatttaagtagatttttttttaaacattcgaccaacttccaaaaacagtttttaggaatagaaaataaaatttataataataagaatactcattcatatttcacagacattcatagtttataaggttatttccatatactttctaattttatccttataaaagccctatgagttaggccagtaataattctatccccttttattgatatgcaaatacaggcccaagagaagttatatgaattaatcttaaatcagtcaggtaaccattcttctctgattaaaatctagtttaagattttttttctctagctgagcacggtggcctgtaatcccagcactttgggaggccaaggcaggcggatcacctgaggtctggagtttgagaccagcttggccaacatggtgaaactctgtctctactaaaaatacaaaaattagctggtgtgatagcacacatctgtaatcccagatacttgggaagctgaggcacgagaatcgcttgaaccccggaggtggaggttgcagtgagccgagatcatgccactgcactttagcctgggtgatagagtgagattctgtccaaaaaaaaaaaaaaaaaaaaaattttttttgaaccattatagctaaaaatagtgaatagtgacattttttagcacacttttttcccaaaatgtttcataaatataatttcatttaacctttcagctagccatctgatataagcagtattcattatcagtgtatttcccttttttgaaatgaaaaagatctaaaggtacaaaaaattatttgtatgggttacataagtaatgtaggatctaaagctgtcacccaaatctctaactctaaattgtgtccatttttttaatattgcactatcttttgttgtttagagatgaattcaacaatatacaatatacatttattattagctcaccaatatttttactttgtgtctttagactgcatctgatgtcgtaggaagcactcaacactttattgaatcaacaaataatgaatgtaaaaaatatcttttggcagcatctgatgtcctttggacttttgcttctttattctgttctggaaaatgtactatgaataaaactgctttttctctaatctcaaatgaactgcataatatttccaaaatgccgtatacctgcattttgaattatgagtcaactgataaaaaaatttaaaagacttctgggccaaaagggctatttacatgctaagtaatatgccttgggatgaaaacacattataaatatttatatttaaccaattttctctaaacccttttggaggtcttttgaagatttctttgtttgctccttcctagttcgctttctccctcccttttttcctccctttcttatagggaatgctattctgtaaaagctatattctatcttctgccaaaccctcaaatctaattttggaacaacttctgtaggtaatttaagtacagaagatagatttaatgttcattttacttttgatttatatatgacatctgtttggaaccaaactttctctgtttttagaaacagagaaaaaaaatattttgggatatgtaggccagaggcaaatgatctgacaagttagcccccttgtttctaaaggaaaaattgccacagtttataagagtggtataaaggccaagaagttgaccaagaccaaaggagatcacaaagaaagcatagcatatagtagactttcaagaaagaagtttactgaatgatgaaggaaaatatgtgtctatggtttttatggcctacctagcatataggatatatcttctttttttccgacccactaccaaagaagagttataaaattcctgtcttcagtcgtgttgacctaaaataagatgtactgtggtatgacaataccaacctttatgtgccttattttcagactttgtgcctttagcttaagtagagatattggctaatagctgtaagtcttgctacttttctgttctcagtgtgatgttcaaaattagtgaaatgcagacttttatttctttcctcaaatgtaagtcatttctgtttctgtagttattaaatgctttttgataatatgaaaaaatatacactgcattggcttttaggaacattttcgtcatatatatttcaaactttaattaggacctctaacaacaaccatgttttaaaacaaagtttggcagcagttggctttttgttttctttatagaaattgaaaaggtgctagaagaaggtgctgagtaattttaaccacatgcaatgtagtaatcacctggaaatcacacactttctcaattgtcttattgctactatgaaaaacaggaataaattttagtcattaatacatttattctttttttccagagaaaaattgaagctgaatttaacacattttattgacttgtatatcacatcattcatgacacaatttatattttatttgtgcacatgattaacactttattggaattattactattataaaattgtaagatacaattggatccaaattttttgtggaattaaaataagccaacaataggattatctttaagcatttagaacagaatgggttaaactgtcattattggtcagaacaagcaaataataggatgttttacattttattttgttgctggttttggttggtatagaacattattatatacaaaatactatttgagatgtgtatatcataaactatagcattgggaatcttttggtcatgccgaggtttttcattggaatttgttgtagcatttgctgtaactggatttgacctgtataaccaatagatagtgtaggatgttatcctttaccagtagttttctgtaactattatgtgtacagtctttgtgtctcagcccacatttataatatctgcacatcttaacaggcacctttttgaatgtaaacatttcagagctctcaagaacttaaagacatctaatcttgctattgcatgcttcaggtggtaagcatgtcactttaaaaaataagacagatagccatttaggactgggagaagctgtgaatttctctctgtcatccagtgaataagtggactagaactttcctctgttatttccagtagtgtttggcaaagatatgaagaatatttgcaacaagtgaatttagaatttgtcacaaacttagattctcatgaaatcccccaaaatgtgaggaacaaattagacataacttaatggtctttatactaacagagttttataaaatcggataagtaaaacaaaacagaaacaaacaccttagtctcactgtcttgtctgttatattttattaatgatgcggtttagacatattttccattaatacagtgtatgcctgtgttacttaataattgaagtttcttttaactctgttcatgttggttaaaaccattttttatgtgaagttaaaatttacagatataaagacattccagggatattgggtaaatggttcttctgaaaatttccaaaactttttaaacacccatttcgtacacatataaacaaatgttagttgtaactgccatacgtctagtttattagcaagttcaaaggatttgaactatatttataaataagtttcttctatttagagggaagaaaagttatttgttgaatatcgttgtaattacttgagtgatacagttttgctattttacaatcaatcattgttctcataaagttctgtaggaaatactgcctatttaatacctttacacttgaacaccaccaacaattttgtttcccttcagggcatacagctgtttccagcctactcagtgccatgtcaggacataaaattatcttgacagcaagatttaaattataaatagtcccataatgacattcagcttgggcggtacatttataaaagtagttattaaggaaaatgtaattcaacccattactataactagattctctcacatttctgaagctgtcttttggtagcccgataatatttgcatatgtaagcatttaaactattaaggctatcaagtcaacaagtataaaaacataatatagatattagataaatggtttcctaaaattttccaaaacttttctattacaaatacgtcttaatatatgtctttgccctatgaaaactgataaaatattggggagttgagaccccaagatcttgatattattcaaaaagcatagactggaaatactttatatataatgaaagaagaaaagaactagaagtcgatttatcttataagcaacatcagaatattggatagtgaataacattttatgagcacttttttcctagagtaaatgttgactgtaagttacttggtgttagtgttctgatttttaaatacccaatttaccatcttattagtacatttagatcctatgagaatgtacttttagccaaagtcatatttttctctgaaaaaattatatttattctaaaaaagctttactatttgaataagtgttgctgtgagtctattttatgctgcgtgtgtacctagttatttcagcatctgaaagtagagatacgtaacagaaagtgaatgggaagatcagtcaatcataacaatatgtaatatgggtccatgttgcagagccacacttatcaaagctttagcctgtgttgtggtcatcactgaaaaaatctagagcatagctggtttgaagctggcatggtggagatgttagtgttagattaacagtaacatttaacctctgtgatataaacctctatgaaacctctgtttaacataaacctccgcatgtttatgtgtgtgtgtgtgtgtgtgtgtgtgtgtgtgtgtgtgtgaacattgattttatttctgaagtctgtagtttataaacattattgcattgtgctgcttagtgggccaaaaattacccaagatgattgctgatcccaacttcgatcttctaattcagtttttaatcaaattttctttttttgattttgactccttctcaatagagatatttcttaccgggcttctgccagtttagcaacttcatttctctcttaagcatgtcttagaaacagcctaatgtatttattctttcctttcccaatttctgtctcttaaaaagggatttctgtcaaaggttcagtgttctgagttgttccctatgctacctaatcactttagccacttagctttgaaactgcctgatgaaaaaggaagttgtactggcatatgtaggtcagttcctttgatttctcatttttcttattcccctagatagaatgatgagaaagtttagtatttttagctttcttttaaacagctttatattctgggtggttttaagccaccccaatttctgatattttaaaagaatcctggtgtttattctagataagacacctactatataaaataatattttatgttgatgttcaacaggaaagggacactaatcagtccacctgatttatttagcaaatattattaccttctactgtgtgccaggcactgtacttgccactgaggataacagcaatgaaatatgttatcagaggagctccactgcctagtgaagaagatgatcaagcacactcagacctgtgttggttagtcaatggaattgcttagtaaattatttcgggtccctgcagtacggtctttttgatcttctagtgaatacatccctggtctgagagttagaaggttttcataccatttctttctgctggcatttcatctttcatcatatatttaatacagtataatcttgagtaagccatacatcatttttataaagttagtaatgtctgttacaacatattatgagatctttgggacagaaatgctgagtcaacagaaacattatcctttcaacaaacatgcactgagtacgtatgattgaagcactatgtgttaggctccctgagtgatacagagataagcgagacaattatctaggtctaggagctgacaatgcagtgtattggatggaaacgaggtatgggggaagtgtagaggagggcataacagttaagacatttctttagtgctttcttgtacaaagcaaatgtatgtttaaatgagaatcttattattaactttattctctctaaccctttatctcttcataatgatttgtagttggagattttccaaacctcagtgggcactgtaaactcaaaaattaagttagtttattatcaacttatttaaatagtgttctttagctttgccttcactttcacttgcattgccagagtacttaatcgttattaagagatattttttaaaaattctactatttgtgtcagggttttcaactttgaaaaatatgccaaaccatttcatcgggaaaaaaaaagtcctcaaagaccctcttttcaccagtgttgagtgtgtgtattttatccagtgttgggtgtgtgtattttatccagtgttatctaaatacatggagatatacaattaaatgcaaactatactcttaactctcatgaccataatctattagaagcaaactataaaatcaataaaaatgtatatttgccatattaatctaatgttataaattaggttgtcttccagaaaataaattactgctgacagtgtgaatatgatactgagagctacaacacagatttttttttgagctttcttttaaaaagcactattacagctatgtaaaattaaattaggttctttttctggtgctttttcagtgcttgcaattccttttttaaaaactaggacaattaagattttattgtgtgatgctggtaagcatggagtagaataaagcagggtattgtaaatcattaatctaaaggatagtaatatttattttaatgaaaggcaatagaattatattaggctagctttaaaataatagtggccatcactagtcgtcttcttcactggataagatagttaaaggaagggcatttgtgttttttgaaggcattatatttctacagagttatgaggatctataatatatataacaggctttccctaaccaacaagcccctttctaggtctaaggaaaatccatggcactctttcccaccaagcccagcttctcaagtcttctttactagctcataagataaaccaatggagggccgggcacggtggctgatgcctgtaattccagcacttttggaggctgaggcgggtggatcacgaggtcaggagctcgagcccagcctggcaacatggtgaaaccccgtctctactaagaatacaaaaattagccagacatggtggtgggcacctgtaatcccagctactcaggaggctgaggcaggagaatcgcctcaacccgggaggcggaagttgcagtgagccgagattgtgccattgcactccagccggggtgacaagagcaagactccatctcaaaaaaaaaaaataaaaataaaaataaagataaaccagtggatttagggggaaacaaaggagacacatagagggtataaataaagcagaaaggtatggagagacatgcataggggtctgtttccagccatttccagccaagttagtctataaatactggggaaatgtgtcatgttagcaacatatattactacatttgttactgaattttggtcactagttattagcaaggaacatatgaaactaaagatgcttcttgattttttgatacaaagcatgtaaatttaaaattgtatttcccaataaggcatctctggggaaaatgaattaatttgggctacttcttagcttaaacccttcacagggctgcgtgcagtggctcacccttgttattccagcactttgggaggccgaggcgggcagtttgcttgagctcaggatgagaccagcctgggcaacatgttgaaactccatctctacaaaaaatacagaaattagccgggtgtggtggtacatgcctgtagtcccagaggctcaggtgggaggattgcttgagcccggaggaggcaagatcgcaccactgcactccagcctagatgacagagccagactctgtctgaaaaaaaaaaaaaaattttttttcaaaggccttaccacttcttatagcaccctcatgattttgttttttctgtgagaatagggttccagacctcaaacaatacctagcatgcaatagaccttcattaacattttaatttaattgaacgctaattgcatgaatctgggcacaacatgttggcagtaagtaaatcttttccatttttagtgtattctagggcagagcattcaagactggaagtatgaaagcaagttagaagagcagaaaaatccaaatttcacacaaacctaatagttagagttcagtttaacagacatttattcagtgctcaacatttcccactgttcttggaagtcagtaatatgtagggttgtctaaagccacattgttgaatatgtgtagaatgatgaaagatataagtgatataaaaaataattaaactcatgattaagattttgttttttgttttttaacttggactgcagagacatctcataaagacaagagcatgagtatttcaagttttcttttgaaaactgagtcatagatgttgcatttcaagccaaggtttgatcattctatacttcatggctttttaaaattctagttgctataacaactttgatatttctttattatttttagcacttcagttgccataacaataagatatcctaaaaaatagcaattttcttttataagagaaaattttcttttaattaaaaatgaatgtgaaccaacacttcttacctataatgtgaacccattatttaaaatgggtctgtgctcttctgttttcatacaattttagcagacttttgtaggaaatatcttaaggttcaacttttctctctctgtttttactgtacaaaagttgaagggatacagctgttttgaaccctttctatgagataattctaatttttatgggatttcattgatataaaaatgaaatgatataaaaaatttaatttccagatttgttagtttataaagcaggaaaagatcgtgattaatggatagttgtaagccatgggaaatgtaagaaacgttgaaatttccttttctcctgtgttatttttaagtgtattttcatacctgttgccatactaaaacaggtacctcctcacttatctggaaataactgacagcttaagcctgagctatggcactttactcatagagcagttacctttatttgctctttgagaaaaaattcttataagcttagtttctgatacagaagcctctagaaaataaggacagcaaattagaacaggaaggaggggctatgctgtgtttgctatgcacatagattcataaaatatagagttatgtattatttttaaggtacctaattcttatggaaatcaaacaaatccagcagctacaaaggtatgattgtatcagaagacagtattcgaattgatgttaatagtgatgatcctaggctaccaaatattaaattatgtcagaattcttggtttaagaagacagaggaatagataatacatcttttaagaatttagatgcctaatgtaatagagtaaaacaatttttttttaaaaacttgggatcatttttctttttcttttttaaagaaatagtttcaacttttatttaagattcagggatacacatgcaggtttgtcacatcagaatattgcatgatgctgaggtttggggtatggttgatcccttcacccaggtagtgagcatagtacccatagttttttaagccttactttcctctctccttcctaactctattagttcccagcatctattgttgctatctttatgtccatgagtacccaatatttacttcctacttacaagtgagaacatgggtttttggttttctattcttgcattaatttgcttaggataatagcctctggtcgcatccattctcctgcaaaagatatgatttaattttttatggctgtgtagtatcgcatgttgtctgtgtaccacatttctttgtccagtctgctagcataaaacataatattaaaaatcaattttaaaaagccccccatttatctgggaaatgtaagatccacgtaccttaggttttcgtagactaagccttggtaatttttatgttactttattgctaatcacaggattttcctaaaaaacatggtcaggttcagacaatgatatttcttttcttttctttctttttttctttttgagaaggagtctctcactgtcaccaggctggagtgcaatggcatgatctcagctgactgcaacctctgcctcctgggttcaggcaattctcctgcctcagcctcctgagtagctgggactacaagcgtgcgcctccatgcccagctaatttttgtattttcagtagggacagggtttcaccatgttggccaggatggtcttgatctcttgacctcgtgatccacctgcctcggcctctgaaagtgctagtattacaggcgtgagccactgtgcctggctgatatttcttttctttaatgtactttaaaaaaggaatggtgagggagttggcaattcaatagaaaagagaaagtgttattattaatttccaaaactcagcatgttacctgtggttgcagtttctgaaggaaaaacgattagatagaaatcttactgatggtaaaataatatgcttatcttactatcagtgagctttgaatgaatagccactgtatgctttacatgctttaagttttagttttcataaccaacttttaaaggtaagtattattatctccattttaaagatagaagctgagatacatggagagaaagatatacccaaggcctcatagttaatgagtggtgcagccatcatgccaacccaaatctgtctgactataaagcctacattctttcctctaagtcatagtatctccttgtcttcaaacttaataaatgtttattaaaggtaataacatacctagaggaaaatatgagaagaaaggtcatactgtgtatggttttattttattgctctgcatactgttttgacctattaattttgttttaaacacatattttgtgtttgagactttctcccactaagaaggtggtaaatatacacgtaaattagtatttttgtctccatttttctttatgatcgagaaacatagtggaacctctcaaagtttttgcttacttggcccattgtcttagatctcagctagctagggcagtctcaaagtgttgtataactggcatttgatatgtcttttctcagtgtctcacttgcagctgggctgttgtgtcttgagtacaaacactgagccatgagtcagatatactgattgagtgtgaaagtatgtgcaggctggatatacttactccatccaccagtatctgttcttttagacattttagtagctctcattctttatggcacattgctacaaaggattctggtatgtttctttttaaatatcattatactatataatttcctggcaatgccttaaaattcactcaaataatttagggctctcatttcgtggctttacacagaactcgaacacttgattacatgcaaatgccatctcagccttttcagtctcttcagctataacttacacaggtcttaaatgatacattttaatgagctttgacatgcatgcatgtgtgtaaccacatgtatcaagatacagaatgtttccctcttccctgaaagttccctcatacctcttgccagtcttgactggtacatgtgtgcacatgagcgcatgcgtgtacacatacacacacacacacacacacacacacacacacacacacacacaccctgcctggggcaactagggttctgatttctttcagcaaaaattagtttttcccatttcagaacttcatataaaatcatgcaatgtgtattcttcaatgtatggcttctttcctttagttttaagattcatccatgttatgtgtgtctttagtgttgttccttttcattgctatatttcattgtatggaaatatcacggtttgtttattcattcccctgttgatggatgtgcgtgggctgtttctggttttggctatttcatttttatacatactgctatgaagatttttatgcaagtcttttgtggacaatatgttttcctttctattggaaggaattgatgggagagatagggtagattttcttttaatgtcataagaaaattccaaactgtttgtcaaagttttcaaagttgagccattttacactactaccagcagtgtatggtttcagttgttctatatccctaccaacattgtactgtcagtcttttagttttagccattctagtgggtatatattggtatctcattgtgggtgtatattggtatctcatctattttgccttttcctgatgactgtgggtgctgagcattttttcattttcttaatggttatttgtatatcttcttttgtgaagtgtcttccagttttttcaccattttaattggattatttgtattcatattaacaaattgtaggagtcagttatatattttggatgcaactcctttgttagacatatgttttgctaatactgtctttggcttgctgattttcttaatgatgtcttttgctaagcagaacatttattttaagtatattttattaaacttttttatagttattgcttccagtatcctaataagtctttgtctattttttaagagacacagtcttgctctgtcacctaggctggagtgtgttggcatgaccatagctcactgtagcttagaactctggactgaagcagtcctcctgcctcagcttgcaggtagctgagactacaggtgtgcaccaccacacccagctaaattttgtttttggtacgaacaaggtcttgctatgttgcccaggcttgtcttgaactcctgggctcaagtgatcctcctcgttaggcctcccaaagtgctgggattataagtgtgagccactgcacctgttcatctttgtctatccttaagttatgaagacattcttcttctagaatgttttcctttagaagctatatatttgcagtttcaatttttttttgtttagatctatgatccatatcatttaaatttttctatatattgtgaggacatggtctaagttaatttttccccagaagattattcaaatttttctaataccatttactgagaaaattttcctttttccttgatttgttttagaatttttaattgaaattcagttgaccatataagtgtgggtttatttttagactttcttcttctcactgatcattttgtatattctttatgcaagatcttaactcttttttttattattattatactttaagttttagggtacatgtacacaacgtgcaggtttgttacatatgtatacatgtgccatgttggtgtgctgcacccattaactcgtcatttagcattaggtacatctcctaatgctatccctcccctctcccccgacaccacaaccgtccccggtgtgtgatgttccccttcctgtgtccatgtgttctcattgttcgattcccacctatgagtgaaaacatgcagtgtttgattttttgtccttgctacagttttctgagaatgatggtttccagcttcatccgtgtccctacaaaggacatgaactcatcattttttatggctgcatagtattccatggtgtatatgtgccacattttcttaatctagtctatcattgttggacatttgggttggttccaagtctttgctattttgaatagtgccacaataaccatacatgtgcatgtgtctttatagcagcatgatttataatcctttgggtatatacccagtaatgggatggctgggtcaaatggtatttctagttctacatccctgaggaattgccacactgacttccacaatggttgaactagtttatagtcccaccaacagtgtaaaagtgtcctgtttctccacatcctctccagcacctgttgtttcctgactttttaatgatcgccattctaactggtgtgagatggtatctcattgtggttttgatttgcatttctctgatggccagtcatgatgagcattttttcatgtgttttttggctgcataaatgtcttcttttgagaagtgtctgttcatatccttcacccactttttgatggggttgtttgtttttttcttgtaaatttgtttgagttcattgtagattctagatattagccctttgtcagatgagtaggctgcaaaaattttctcccattttgtaggttgcctgttcactctgatggtagtttcttttgctgtgcagaagctctttagtttaattagatcccgtttgtcaattttggcttttgttgccattgcttttggtgttttagacatgaagtccttgtccatgcctatgcttgagatctcagaatgggcagactgcctcctcaagtgggtccctgacccctgagtagcctaattgggaggcaaccccccagtaggggcagactgaaacctcacacagccaggtactcctctgagacaaaacttccagaggaacgatcaggcagcagcatttgcggttcaacaatatctgctgttctgcagccaccgctgctgatacccaggcaaacagggtctggagtggacctccaggaaactccaacagacctgcagctgagggtcctgactgttagaaggaaaactaacaaacagaaaggacatccacaccaaaaacccatctgtacgtcaccatcatcaaagaccaaaggtagataaaaccacaaagatggggagaaaacagagcagaaaaaccggaaactctaaaaatcagagtgcctctcctcctccaaaggaacgcagctcctcaccagcaacggaacaaaactggacagagaatgactttgatgagttgagagaggaaggcttcagaagatcaaactactccgagctaaaggaggaagttcgaaccaatggcaaagaagttaaaaactttgaaaaaaaattagatgaatggataactagaataaccaatgcagggaagtccttaaaggacctgatggagctgaaaaccatggcacgagagctatgtgacgaatgcacgagcctcagtaaccgattcgatcaactggaagaaagggtatcagcgatggaagacgaaatgaataaaatgaagcgtgaagagaagtttagagaaaaaagaataaaaagaaatgaacaaagcctccaagaaatatgggactatgtgagaagaccaaacctacgtgtaattggtgtacctgaaagtgacggggagaatggaaccaagttggaaaacactctgcaggatattatccaggagaacttccccaatctagcaaggcagaccaacattcaaattcaggaaatacagagaaaaccacaaagatactcctcgagaagagcaactccaagacacataattgtcagatttaccacagtggaaatgaaggaaaaaatgttaagggcagccagagagaaaggtcgggttacccacaaagggaagcccatcagactaacagctgatctctcggcagaaaccctacaagccagaagagagtgggggccaatattcaacattcttaaagaaaagaattttcaacccagaatttcatatccagccaaactaagcttcataagtgaaggagaaataaactcctttacagacaagcaaatgctgagagattttgtcaccaccagacctgccctaaaagagctcctgaaggaagcactaaacatggaaaggaacaaccggtaccagccactgcaaaaacatgccaaattgtaaagaccatcgaggctaggaagaaactgcatcaactaacgagcaagatcttaactcttaaggctttatagtatgtcttgaaatcaggttgtgccagtctttcaactttgttttttgttttttctctttcccaagatcgttttagctctcttagatcctttgtgtttacatatagattttagaattagtagcttgtcagttctacaaaaagctgcttggatttgaattgcaatagcaatgaatctgaagatcaatttgagaaaaattgacgttcttaacaatattgattctcccattgcataaagctagtaggctgggcgcagtggctcacgtctgtaatcccagcactttgggaggctgaggcaggtgatcacttgagttcaggagtttgaggccagcctggtcaacatagtgaaaccccatctgtactaaaaatataaaaattagccaggcatggtggtgggcacctgtaatcccagctacttgggaggctgaggcaggagaatcacttgaacccaggaggcggagtttgcagtgagccgagatcacgccactgcactccagcctgggagacacagcaagactctgtcaaaaaaaacccaaaaaaagtgtgtgtgtgtatatatatatatatatatatatatatatatatgactttttaatttttctcaaatgacattttatagttttcagagtagaggttttatacattttcacctactttctgtttttcaaggctactttaaatgatttattgtttttaaattttgtttcctactgtttcttacaagtatatcgaaatgcaatgatttttatatattgacctgtgttccgacaaaatttattcattaattctagtgggctcttgggaagacattttagtatttcttatgtgcacaattatatcttccttttcttgtatggcttttttttttcttgcctgttaaactggctgggacctctagtacaatgtgtatagatgtgtaagagcagatatccttccttttttcccagtctcgggaagaaagcatttaatatttcaccattaaatatttcaccattaaatattatgctagatgtaggttttcccataaagtgtctttatcaggttgaggaagttttcttttgtagtgccactaaattaacttttcttaaatattcttagttgctaataatttgtctcataatgaaatgaaattgacaacatgaaattgttttctgctcttgagcggtcactaaatcagtagattgtgatatgtttcacttcagagggtttatttgattcttggcacttagaccaagttgctttaatactacagttgatagtacatttaaagtgcattggtactgtattttgcagcatttggcattttttagatgataagtaattaaataatcattgtcaattgctagataggacttttcaaagcactagtgaaatactcagtttagtttagggagatttatagatgactaatactgcccttcatttgaatatattaggaggttaattccccctcccacaattgggaaatgcattttctagctttttcttgtgaagtttgtgtattctgagcttcacatagactgggtgttagtgtttttcagtcctttgatagactcttttagctattttatgtgctttatattaaaattatgttaaacacttatttgttcgacacctattctgtgtctagcaccgcagtgtaggcacttgaaatgcaatggcaaagaaagcagatgttgctctcctcatgggacttgtaatctagtcaagaagacaaaggtgaatgaagtaaataattataaactataatatgtgtagaatctggtctggttccctgtgagaactcaaggaagatttcccagaggaagtggtgttaaaactgagacctaaagattgcatctgaattaaataaaaagaagtgtgatggcctagtaagcagttataaatatcctgaggccgtagggaacatagcaaatatatttgtgactggtgggtgagggatatgagttggtggggaggtagaggtagtttagctaatcctaaacaacatagaagagaagtgagactggatggatgcatagagaccagtttttgtagcacctattaagatcttatcataagggcaatgtaaaaccagtgaagtattttaaaacagaagcaacgcgatctggtttgcattgtggaaaaaaatattttgtctcttttgtgaataatggattgaagagagactacaaacaactcaaggccacattggaagccactacaggtgtctaagcacaagatgatgctggtttgctagggtaatgatagtgaagatggagaaaagttaccaggtaggagaagtagttgaggaaataggtaaattctgaatgcgtaagccttttggtacatttttaaatttattgaaggacaacaggtttactttagtctctatttgtttatttttttatttttattttttgagacagtctcactctgttgctcaggctggagtgcacggtggcgtgatctctgctcactgtaagcaattctcatgcctcagcctcctgagtagctgggattacaggcgtgcaccaccatgcctggctaattttttgtatttttagtagaggcagggcttcaccatattggccaggctggtcttgaactcctgacctcaagttgatctgcccgcctgggccttccaaagtcctgggattacaggtgtgagctaccctgactggtctctatttgtttaccttctttgatactatattgcttgtatagttctctttgataggcattgcctactgtttatcctatttgccattgatggctaatggtcctttctggctttgctgtttaagttctattgaggagtagtttgaattgactggatgttttaataatgaaatattgataaatataaaagaataaaagtattatatatatatataaagaataaaacatatccaatatataaataaaaaattaaatgcctgtgatgtatcatgtaataaagttatacagtttgggctgtttcaagtaattccatataatgattcctcctagatattttctgattagcattcatcagttgaaagcagaaggaggcagctgatgattgtaaaaaaaaatggcaataataagatacctaatgaccccgaaaatgaagcgaattatgcctaatttaaaaacaaagaatgctttatataggaaactatgtaaatatatattagtactcttttgtcagtaaggcttcacattataaatgtgttcatattataatcctatcggaaaaaagtatggtaagaaagaaaagtaaggaagctagcacagtcagccaggtgtggtgtctcacgtctgtaatcccagcactttgggaggctgaggggggtggattacttgaagtcaggagtttgagaccagcctgaccaacatggtgaaaccctgtctctactaaaaatacaaaattagtcaggcgtggtggtgcatgcctgtaatcccagccacttgggaggctgaagcaggagaattgcttgaacctgggaggtgaaggttgcagtgagccgagatcatgctattgcactcctgcctggtcaacaagatcgaaactctgtctcaaaacaaacaaacaaacaaacaaataaaaaacgaacaaaaaaatgaagtagctagtacagtcagttgctaaaaagaaaaaactactttgagctgctgaagctttttttttttttttaaagttggtggaaagaaagagggaggcttagtgggtcaaaggcactgcttctgaaactcttcatctcatgttttcatctccctttagaagcatgtgcaattatcaattatttatagtatttgtagattcaaatagctaccagtgattatttttggaaacaaactaaagggatttagtatgtgaaattttctgaatgatattttttgccattttcctaattttataaatattatgattcaaaactgcttcaaatatgtgtaatggctatactttttcaatggtttggtagtaaagcttagcatttaacttttctttacaaggaatgtgggacctatctacattcacgaatatttatcaaatataattttattttaaatatttatttttcttgtactagagaatatctgattttgtttgattttaatactattatctctgaaagtcaaaatatttccctataaaataggactttctagccttttgtataaaatttaaatattgccttttcatccttaaacatagtattcacttgaaaatcgttattctaatgtatcttacaaacgtctcatttctggtaatgagaaatacactttctgttctatattcacctaaacctccaaagattttggcagtaacatggttttctctgaaaggaagttcaacatggaggaaagaataggaccttctactctttaggaataatttttttccaacttttattttagaatcagggagtagaaatcatttttacaattaataatacataatagttatatatggggtacatgtgatattttgatacatgcatacaatgtgtaatgatcaaatcagggaaattgggacatctgtcatctcaaatgtttatgacttattgtattggtaacattctaacttctcttccagttattttgtaatatacaataaattgttaactataatctccccactacaaccactagaacgtattccttctatttgactgcatttttgtaaccattatccaacttcttttcattcctttttccctacccttcccagcctctggcaactgccattttactcactacttcaataagatcaacttttttatctcccacatatgagtgagagtatgcaacatttgtctttctgtgcctggtttatttcactgaacataatgtcctccagttccaatcatgttgctgcaaatgtaagaatttcattcttttttatagttgaataatattttattgtatatacatattgctttttttccccacctgttcatgtcttgatggacacttaggttgattccgtatcttggttattgtgaatagtgttgtaataacatggtagtgcatttatctgtttgatattgctgatttcctttcttttggatatatacccagcagtgggattgctggatcatatgatagttctatttttaaatttttgaggaacttccatactgttttccataatggctattttagttttacattcccccaatagtgtatgagtgttctgttttctctgcatcctcaccagcgtttgttactttttgtctttttggtaatagccatattaactaggtgagattatatctcattatagttttatagttttgatttgcatttgccagaggcaaaatgagtaatttttcatataactcttggcaatttctatgtcctcctgtgagaaatgtctattcagatcttttgctgactttttaatagtttttttctgattattaatcacttgtcagatggatagtttgcaaatattttcccattttttaggttgcctgttcaccgtgttgattattttctttgctgtgcagaagctttttagcttaatatcatcctgtttgtctatttttgttttgttgcctgtgcttttgaggtcttactcaagtagtctttgccaaaaccaatgtcctgaagcatttcccagtgttttcttgtattagctgcatagtttcaggtcttacctttaagtttttaatcaactttgacttgatttttgtatatggtgagagataggagtctagttttatttttctgcatatggatatccagtttttccagcagcattgatggaagacactgtcttttcaacagtgtattttcttggtgcctttcctgaatttaggttgactataaatgtgtagatttatttctggtttctctgttctattccattggtctatgtgtttttatgccaatatcatgctgttttggttactataactttgtagtgtatttggagtcaggtagagtgatgcctctagctttgttcttttttcttaggattgccttagctattcagggtcttttgtagttccatacaaattttaggttttttttttctatttatttgaatgtcattggtattttgaaagggattacattaaatctgtatgttgctttgggtgatattgtccttttaacaatattaattcttccaatccatgaacatggcatatctttttaatgtgttgtttggtttgctagtattttgttaaggatttttgcatctatgtttctcagggatattggcctcctataattttttttgttgtatgtgtccatgtctgcttttggtatcaagatagtgctggcctcacagaatgagtttggaagtattctctcctcttaactttttaagaatagtttgagtggagttggtattagttcttctttaagtgtttggtagaattcagcagtgaagccatcaagttctgggcatgtctttgatgggagactttttattattgcttcaatctctttactcattattagtctgttcagattttctatttcttcatggttcaatcttggtagattgtatgtgtccaggaatttagccattttttctaggttttccagtttgttggcatatatatttttcacaagtctccaatgatcctttgtatttctgtggagtcaattgtaatgtcttttcatctttgattttatttatttgagtcttctttcttttttgcttagtctagctaagggtttgttgattttgtttatcttttcaaaaaatcaagtttttgttttgttgatctttttatgttttttaggacttttaagaataataataacctatttcggtcccattttcacaagtctgtgattataggcaagttatacttactatctctactatctgctttcttcatttggaaaatgataatgatgatacctacttcatagagttttaagatttttataaaggaaaagtatataatgcacacagcacaatgcttggcatatagaaaatactcaacaaatgttagttatcttccatttttatcttaattttcctggtgtattttaattctgacataatttgtaaattagttctaagtcacttttaagaaaaatgctgatcccctaagaagtttaaaatagtgaatgtttgtctgtagtaagtcaaaataatcagaaatgttttaatgtccatcaaatatttgattaaattaatttgcattgttctaatttaggtatgtgtagctcaagcacttagaacaaatttctttgaccatttgaccttttttttcatattaggataaaaagtggataagcaatgtttttatttattctaatttctatgctcttttgagatcatatttgaccttcagtattgctctgaatagattttggtacagtagtgttagttctattgctttgtttgtacagttaaatacatcaaactcagcaattttttgtgggggtgatggggattggagagattagtaaatgatttctaagttctgttaattaaaatgtaactatatattttagagagaagttagtagtcatatcactttagttcatgaagacttggcaaatttttaataattaataagttttttctgccaatgagcattagattactgctgactttttagtgtcatagtaccttgtggtagtttctttacagggtttacaggagtatggcagtttattttttctgtcttgtccatacgaaataatctttacaaatgctataaggagaataccttgagaagttcataaatgccttaatatattataaagatcggtcagttccattgtcttcttttgtcagtcttgatcggagcttgccgagtaagtctataagcctgcatgtgcctggcaactgttacctagtgacagtttcagctgcagtagccattggctgtgctgttgattggggcaggagggccgagtcacctttctgatggtgagtttttctgcatcagcccaggatgaggaggaggagtagggcttgggctcaggtggagtcattgatgctgagagattgtgaagaatatactgacagcatccttgtagctgcatcacagtaaatcggacttctgaatcaagcagcccagcctagcagctgataagagtgaatgtaggtgagaagcattaccttattcctgtaacaagagaactgttttgtgataagtgaaactaggaatgtagaagaagaaatatcctatggctattataaaagaagaaggacttgcctgaatgacttggtggtgcaccagaaaataactttcagaagaatgctttctgttaagctgctgcattgttcctggaggaaatgttatttctaatgcatgttatttcttcaaaagataggataacaaagaatgacaggagactctctgaaatgacttcacttttaaaaaatactttggcaaatgttaacctgatatcaaaatgaccttggaagcattttggatggattctatcctggcagccttgcaatgtttcaaactctaggatttaaagttcatcttgatactttagaggtattttaaaataagactatcttgcaacctacctaatggcccctgtgttaattgagcacttgctcaaaatagagtacagaaaaatagaagaggcattttttaacatatggctgctacataactgcaaatgtaataaacaaggtaattttccactttcagaagatatagttgaagtaatgatttaatgtgttaaatcatctactgaaaatagaaaaggtatagcaacatagaacatgaagcctattagaaatacctaagtaataaataatggcagcatttctggtcaaataagctcggagtatattggaaagttttattgtctaactttatatttacatatatatgtgagatatgggtatacagttgcaaaggtgagaaataactgtgagctacatattttattatcatgctccattataaggaaggtggtatatgaaataacaaatgttattttaagttatagatgccaaattaatagcaaaaataattcattttgaaaaggaagaggtataagttacgttgctgttagtaccaccagtaactgtaatggattaaaactgctttcatctaaatgctttaaaaatgcatgcagaattaaaacttcagaagtttattacattttgccaggtgttaattcattaattcattgtatattctcttttctattggaaaatacttttttctcatgagagttatagggcaatctggagtctgtttgttacctctattctgcccatgtagagatgaatcttttcaaattaactttgatagagttgtttttcttagattttagaaaaatgagaaataggttataaatttgaccccccaacatcaatccctgaactaagcccaaagacactctttgccacaatgaactttttcttagcttttcaaccaaatttgagatcttaaattatttaaaatctaaaatatgaatgcatttttcatcatagataaagcaggaagcctgagacagtttcagagtttttcttttctcattctttccagttgctccctaagaaactgcctctcttaggagaacagcccacagaagcttttcttcctttggcaattcattttttttctttttacagatttaatttttcatagtgcaagataataagaagtctattttctctagaagtgccttatgtctgcaaaaagttctttgagggcaccagaggaaactaattagtgacctcttttcacctcctttctagcttatccccttctctccaccccttaccgccccccccccacccccccgcccgaaagctgaggtgtgtcactgctgaactgaggctggtgaagagacttgagcactctctgggactctcagctgtgacagaagcactgacactgtctactgaagcaggttctgaaacactcatgtgcggtgtttaacagatgctgggcagggcatctgcttgctgtagccaagtctgcaggtgtctttaaatttccaagccatgaatgaatccaggtggactgaatggaggatcctgaacatgagcagtggcattgtgaatgtgtccgagcgtcactcctgcccacttggatttggccactacagtgtggtggatgtctgcatcttcgagacagtggttattgtgttgctgacatttctgatcattgctgggaatctaacagttatctttgtctttcattgtgctccactgttacatcattatactaccagctatttcattcagacgatggcatatgctgatcttttcgttggagttagctgcttggttcctactctgtcacttctccactactccacaggtgtccacgagtcattgacttgccaggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgtttactttatgctcctgctgcctttgttgtctgcttcacttacttccacattttcaaaatttgccgtcagcacaccaaagagataaatgaccgaagagcccgattccctagtcatgaggtagattcttccagagagactggacacagccctgaccgtcgctacgccatggttttgtttaggataaccagtgtattttatatgctgtggctcccctatataatttactttcttctagaaagctcccgggtcttggacaatccaactctgtccttcttaacaacctggcttgcaataagtaatagtttttgtaactgtgtaatatacagcctctccaacagcgttttccggctaggcctccgaagactgtctgagacaatgtgcacatcctgtatgtgtgtgaaggatcaggaagcacaagaacccaaacctaggaaacgggctaattcttgctccatttgaagagagctacatagtaaatcaaatgtaatctgacagtggttttggatcatattctagattcatctggaaatttgccatcagagaaatatttacttgaatagttgactgtaaaatgaagtatgagactaaaggtttctctctttttttttctttttcatggaagaaactaaagggaaggatgtatagagggttagctcatgaaataattatagcatgtgagtattagtgtgcagtaataggaaaaattaagcactgagatgaaaaagaatatctcaaatcttctgcaggacatgagcaagccccttggctcagcatttctgtctttctgtctgactgtaccctgcctctgtctttctcattttgtctatgtttctctcactctttgtggaagttattacttacataaactgccctttgtagaaaagtgctacatattatatatgtggtaaagtataatcttttgcatcaaagtgtacctttaatcacactaatctataatccataagtgatctcttcatggaggatgcacagtaagcattgcattttattatttgccaaacaacccctttgcttgtgtttttataatgttctctgcagcacagtttttctgctataaacaaatagaaacagtatttttgtttcttctgggtaaaatgacatttgcttttccctggtttcctaacagtctcctgttttttttctctctttttcttgatctgcatccattggtaccttactttagaagtgtcttagctattgaaagaatctactgtatagagcatccatgatgttaaataatgtatttcttccagcaaagcaatctggtagcttattaaatatttttaatggcttttggaaacatttttatctggttccttttaaattagttcatgtgcttaaaagtgatgtcttttttttgctatagtaaagctttgtttttctttaagaaaacccactagtaattgtaatgcagatgcaggatactcacccagcagtgaggtattactcttaagggtacttagaatgccctttttaaaaataaataaataaaataaaacatgaatcttttttgtgttaggtctacgatagcttactgttgtgtccactagtcagtcatttgtgtgatatgcgtttgcacatactatgtttttcacagcaaagaaaatgtaaattatgttatctgtgcctaacgttttcttagcaaaatatatagatcaatgttgtttaagttgtcaacattggaaaaagtatatacaaaaacctattttaagagaaaaatacttttgtgtaattgttatttagatatttatattagacaaagctgcatttttagtgccgctgagaatataatatacttaattatcaaatacaggtaagagctgacagtattttcttttgtaatgatctgttttcaaatgcagagattaacttatttttttgcctgctacatggggttgtgtgataaattgtcaggggtttagatgtagcaaagtagcatttggggaattagcgaagcaagtatgagcagtaaaacatctaagtattacttttttaccataagtttcttgcctgaaagatattttaaaatttatatcaaactactgagtatttttcttctcagcatttttgatttctttgttttatgaaatgcatttaataaaatgtgcctatgactcttcaaattagaagccaaccatgtttgcaccctggtggtttggcttcaaaggtcttttagtagaaatgttgtcattttattgaggttgttctgaacccctgtatatttttaaacatgtaagaaagatttaaaataaagaataaaataatattctatatatcaaaatgagactttgcctcagtttaataaaacacttaggacaagagtttacttttttgggaatcaaaatctgattgttttatacttctgtagcttgggtttatatttattcttgtcccctgtttgccagtggcatcttggtttaaatgtgccttttaaattcagaccagttcaaggaaaacaaagttcaaggaagtgtactgctaacatttcagatatcacatataagacttctaaattatacatattatttgggaatcgtatttttatttctttaaggtataaatatagttagaaaggacccagtggattctgtgtacagaaagcctgaggccatgcttactgcattttccccttctggcttttccccatagtaattaataacaattatatgccaggctcactgttcacttttacatgtgttataccttaaatcctcactacagccttttgagataatagttattatttccactccagagataaggaaacgaaagaaaaatgattattcgtcagttaactagtcaatggcagaggttcccgcccatccagtaggcctgggccaaagcctgcctgcttcaccggtaggctgcgctgctttcatttcaaaagcctttaaatttttgtacctctgtctgtaccttttccctacaatatttctctgagttttatttatttttttctcatcgtaagtcttttgcttgagttcttttcttgtcttgtgatatctttttctttgatcttaaaagtttcttttattaaaacagcaatctgataagctcaaacttaccagtttagtctataatcaaactgaaattgttgatattactttggtttacttttgttatttcccttgaatacctttttgaaatctctatcaatttctttttggaaaaaaattgttttgaagaggaagagtgaaaagaaaggctttatcataggctgaaagaggctgaatgaggcaaattctgagtttatttatttactatagtattttatatacaactctaggacaaaccacttaacttccttttatcatattttaatgtgtttgtataataagctaatccttattttgaaacctctctttttaggtaatgtgttttaagaataggaagcataaccatttttctcatcattatattgtattttgtggtaattatccagtttggctataaaagacagccaaaaaacaatgcattctgtattctttttcctaagggttctattatttgcatagttgtttctagagttatagagtgttggaaagcttcataattgacactattagtatatgaaacttgggctgagatccaggccctcataaactgcttggccttgggtaagataccaaatgctccaaaaccttagttttggcattgattaaaaaatcttaagtcagagacttgtagctctctgtttagctgaatttgaggactaaatgaaattttgtagtctgtgtgcccagcatagctcctggcacataaaaagtgttcagaatatggtagctgctgtttttgttttgttttttgtttgtttgtttgttttgaagtggagtcttgctctgttgcccaggctggagtgcagtggcactatctcggctcactgcaagctccacatcctgggttcatgtcattctcctgcctcagcctcccaagtagctgggactacaggcagctgccaccacgcccagctaattttttgtatttttagtagagccggggtttcgcggcgttagtcaggatggtcttgatctcctgacctcgtgatctgcctgccttggcctcctgaagtgctgggattacaggtgtgagccactgcacccagccggtagctgctgttttgttatctttgtgggtgccatatttattaacatcacaacttaaaggtcactaatcccaattcaaacaggaataaaccattgagcattagggttttctaagatagcatttctttttgcaaatctatttaaattcaaattttggggttaaactcagatatttcaagtatatttctgaaagctcgtttcccaggaatagttattcatgaagacatcgtttgagattaaagatatccagcaagcggatgttgtgatgagacaggcatgattctgaggttaacctacctcttactttattacactaaatatgcttaaacattttattctcgttagggaagtaataataggaaggattgtccagggatgtcttgtcatttgtctttgcactttaattttcctcatttattaaaatgggatttgaagtattttgtcatatatctatttcttgggagaaacaatgattaataagctgatttgctccatagataacataaattatgtgaatttaaagataaatgaagttgccttaaaggacctttcctctttttctccccacgctagaaggtaatcattagatgtgaaaaagatacaattacataataagtagataaaaaagatttagatgtgagaaatctgctggtataacattctgagcatagatagcatcatgtatgtgtaggtagggccattttggtgcataggagcatgtatgtgttactcagtcagtgctgtactctgacgtgtaggttccaaaagatgctcttttccttgagcagaaattaactttattttagattgagtgatatgtagaaagtggtaatcctgtaaccaaatacatagatattgaggaaaacaaaattgctagagtagagaaaacagttcctattttatgatttctcataaatggaagtttgattcagtgctagtcttgctctgtattttaaaatattcataacttttttcaatagtaaaagtgtttttttaaaatattaacatgatgtcattaaggtttttcttcatgactattttgttttaattttttacaatgagcattggtaaaaatttcttttataatcagaaaaattaatatttggttaaaaagaatgctgaaggctgggcgcggtggctcacacccgtaatcccagcactttgggaggccgaggcgggcagatcacgaagtcaggagatcaaagccatcccggccaaaatggtgaaatcccatctctactaaaaatacaaaaattagctgggtatggtgacatgcacctgtagtcccagccactcgggaggctgaggcaggagaattgcttgaacccgggaggcggaggttgcagtgagccgagatcgcaccactgcactccagcctggcaacagagtgaggctccatttcaaaaaaaaagaagaagaatgcggaatatttaaaaaatattttaacatttcacaaaacagcttatgttgatagtacaaataacactatccaataatgtctcaatattgtcttataaagataggttatatagtttttctgagttctgtaatttttatttcaggtagatttttacaataaacttgacaaccttctacttgcaatagtagatgttcttgacttatttttgctttaatgtaaacagtttgaggtattacttgatgaatctgaaatggatctcaatcactgtaggattttttttttttttttttagacagagtctcgctctgttgcccaggctggagggcagtggcgctatctctgctcactgcaagctcgcctcccgggttcacgccattctcctgtctcagcctcccgagtagctgagactacaggcgcccaccagcactcccagctaattttttgtgtttttagtagagactgggttccaccttgttagtcaggatggtctcgatctcctgacctcctcgtgttctacccgcctcagccctccaaagtgctgggatgacaggcatgagcgaccgccccggcccactgtaggatttttaaatgcatcattcatggcacctttctgcatttttcacacctttaaacaacaaaaagatggctctgcgttaggaaataggctccagctggtacattacctgcatttcctacataggcagaattctccaaagaacatatttataattttttaatggtaacttttattctgcttttatatatgactttctccaaaggtgaagaaaataacagtaataaatttagcaggagtctgttatgtctgataaatatttaacatgaaaggcacatatcaccaccttcattatagtaaatggagccaaattagtttttgagattctaaaattctaaggtttaaggtgataaatatcaagaaacgtagtacataatagtagaattcatgaatgaaaataatttgcaaaaatttgaaaacttccaaaaaggatattttatacaaaagaaatacctatcattgacttaaacatttgaccccagttttattttattttctacttaagcaattgtaaataaggttgatgccagttaaaaatggcaaaatatatattataaattcaattattttaattgcaaggcacaaacaaggtacagagttgtatgacctgttctttaaatttttaaatttatttttgaataaaatgtggactgtagcaagagatgtgcagtaattttgtctgagattatacatgacacaaagaatgtttatgtacatactctgtaaagtatagctttaagatgtttacttatgttcttaatagagttctaagtttaatataattattagtagatggcgtatttttatagaaataacatcttcacaattattcatttactttttcaggaattttataattaaaaatgctaaattggtaagaaattattggaaaacactgcaagttgaaatttggaaacacttataacgcttttgaacatatataatgctcttgacattataaacgaggtctattctaaaagcttctgtgagtaaacactatctcatttcacatataggaatctgagataagatttttaagtgaccctaacaagatcatgtcgtttgacaaagatactactgacgacgtgtcttgtgtgacaataatattgcctgtgataaagttcttgaataatgtatttatagatggctggtaatagagtgacctgatatttctttcttgagaagaaaatgaagacttagttatttgatatagaagaaattctatgtgaatttttttcttttaatttgtgacataggaaaaattattttaaaattaactttatgttggaggtgtgatttttgagatcatagaaatttttaatcagatgtattatcaggcttgatcagtgttttaatatttcttttaacagttttttatccatagagggtaataaaaaatttacctctccttttgaaaacacagcagtcatctactgaatatattgagatatgtagaataaattgaaacagtgtttgctgtgtattctaaacactataaccttaatgatgaagacatcaaaatcacgttatattcaagtacctacttttggaaagtactaattttatagtcatatactttatgttttgaatttttttttgtaatagatttgcaatgttgttgagtcatcatcggttggatttttctcagtcattatgatggacaagattttgatgtttcaggctatagtgcttttgtatgtttgtaatctataaattatcagtcagggaatcagtgattagtttgaattagtgataaataaaaccttttaaataagtaattcagttttatttcaatgaaataaatatagttacagaaaaattaaaggaactcaaattaggcaaacacaaaattgccttgtaagtgtccttagaggaaatctttctttaagtcgtttctagtgtctgtatcagttgaataaaaatgagttccactgagttatttgaaaagtttattctcttaaatatgtaaaatttccataacaatttatgctacttatttaaacagtttgtaggatgaatcattgcaaagtccaaatttggatttaatctgaattaaccagatatttttgcatttcaaatctataaattaggtcaataaatatttattgactatgctatgttaagggcataaattgtggttctataatagtcctggactcttaagagtaactcattgaattgtgtgaatccaataagcaggaaaattaatttctagaatttgagggagagattgcagaaaagtcataggaactatgcaatacattgtagcgttagagggattaacgcattttagaatatgaattggcttcaatatttagccatgtgtttggatgctatagttctaaaggataccacaggatatttgagaagtttttgaagtgaaaggagagaaaatgttcaatgttcagattagtacaaaagtgttgtggggagaatacacaataactttggaatgcagtgtaagtaaaagaaaatattctttatgtggattatatctgattagagtaaaatcatcattttaggtataaattataagctttgagattaggacaataatattaacatgggtagaagtagcttgagggattgcacataggacatgttctaccaactcaggcatcatcttttttttttttttttttttttgagatggagtcttgctttgtcacccaggctggagagtgatcaccagtgtcacccaggcagtggagtgatcttggctcactgcaatgtcctcctcccaggttcaagtgattctcctgcctcagcctcccaagtagctgggactacaggtgtgtgccaccacgcctagctaatttttgtatttgtagtagagacagggtttgaccatgttggccaggctggtctcaaactcctgaactcaagtgatccacctgccctggtcttccagtgatgggactacaggtgtgagccaccatgcctggctttaggcatcttcttagaccactttttctagagttgttttcctaatatttgtcttgtgattacaagtgaatgtcactatatgcaggttattatgacaggcaggttttaacttctctgtcaatcaagttaatcatatgatgtaggcctaatattttgaataatagaatcactcattctttcatttaagtatttatcaggttgctattgtgtgccagggactattcttaattctgtgtaagataaggagatttctaagtaaaacagattttcagttctccaagagcacttagactacaaggggctatatggactttatatggataactatagggcaagataggagctgacaaattacagtccgctgactattgtagatacaattttactggaccatagcagcactcattcatttatatattacccatgggtgcttttgtgctacaatggtagagagtagttgtcatggaaatgttatgttctacaaagcctaaatatttactttacagaaaaaaatttttcagaaaaaaatttacagaaaaaaaatttttttctgtacagaaaaaaatttgctgatgcctggtatgagacattataatgccctttgtatgctactcacagtagaatgttgtgcttttatgtttgctaaaggatctcatacgaaggagtgatttcaacctgattcagtcaggcatcaggaaaatttctagcatatgaataaaaacctagatattgattcccctgtatgattccagtggtttttcagctatatacctgtctgtaaatgaaacacagatctactttttctaattagttcttactattatatagctaatctacattacttatatttagatttttcctactcaggtaaagttctttgcatatcaaacttagtgtctagtttctttatttaactactaatataacataatcgtattttacctttaagcatggagtcagtaataattaacattggatgtagtcttcaaacttcagaagcatttattaaacttctcatcaataaatgataatctcatagtctaaaagagttaatttacttataagtaagcatgcctcttttgtagtactccaataggccgtaaaacaaaaaactaaaaaacagaagatatagctgtataagagttaaatttacatgcaactctaaaacatatatgacttaagagaatttataattcaacaccaatgtatgacattattaataggctcttggtaatatataagttagaaaataaatggttatagtcgtacacttagctaagatgtattgcagtgctaggagttttatgttttttgtcattgtcaactaatgaatgaaaatacaaagcaattttaaagagccacaatttatatttacacaaaattaagccattttaaaaatcttgatgattcagttaatcagaggtatttgatacattatttaataatatttgctttggcagtactattgttttaaactattaataatccattgggaagttttggttttcttcaagtttagtaaatcagtaagaaaatgaataaatgatcttgatgtttttcttgaaaatacagttcacggagtctgttagaataaaaggaaacacttacacagttgtccctcattatctgtgtgggattggttccgggatgccccaaggataccaaaatccacagatgcttaagtcccttttatataatcacatacaataacctacacacacccttccatatactttaaattatctctgagttacttacaatatctaatacaatgtaaatgcaatataattagttgtattgtttagggaatagtgacaagaaatgtacaaatacatttcaagtacatgtacaagtctgtatgtgttgaacacagatgcgaccatccatttttttcccctgaatattttcaagcagtggttggttgaatcgatggatgtgaaccctatgaatatggaggactgactgtatatgcttttatgctttcagtactgtttaaagtcactgagatagtagagccatcattagaacccatatagtcagagtgaataccttaataatgtttattgtatgttttcccaaacaaatgaatagaaaaattttatgtaaaattgtgtattaaaagattgtaaatggtcaggtttccattagtttgattttgagagaaagatttcagagaatcattaggtccttctgcctttttcagaccagtcaacggactgaagggtcttaagaaaagacctcagggatttcttatagagataatttgagtgacaaggtatattgtttccacgtttttatatacccaccagcttgcccttccataattggcaccttttaatttctgacaatgttgtaaaaggatgagttatagcaaatcattattaacttatctcaaatgtttctaattctcatccctttcacataattaacttcctttttttcctcctcattcatttagttatttttatttttaattgtcaaagaaatagttgctcataaaggaaatttaggaaatgtttaaaatgataaaaaagagactaaattacgcatagttctctacccaaatataattaggtgtgatgataatgactgttgattttggttttcttttcttccatttcccccctatggattagggctttttctaaaggatttttaaatatgggtatttataacttaaacatttttccatattattgcatattgtttatgaacatttttataaataaggcttttccacatttagtattattttcttacaatttttaaggaagaaatactgaagcaaacagtgtgaaggtattttaagattatttatgtatattgccaaattggtttcccaaaggagtgatccagtttatcttcacactaataatgtatcaaactatgatgattcattgcaaacttgctagcatcaattctacattaataaataaattaaaggaatttgattttttacttatttcttcctagcccctatagggaatttgtttagttctttgcaattttttttcttccctacactaaaacagatagatagataggtaggtaggtgggtaggtaggcagatggatggatggatggatggatgaattaggatggatctgctgagcctcatttaaaccaaattgtctcaaattctttatttcagaagtctttaagctcagataatcttctcactattgttatctcacaatttactctgtgctactgctgctttgttgtttaagaacactgaattctgtcagtgctgttctcccattattactgctatcttcagcattgtctgtttcattgtatcttgtgtgtgccacacagccacctagatattgcgtttgagaaaggtttcgaaatttttttctattgtattcttctgcctttgttgcagtgataatctctactggcctttcaaggtaggggaggatatgttcctaagcagaaaattttgaggcctgtgtccttgaagagtttgtgaacatcaagatttcagtagttaagcactgaccccaggcctggtattgatacttaggatttccctaacctgcagaaccatgggaatagtatccatagtggtagagctgtggtaagcaaatcagcttttacgttagaaaagtcacacctggtgtgattgtctaacaagcaagcatgcttgcaggtctgtactgtttctcttctttatgtcttttacatctctctggttcctcagagtgctttgtatatagtggctactcaattatttgttgagccaagtacagagtgctctctgtatagtaagtcatctatttcttgagccgaattgaatttaattgtcagagttaacagtagttcttgggtctcttccagtagttctttcacctccagctcacttgagggtatggttggactgaagattacttcaagattattttccccagtgccttgctgttaccaactggggaagctgtggaaaagaatattttaggagagttgaacgatgatttaatatacctatcatttaatatagcttcccactttaattgaatttttccttccaaaattgacattcagtggacttataggctctttttgaatatgcgtcttaaaggggggtgaatacactttggggtagctcaggttttttccataatgtttatttatattcagctgaaatgaatatatttttggcttattcccattgtgattatataggaagaatgagaatttttgttttacccaagaaccttctgtataccttagtaaaagcattgtttctgtccaggcttctcttggtcttgaaccattcttgtaaaatatggttttgaagctcatcaccaacttttccctgactatgctctaataatacttcttttaatggtgctcagggctgaataaaatgttacgtgtgtgatatgactagtaacagatgagagcgagactatcattttcccttggtttataaactattctgctatttattcaggccagaaataaattacatattttggtagttatagtttatcctttaatatatcaagtttgttttcaataaatctatacatctgttttacacctgcttaatttatattccttctccatatatgtacaatggtttttttaaacaaattttacattgttatctcccttcaacttcatcttgttagagttggctcagtttttccagcatttctgaaacctttgttccatttctaatacagtcattaaacttttgacttctgcaaatgtgatatacattttttttcaacttttattgtaggttcaggggctatatgtgcaagtttattacttggggaaatttcaagacactgagctttggggtaggaatgatctcatcaccgaggtagtgagcatagtacccaataggtagtttttcaaccctcatccccttccctccttcctctagtggtccccagtgtctgttgttccaatctttatattcacatgtaccaatgtttagctctctcttataagtgaaaacatgtgatgtttggttttctgctcctgagttaatttgcttaggataatggcctctacctacatctgagaacaggaacagatgcttctcaaaaattctcaaaagaagacatttgtgcagccaaaaaacacatgaaaaaatactcaccatcactggccatcagagaaatgcaaatcaaaaccacaatgagataccatctcacaccagttagaatggcaatcattaaaaagtcaggaaacaataggtgctggagaggatatggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttatagggacatggatgaaattggaaatcatcattctcagtaaactatcgcaaaaacaaaaaaccaaacaccgcatgttctcactcataggtgggaatcgaacaatgagatcacatggacacaggaaggggaacatcacactctggggactgttgtggggtgggggagggggaagggatagcattaggagatatacctaatgctaaatgacgagttaatgggtgcagcacaccaacatggcacatgtatacatatgtaactaacctgtacattgtgcacatgtaccctaaaacttaaagtataataataataaaataaaaaagaagacatatgtgtggccaacaaagatatgaaaaaaataactcaacatcacttagcattagagaagtgcaaatcaaaaccacaatgagataccatctcacaccagtcagagtggctattactaaaaagtaaaaaaaataataataataacagatgttggtgaggttgcagagaaaagggaacacttatatactgtaagtgcttattttataacatctaatttgatataatccagatatttggatttttcagatgagaataatttattttctaagcttatactacatattggattacaaattttttaaaggctttctgtttacccatttaggaaccaaagtataatttaatatatgattatttgatagcatttactatgagaaatgttaccatttgtgttccataactacacttaaaatatggaaatattttaatacagatacctttagcatttgggacatatcttgcagagagattttcaagaatgccttttagtggagatttgtgaaatgaaagatagtaaacctttggggtttattgcagttctgcccaaggacaaatgaatgaatggatgacttttcaaagtaatccttacaaagttataatttgtgatgctttccccatccttaattaattgttctctttaactactttcacagaaagcccatctactctcaggaattaaactatcatccttttgccaagtattccaaaatagaactcttcaaatctggccttgtaccttttctccaggagcatatactatgctgccttcaatgagccttcttattctggggttttcataaaaattgaaacctgaacaatttcaaaggaaaatcattattaccatttcttattccttacactgctcatctctttttttgttgttgttttgttaatgtcattagtaccactgccttcttatatttccactttatagccctgtctgtttaataaatgttaattgaaaaaaagactacctggattttttttcttctaccttaatcactctttcatttagaatccagtttatacacttcattcttcactgtcttttaagattctttctctgggtaaccagatcacttttttttttgcttcttccatagaaagattaccttctttttttgaatctttatgtatagttttattatattctctatgtgctttgaatgataggaactttaggttaactgataacttatggatacagcctcctaccatggctaaaattcctttcataactagcaaggtagtctcttcaattattataaagttctgtgacttagaaaatacttcctaattaatgagccccaaaatcttcctattgatcctattgacataggatcaaatgtccaccatttgatcccatgtcatatctctgtggaaacacagaaataagtctccctttatgatgtagcttttctggcacatgaaaactactgttatatctgccttctcttctcagattaaacatctttatttctttaacacattgctaattcattcattcagcgaatatttattgagcattttttttgaggcggagtctcgctctgtcacccaggctggagtgcaatggtgtgatctcagctcactgtgacctccgcctcccgggtttgagcaattctcctgcctcagcctccagagtagctgggactactggtgtgtgccaccatgcccggctaatttttgtacttttagtaggctctgggtttcaccacattggccaggctggtttcgaactgctgacctcaggcgatccacccacttcggcctcccaaagtgctgggattacaggcatgagccaccatgcccggcctattgagcgtcttttgtgtgcaagtcattgtttaggtatttggaatctggtgaacaggaatgataaactcttttctcatagagcttacatccaaatagagataaaaagtattctatattaagatgccagcaagtaaaaaaaaataagataatttcagattatgattaatgccatgaaaagaatagaacaggacatcaggatggagaagtgatagagatgggaggcagcttctccatgaactttggtttacaaatatctcatcattttggttgccttccaccacaacaacatgcatggacttggcacttttaacatatgatcttatggtgaaagacttctgatctgctaatgtcctctgtgtacatagggaagtatggagcttcttagttatgtgggagatgaagctgtctgaactacatcagtgagggaactattaaagaaggagacacaaaaatttagaccttttgcagttatcgttagccgcagtattctcttgctcagtgtgctcttcttacagtgggatgagtagttgccatatttggacaatgtgcttcccttagtgcagctccacatgtaatcagctgttccaacaacaggtcaccttagctttgtagtgaacttatttaggtctagatctcacctgtttggaacttggaaaatcagtttattgaacatagttgcagggctttgcagttattccttacttactcagcacttccttctactttaatgtgatctttttctaatgtttttaatagatttagaaagcttatgttccttgttgtctttaaagttagcaaaaatgatgtatacagaagagtacctaggcaaaacttagtaaaaagctttcttctaaattgatttttctttatttaattagcacattttgagtaaggccataggtctacctcaaactgtacctgaacctgttaatatctagttcccattttttccccttttgtttcaaatattttataaaatgtttgctaaagacagtgaagcataggctgggcatggtggctcacgcctgtaatcccagcactttgggaggctgaggcgggtggatcacttgaggtcaggagtttgagaccagcctgggcaacatggtgaaaccctgtctctactaaaaatacaaaaactagccaggcgtggtggcacacccttgtaatcccagctactcaggaggctgaggtaggagaattgctttaatctggaaggcggaggctacaatgagccaagatcacgccactgcactctagtctgggcgagagagcgagactttatccccgcccccgaaaaaagagagagtgaagcataatggtttagcctgccctctagagtcaaactgaaattttttattcatcacttgttacctgtgtaatactgggcatgttacctaacccctctgaccgttggtttcctaataattgtattggctttatagggatatgtgaaataatgatatataaatcatccctcacaatgtctggcatatagaaaagtccaataaatgttagcagtagcagctgtagtcattgttgttcctggcccacagaaattaaatatagtctattttgggctttccagatctaaaaaccctttaaatgcatgtgcacacacacaaatatatacacagctagttttctgccatttattcttagggatggacacagtaaaaacatctttattttttacatcttatatgccatctgtctagaattttactagatgaagcatcaatgttaccatctctgaaatccatatgttcttattgaaagcttaaaatttgtcttctctgtagtcatttatcatcttttcaggggtctacagtttctcaaagattaataatactaccagatcttctagtagctactttgatatttctttgtttgagcctagttaaaaaaaaaaaagacatgggtatgagaggctgaaaataaagttgagaattgcctgggtatttcacttagccatgattctcaggtctttgttagacaaagagtaaaattatctataccagggaagagaaataacgtttctactaaataaatgtaaaagtaaccactaataaatactaaataacagagctactgtatgacaagtactgtaaatatatattcatgttatataatatgtttaatccttttagcaactccttttcataggtgagaaaattgagcatcagtatttaagtatcttggttatcacacttctactaagtggcggaatctatagaatttgaatccagctttgtctgacaccaaaaccatatcctttctacctaatatatgctacctcccctactatttggcagttaacgttatactgacatgtatattaaactgaaactatataaagagaagctaataaaggcttttttgctatagaagatatttctagagtcagagaattgatgaggatccatgagtaaacttggcaaatttccctcaataggaaaacgttagcattttagaaatattataaaatcgtgaaatcttagggttgaaagaaaccttcttgattataagttttgttttctggtcacatagcaattatatatgggattatattataaagaattaattttattattgctgtatctgtaatattttgagacttaagataaattattgcttttgtttacttatttatttaccttatttacttctttataccactgtattttaacagtttcttttatattgtatagtctaatggttacacaaacatttgtgtgtaaccattaggataaacaaatagagatttcagaattcttccacatgtaagtgatgccctagtactctaatttataatagagggattgttatggcttatactgaaatactagaagagagttttgcttgcaagacgtgtatacacataggctgatttcatattaagtaattctgctttattataataattcatcctgatcattgttcaataatggattcacattctaccttggttttgtgattgtgctggtgttgtagtataaattatagttattatgcacttcaaatttaaatgttattgataagtaaaattaaacactttccatatgacagcgtgggcagatatttttgtgtagtatgaaacagtgaatttcaaatagtagttaatttcttaaactaatattgagcattatatccctaaagataaaaaagtttaaacccagagaagaaatcatagacactacatctatatctacctctttctctctctctctctctgtaaaatcattccagtttcttctgcttagaacagtaagttccatggggcagggactttgtcactttccccactgtgtttctaccacctagtgcaggatgccatacgtggtagatgttcagtaaatatttgggggcagactgtgttggctttgcagataagtgttatactaaaaatgaggggaatatttttgcttttgagtagattacactgctaatcatttcagagttttgcttgaatatttctgggggtttatgtttttcctgctctgaatttctagatgccattagcaaaatgttttatacaaaagttaagaacagaacgtttatatttgtgttaagtatatgcttatgtgtatttatgttcatgtctttttatctattaatagaaaagtgcagctgttactgtattttgtcttatcaattgctaagggttaggtaagtgttgctttgatttgtagtcccaggtaataagtttaaatctttgtgcttatatataattgtatatgaatatattgctgacaagggaaattattttggttatcaaatatcagaaagtttcatattattgtctgtatctttctgataacaaggccactactttctagtaaatcaggtattttctctgatgttaattaatcctttaagccactaatccaacatttctcagaagtataaacgtggacagtttacatcagattcactggtaatgcttattaaaattacagattttcagcaactaccttagtcctcctaaatcagaatatctacaatgtgagtctctgaatttgtgacaagctctgcagatgatttctctgcaatcagaagtttgagaatcatagtatgaaactttcctggaagtgtctttgcccttaggaggggttccatcctggaagctctacagaaaaaaatccctcactataagctctctgcccatttaagttccagagtagtcagtcttaagacactgattgtgtcagtttgaattacaaccaaaggtgcattatttccaaaagctgttggactggaacaaaacaagaacatcaaaattgctcactagaccaatattgaaagcagacaaaatggcactcagttccagttcctgacaacatcccaggaaatgtctcagctgccttcactggggattgtcactgccaaaaatgctttaccctttaaagcctcgtggggaactaggcactgtagagctgagctgactggaggaaaaaaaaaaagttctacttttttcaggtctacaagagcagagctttctctggtactatgagaatttcagcctaaaaattccttgtatatgagatcttgaccatatgatcaaatcctctctacagccatgacccatcttgaattattttaccacttgcacagggctactactgcattttgcagggttccaaatgcatctccccatctcgcagaatagatatcattccatgtattgatccatctttttctcacttctctatcattagctataaactgattttgaatttcagggtttaaatcaggaactcttactttctagcccctcaaaagccagtttagaaaaaatgtaattttacatatgtacattctatgtaaatttgtttgtatcagagaagtggtaatgctaccttttgtatacaaaggtgatgatactgaattaaatttccagaagtaatgatgagtttttattcatgcatccatgttgtaatctctggccttccttgaattcaggggcattctaaaatgcagtgttttggcctggcatagtggctcaggcctgtaatcctagcactttggaaagctgagacaggtggatcacctgaggtcaggagttcgagaccagcctggccaacatggtgaaaccccgtctctactaaaagtacaaaaattagctggatgtagtggtggatgcctgtagtcccagctacttgggaggctgaggcaggagaatagcttgaacctgggagatggaggttacagtgagccaagatggcggcattgcactccagcctgggtggacagagcaagactttgtctgactggaaaaaaaaaatcaaaataaaaactaaaatacagtgtttagttagagaacagaccataccaattaatttttacataaattaaatccatgacttgcctggcattttgccctagccaaattaactagcctcagaagttggattttgcctctgtgtttgtttcattttctcagtcaagaattaagagtactgacattacatattaagcttttttgtatcccctggggtaactaactagcatggtggcttatacatagcaggtatttaggaaaaaaaaacacactttgatttactgatattgattatgtttcaatacaagggcagttcagctactttgcatggacttctttgggaaggatttactatgatttctatttctatattcgtgtatgtttttgtgtttgagttcagtcatacttattacttacccatcttcttattgaacctcccttttgatcgaatgtgattattgcattggtggtatattagttgttttgaagaattaatatttctttctaattcaagcctatgatgtgactcaggctggtgatacaatgatggtattaagacaatgttcatccccttcaacagggaaagtaaaactgttcaacttgcttttgaatacccagtatacctgttagtaatttatttaggaaggtaatagtctcttcatatattagaaattttgccacattaagcaaaatcttagaaaagtcagtatttatcagaatttaatattaggaaatctttttcaaaggaattgaacatatccaaatcggagctaaatactgtcacaaatagctctaattttttcaccttcaagcaaaccacattcaggtgttagctattggctctgaagtagttgttctatatactataggtgttggaggcccctccttggtggattttgaaacagtagaaactcataatgattgcattctcttaggaatcttacttaatctggctgcagcgtgcagaatttatttcaggagtcagaccagataggagactgttatggactgaatgcatgtgtgtccccctctcctggcgttcatatattgaacccataatccccaatatgactatatttgaaaacagggtctgtgaggaggtgataaaggttagatggggtcataagtgtggggccctaattggatagggctgattccattatacgaagaggaagagacatcagagctctctctacaatgtgaagacacaatggagaagtgtgtaatgcatgctgtgtataagccaccatgctagagaaagtggccgtctgcaagccaggaagagtcctcaccaggaatggaatcagccagcaccttgatcttggactttccagcttctaaaactgtgagaagtaaatttctgttgtttaagacacccagctgtatgtttttcttgcagccagggcagactgagactgagacagagacagagaacactgtcataatctaagcttgaggtggtaaggagtgtggcatcaggaaagacagcaatgagacaggtatggtgggaaaggaaagaaagtggtataagagaagggtccatgggacctagtggctgacagcatgtggggacaaaggatgatgtatattatctgtatttcccaaagtggggaaaattttttaagtccaattttgttgagggttctgccttccaggcccccaggtttggtgatttgctaggactaacaggactcagcatatagtcctcattgctatatttattacggtgaaaagatacaaagcaaaatcagtaaagggaaaaggcacatggggcaaagtctggaggaaaccaggcacatacttccgaatcttctcccagttaagttgcacaggatgagcttaattactcaagtatcaagttgtgaaagtatggtaaagtgttatgtgccagagaagcttgcctgagcctaggagttcagggtttttatcaagagcccatcacataggcaccctttgcctagaatatacccaaatttcagactctcagaaggagtttaacatgcatcacattgttcatataacagtttaggtacaataaaccacatttatcagggaataatggcaactgctgaaattcaagtttccagttgccagcaaagggccagcctttcaagcatttcattctaagaatagcagtctcagacctgcagtattaactgttttttgcacagtaatattttaaactagaaagggaacattaaatatatgtcactctgtttttcttactgaagtttgtgcataatagaaacaaattttaaccctaattattgtcttcagttggccacacaaaaggatatttttgagaagtgttaggaagagaaaaacaactctgaatacagtgaaatgttgccatgcgtttaaagtcagccatggaacataattttaggttatattctcctgtagagtaagagttatatacacagtatctttagtaataaatacctagagagctcaaagaggtaagatgcctttgctgaaggcaccatctcttgatgacataggatctctgtaaaccttgctggtgtgcagaattcctcatgtgtcaggtgcacaatcccaaagctttcctactttgtacttcaggttcaaagagatttttaaagcatcttattttcttgattttggtatagcatctactgcccagagcactagatgagtctcagttggaagtgggaagcagaaatagcataggttcaggagcttccagaaaacaggatgccctgacagtgttttcctttcctgtaccacgtgtggccctttctttccttaggatgttaccttagaggtttctcttgctagttaatagaaagatagttttgggggcagaccacaaattcctaggtatggtttgaggtaagcataatttgacacatataattacattatgttaaactttaaaagttctcaaactttattttaatgccaaccacatcttgtttagaatccacatatgtaaaacatgtaaaagctgagctgctgagcaggttgagctgaagcaggctgaggagtcctgcaatcattcgcccctaaagctcctgcagagaatcttaaaagttcttggagattgcttctcccctctaactccgttgtagtagagatgagaaaatgaatgatcaggaaattaatctatatcagttagttctttcaagtccttacaaacccttttctagaacttctttgactaaccccattttctcctgtagctgttcctgtaacgttttatataaacatagtgcttatcattttgttttatacataaatgtttgtgttgtctccctcagagtccctaacctcagtctattttttaaaattaattttagatcctcagtgcttaatgtaatcctagtatatagtaggtagttaataaatactgcattaaaatgaataaatttattcaatactttccatggaaattatttattcaatttgtagtatcattttgcattcttgatgtcttaatttcgaatggttctctgttaatttctgagattgtttatttcttcaactacattgtcagctttttaaaaatctttattgcctactccccaacataaaacccagaataataggagtattttggttaaccaaagagaattccatagaaaatgtcatgataactgtagctttacttccttcttactacctctcaaaatgttcctgatgtcagctagtaagagtgctctgctctttcttttatgaggccagtatgtaaagaagcagtgtataactgaaataatgtgaatttgtctccaggatctaccacttattacctgttgaccatggtcataatatcgaacctctctgatgatgatgatgattattattattattattattattgtgagatggagtcttgctctgtcgccaggctggagtgcagtggcacgattttagctcactgcaacctcctcctcctgggttccagtgattctcctgcctcagcctcccgagtagctgggactacaggcgtgcgtcaccacgcccagctaatttttgtatttttagtagagacagggttttaccatgttggccaggatggtctcgatctcttgaccctgtgatccacccgcctctgcctcctaaagtggtgggattacaggcgtgagccactgcgcctggccttctgattcttatttctgtcatctataaagcagggaaagtaatatctgccttatgataaataaagaaatgacatattatgtgttttaatgtatgattgtattaaatgtaatgtatgttacaataaatatttaaatattaataaatatcatttattaataaatatttaaatgatagctgatgtcatatacaagcaggtgtgatgaacctactagtggtgtttaaattttaacatgagtaaagatcaccttgggagcctgttcaattgcactttcgggtttagtaggtctgagttaggacctgcagttcttcatttctgataaactcctaggtgctgctgatgctgtagtctacagagcacacttggtgtagcaggcactggagtattcaagattcccttgttatgcttttttttcttttaacatacgttgaatgattggttggactgtctttggcagttattttatatcttctcagatattgtgactgtttttaaggtagttaacaataatattgtggactcatccagtgctttgttttgaaaacttttttgttacaatgccagggacacaatatttttaaaaatattttgtagtgctgtatatccaaatattaggggcaaacaattaaggtagacatgatgatcttatctacttttgtaggtaaataggtttattgaatttgaaaggatgccaagcaaggatttatggcatattaaggcagatcaagccaggaatggtggttcacacatacaatcccagctctgggaggctgaggtgggaagatcacttgagcccagaagttcaaggctgcagtgagttatgattgtgctactgcattccagcctgagtgacagactgagaccccgtgtcttaaaaaaaaaaaaaaaaaaaaaaaaaaggtcagatctttggccatttgcttctgctgtataattatctacaggccagtaattgaaagtataaacctaaattcgcaatgttagatgaacattataacttattagaacattatatatgtataattaacattataccagtatataacattataacttattatttagaaagattgtaaatctttctaagttgaagttgaaagaacaatagggtgggagtcaggagatgtgaattctgggtttggctccaacaaaggttagcggagtgaccttggaaaggtgagagttaattcttactttttccatgcattcatgatactttataaaaataacttttcaacaaagttctcagtcctctatgtaagagaagatcttacctatgacaattttctaacctttagcattctgagtttaaatgtaaaactatcaaatgctctgaaaaattaatgttgcctatgctatttttattttaattgtattaattttgttaataagattttaatagtaagttttggagcaatttactggccagctgaatatctaagatatttcattcaaatttgaatatgtttttacaaaaatataagtaaagcaattgtaaaaacttttacactataatttcagtttttttcctaatttatgcaaaattatctattaaagtaaaagacaaaacacaagagatttatgaattctttaatattatgttattcagccactatatgtaactctttcaaatactatgttaatttgtgagtacctccacaacaacaaattaaaacatgaagtaaggaaatggacatttggcactattgggaaatgatacttggttaagcagtgctttattgcatacttgatatttgagaggaaggatttgacaagttaattagtcttttctcttacctaagtgatttcatcactcaaatcctccagaagttccaaagcggtatctatctctgtcttcagcagcagcacaaaccaaaccttgagagaattctgacacatgatccccttttattttgaggacatagggcaagagatgtgcagaagcatttccttggggcttgaagatgttatttgtgagagtagatgttcaaggttacagatcatacagtgtcagtctgagggccagatcctagtggcagaagacgttcatgtgttcttcattaaatttaatttgggttatttgtgacagctggggccctctgaaacatagggtttgtggcagggtcccctctttcttagacctaagggtgatactgcttgtgtaccatagtcccaggagcagaactgggtgtgctgagatatcaaagttatgcatgtaatctcagccaggttattataattaaatattatttgggtaccagataaaatgctgaaagttaatactggataggctgctgtcataaatctccttagctaatctatatgtttaaatggcagccagacaactaaagtatgtgaacaaatagcattgcaagctaaaattatgcttttcataagcaaataaccttcactgtgcttcttagcatcttggagttgttctcttcttggttgtggctactgttatgatgttcatatatagtaatcatcaatgtttaacatttaggacttctgagcaatcaagtaagcattgaatttttatcttatttctagtgtagaaagtaggaaaggaagtagagaaaattttcaatttagtgttgattcaaagtcaacaaatagatgatggctatttcacataattttctggtatttgctttctatagcattgttttcaaagtcaaggttctcatgggggagaagtactggacatctggacatcttttttctgacagcattgtcataagctgtgataactattttatgtttaaaactaatgtaatcagacaacattgtagtgtgcaataggaacccttatataatgtgtgaaatggtaaaattatatttatttaagaggatattgacatttattttgtatttgactctatacaaaataagtttttactgtatctacattaagaagatctccagtaagtgctttgagatcaattagtgcttaaattagcatttagagatcagtcatttagagatttttttcaagtatttatataaaacctgcatggtatattttataaataggctgctaatatagataggattctcataggtgagtggtaataatgtcataaactagtaataagttttataattactttaatatgattctgtggttaaaaaataagtttgtactatgtacataaagtatttatgaggcagcatattttgtcaaagaataatatttatctagtatatgcatattaccttctattttccccgtctagttttcaagtatatctttttgaactttagtcccctctgtgattgatttttaccccaccttatttcaaagaaattcaaggggactatctcttaacttttttttcctgtttttgttgttgttgttatttgtttttcggaggtgtgtgtgtgtggttgagacaggatctcagtctgttgcccaggctagagtgcagtagtgcagtcatagctcactgtaaccttgaactcctgggctcaagcaatcttcctgccttagtctccttagtagctagtactataggtgcacactgctatgcctggctaattaaaaaaaaaatttttttttaagagatggtgtctcactgtgttgcccaggctaatcttgaactcctggcctcaactgatcctctggcttggcctcccagagtgctgggattatttaaaaaccaggcaccacattcagccttggttttcaaattcttttcaggaagtctttttattaaatacgaaactatatcccaacctcaaatgcattcatacatggggaaaatgtaactttttgaatgtgttgaatttataaatgaataagttctttgttattatttatatcttaagtccttcttaaattagagaccaatacaacttacaaaccgttgctacctatgaaacctttttcaacttttgtgtcttctcaattgtattctgagtaacttccatcttccatcattatcattaatataatactggaaagagtagaatggaaatgatactggcctgagtgtttttaagtttccaaaagatatttggaatcttctgtctgcatttcaacagggccttggcttcgattgcttattttactataaagtgtgtttcacatgtttgccacaatatccttaaatatgctttgctgtttgaccgatgtaaaatcatactccagaaacacctgcatccaagaataactgctgttgaacaatgtgtctaaggctttaatgcaaataccaatcacttggggatcttgctaaaatgtaagttctgattaagcagggttggcatgggcctgaggtcctgcatttctaacaagctcccttgtgatgccactgctcctggtctaggtaccataccttaaggagaaagtatgggttacatctatatgtctagtgcttcctaatgcatttgcccagtgttacaggtctaacttgttcttaggcagtggttctcaaactttagcatgcatgagaatcacttgggagaatgttggctctaaatttacacgcttgggctccactcatcagagtctattttggtgggactttgggacccaggaatttgcacttttgaaaactcctcagattttgatgcatatggactaacaccacaatttgagaaactgatactttaaagtttggaattgctatagaaattcatggtcccttctggaatgacagcttgttaaagccaagcaaggatacagtgaaaagcccatctgaaaggagattgctttgaatgccagtgtagtatttggttaatggggaagcagtagtataaatttgcatgcttttcttttctattccgttgcttcaggcaatataatttactaggtgtattaatttattgtaatataccaatggtgaagaccatagctcattcactccctaattaaccctagaggagtcttaattggataattggttagaaatagtagatgagtaggtatattaaatgttgaatggatggtcagtattgattctactcttggattctgactaggatatttactctctctctctcagaaacatctatatctttaatattacttgctattgtatttactaactgtcacaagaatagcctgttccacatataaaatacagagttggttctcatgttttttgttgaagggaattcggataactagtgagttgtttgtcattttcatttaagacagaagttaaattctaaaagtatgtcactcagtgaatttttaaaaattatatcttttaataactttaagattgattcttcatctattcatgtctctgttttaaggatgtgggtggtatttatataattcctaattgattctataaaaagtattttaaacaaaagggttatatagaggttatagttattagataatcttgtcagaaacagtgccatttagaatacttggttcagcaaactgtttaatgtcagccaaagtgatttaaaagctttatttaggattaatccatcatctgcttaaatttattatctcatttattcactaatttgcatatgactttgcaattcagaaattttaagcaaacagtgatatacccaaaaatggattacaggataaattgaattaaagcaaactgcagtgcaatcaaggccagctctggacagaagcctgggattagtgagctgtgattacatcactccttttctgctcctccgcctttaagagcaagcttctttatgctatccctggatggttttgttccaacccctatgctatgaggtctctcttgcccttggagatttaaagttttgtatcagaaatagatttgaagatcatcatgaccaaatgtagttagtgctatgtgagaaggatatctatcacacaaaatgctttatggtcacagagagattagttctgtctgaagggaaaggggagaagatgacaaacatgccatcggggcaattaacatataacccttccacgggtgagaatactggaccaaatgacctttttggggtgcctttctgttgtgaattttctagtttattaataacccaagaactgtgccttatagtccatagtattcatacctctcaaaaccaaggtacttaggattggggaggaaaaagactctactaatttttaaagtagacctaaacaatttgcactgcctgtgtctttgacctgattttttactctcacctttctttatctgtccagttacctttgtatactaccaaagctttaaccttctgtcctctcaaacttttttaaattttactttatttaactaccaatttatcaaaacagtcatttacacttgacgccagcccactccgaaacagctgctgtctagcttctgctaccagcacttgactatgcttatttgaagatcatcagtgatacactaattaaaactccagtgacttatctggctttgtgttccttcatctatgccacagttgaatcattgaccactttttgcttgaagttctcagctcatgctgctttctgttgagtgcttctcatgctacctcagtggtacttgttaaatgttttccttttctactttccctccatttagtcgcacaaagcccccaccctctatactcgtctctgcctatttaacagatcctacctatgctctaaggcctggttcataggccatcttccctttaaatctttgagctaaaatgttttctcagttctgtagtttttaatctaatttttacttggagcacttttaggatgactgttgccttgatagtatgattttgtacacatttcttaactactctagcagatgttaaaaaaataaaaaaaggagagaaatcatcactgtagcttctgcaatgctgtgcattattagaaatctttaaatatttttcttaatatactgtggtagggagaataatggcaccccaaagatccccatgtcttattctttgagttagtgggtgcagcgcaccagcatggcacatgtatacatatgtaactaacctgcacaatgtgcacatgtaccctaaaacttaaagtataataaaaaataaaaaaaaaaagaaaaaaaaagaaaaaaaaaagaaaccactgaatatgttaggttacagggcaaagtcaaattaagttggaattaaacctgttaatcagttgatcttaaaatgtggagattaatctggattatgctagtgggcctattgtaatcacaaacatctttagaaataaaagagggagtcagaagagagagtcagagtgataccatgtgagatctcatcccttgctttaaagatggaagaaaagaaccatgagcaaggaatgtgggaaacctttaaaaactaggaaaggcaaataaaaggcaagaaaatagatttccccccagagcctccaaaaggaatgcagctgatgtgttgattttagtctagtgagacccatgtcagacttacgacttaccaaattgtaaaataaatactaaaaattcagagacaaagggataagtaaaataggaaaataaaactcattattccaagacttgcttaattccctttagaggtaatttgttcattattacactgttttttggttgttttacaaaggaattctatataatatagttatcccagtgaagaaggagcccagataagatatattgatttattcttctttctttttgtatgttgtaaaacagagtcttgctctgttgcccagactggagtgcagtggcacaatctgggctcactgcagcctctacctcctggctcaagaaatgctcctgccttagcctctaatagctgggaattacaagtgtgccacgtaatttttgtatttttatagagatggggtttcatcatgttgcccaggccggtctcgaactgctgggctcaagcaatcctccctccttggactctcaaagtgccaggattacaggggtgagccaccatgccctcacacaaaaagaaattggttggtacatatacacagctttctgatttctttttatttgagcttcataatttgaaaaagatacctctgttgttcagtggggctgctacatagtagaagctcaataagtattgaatgaatgaaaaaatagaattgataaataaagagaaaatgtctttattcattctaagaaacaaattaccctttagcatttttttaatttttaatttttgtgggtacatggtaggtctatatttatggattacatgagatattttgatatatgcatgcaatatgtaataatcacatcagggaaagtggaggtatccatcacctcaagcatttatcctttatatttcaaacaatataattatatcctttttagttgttttaaaatgtagaatttatttttgttttactatagttaccctgttatgctagcaaatactaggttttactcatactttctatttttgtacccattaaccatccccacttctctcccaccccctgccacaacttcccctctcaacctctggtaaccatccttctactctctatctccctgagtcaattgttttaatttttagctcccacagttaagtgagaacatgcgatgtctgtctttctgtgcctggcttatttcacttaacatagtgacttcacgtttcatccatgttgttgcaaatgacagtatctcattattttttatggctgaatagtacttcattgtggatatgtaccacattttatttattcattcatctgtcgatggacacttaagttgctttcaaatcttggctattttactcctgtaatcccagcactttgggaggctgaggtggtcagaagtttgagaacagcctggccaacatggtgaaacctcgtctctactaaaaatacaaaaattagccaggcattgtggcaggtgcctgtaatcccagctagtcaggagactgaggcaggagaatcactggaattcataaggtggaggttctactgagccatgattgcaccactgcacaccagcctgagtgacaactccatctcaaaaaaaaaaaaaatcttggttattgtaaataatgctgcaataaacatttgagtgcagatatctctttgatattctgatgtcctttcttttgtttatatactcaatagtggaattgctggatcatatggtagctctatttttagttttttgaggagcctccaaactgttctccatagtggttgtactaatttatatttccaccagcagtgtaggaaggttcccttttctccacatcctcgccagcatctgttattgcctgtcatggataaaagccattttaactggggtgaaaagatatctcgtagttttgatttgcatttctctgatgatcagtgatattgattacctttacatatacctgtgtgtcattcgtatgtcatctttggagaaatgtttattcagatgttttcccattttttaataagattgttagatttttcttctatagagttgtttgagaaccttatagattctggttattaatcccttgtcagatgggtcgtttgcagatattttctcccattctgtgggttgttgcttgactttgtacattgtttcctttgctatgcagaagatttttaccttgatgtgatcccatttgtccatgtttgctttggttgcctgtgcttgtgtggtattactcaagaaatttttgcccaggctaatgtccttaaaagtttccccaatattttcttgtagtggttttataatatgagaccttagatttaagtctttaatccattttgatttgatatttgtatatggtgagagatagggttcttctgcatatggataatcagttttcccaacaacatttattgaagagactgtcctttccccaatgtattttctgagcaactttgtcaaaaatgaattcattgtagatgtgtgggtttatttctaggttctctattctgtgccgttttggttatgtagctctgtcatataatttgaagtcagtaatgtgattcttccagttctgttctttttgcttaggataactttggctattctgagtttctgtgctgtcatgtaaatttcaggattgttttccctatttctgtgaagaatatctttggtattttgatagggattgcactgaatctgttgattgctttgtgtaatatggacattttaacaagattgagtcttccgatacacggacatgaaatatctatccatttgtgtgtgtgtgtgctctttaatttctttcaaaagtgtttcatagttttcattgtagagatcatttacttctttgattaattcctaggtatttaattttatttgcagctattgtaaataggattactttttaaatttctttttcagattgtttactgttataaaaatggtttttgtatgttgattttgtgtgctacaactttattgaatttgtttatcagttctaatagttttttggtggagtctttagttttttcaaatgtaagattatatcatttgcaaacaaggataatttgactgcttcctttccgatttgatgctctttatatccttctcttttctgactgctctagctagaactttcagtactatgttgaataacagtggtgacagtggacattcttgtcatgttctagatcttagaggaaaggctttcagtttttcccagttcagtataatactagttgttggtctgttgtatgtggtttttattatgttgaggtatgttccctctatccccagtttttggagggtttttaccatgaagggatgtggaattttgtgaaatgctttttcagcttcaatggaaatgattatatggtttgtgtcctttattctgttgatgtgatgtatcacatttattgatttgcatatgttgaatcatccttgcattccagggataaatcctacttggccatgatgaatgatctttctaatgtgttgttgaatttggtctgctagtgctttgctgaggatttttgcatcaatattcatcaatgatattggcctgtaatttccttttttgatgtgtctttgtctgattttggtataagggtaatactggccttgtagagtgagtttgtaaggattccttcctcctttatttttctaaatagtttgattcagattgatattatttcttctttaaatgtttggtagaaatcagcagcgaagccatcaggtcctggacttttctttgctgggaaacattacagctttggtattgttgtttgttattggtctgttcaggtttttggtttcttccttgttcactcttggtaggttggctatatctaggaatttatacatttcttccagatttcctaatttattgaaattatgtttgctcatagtagccactgttgatcccttgaacatctacagcatcagttgtaatatctcctttttcacctctgattctatttatttggttcttttttcttttttttttttttttgtctggctaaatgtttgtcaattttgtttaacttttaaaaaaacaattttttgtttcattgatcttttattctgttttcttcatttcagtttcatttatttctgctctgatcttttttttttttttagacggagtctcactctgttgcccaggctggagtgcagtggcgtgatctcggctcactgcaagttccacctcctgggttcgtgccattctcctgcctcagcctcccgagtagctgggactacatgcacccgccaccacacccagctaatttttcgtatttttagtagagacacggtttcactgtgttcaccaggatggtctcgatcccctgacctcgtgatctgcccgcctcggcctcccaaagtgctgggattacagacatgagctaccgcgcccggcctctgctctgatctttattacatcttttcttctaattttgagtttggtttactcttggttttctagttctttaagatacagtgttaggttgtttatatgaagtttttcttcttttttgatgtaagctcttatgtctataaactttcctctcagtgctgtatcctgtaggttttggtatgttatatttttattatcttttttacaagatatttttcaatttccttcttgatttccttattgactcactcatcattcagaaacatattgtttaatttcatgtatttatatagtattcaaaattccttgttactaatttctagttttattccattgtggttagacacttgatattttttcagttctttttaatgttttaagacttattttgtgacttaacatatgatctgtccttgaaattgatccatgtgctgaggaaaagaaggtgtattcttcaactgttgaatgaaatgttctgtaaatatctagtaggttcatttgttctatagtgcagatttaactgatgtttccttgttgattttctgtctggaagatctgtgtaatgctgaaagtggggtgttgaagtctccagctgttactctattggggtttattagagctactctttagctctaataatatttgctttatatatctgagttttccagtgttgggtccatagatacttaaaattgttatatccttttgcagaactgacccttttatcattatatagtgaccttctttgtctcttcttatagttttgtcttgaaatctattttgtctattagaactataactactcctacttttttggtttccattgggatggaatatctttttccattcctttggttttagtctacatatgtctttttaggtaaagtgtttttcttgtaggcaacagatcattgagtcttgtttctttatccattcagccactttgtgtctttttattgtagagtttagttcatttacattcaatgttattattggtaattaaagacttactactgcctatttggttttggttgtttcgtggtcttcttatccctctttccttccttcctgtcttccttttggttaaggtgattttctctgttggtatgatttaatttcttgctttttatttttttgtgtatctgttgtatgttttctgatttgaggttaccgtgagacttgcaagtaatatcttataacccattattttaagctataacaacttcacactgtttgtataaacaagcaaaaagaaaactgagtgaaaactctacatgttaacttcatcccccagatagttaatcttttgttgcttctatttatatcttattatactgcctgatttcaaaaattgtagtagttactattttctgttggctcatattttaatctttctatttaatataagagaagtttatataccacagttacagttttataatattctgtggggtttttttctgtgtatttactgttactagtgagtttgtactttcagtttatttcttattgctcattaatgtccttttctttctgattgaactactctctttagcacttcttgtagaacagatctagtgtttaaggcctttggcttttgtttctttgagaaagtctgtatttctccctcatgtttgaaggatattttcaccaggtatactattccaggataaaagttttttttttttctttagcagtttacatatgtcatgccactgtctcctggcccataaggtttccacttagcttactgtctgacttagagctccattgtatgttatttgtttctcttctcttgctgcttttaggatactttttttatccttaacctttgggagtttaactattaaatgttttgaagtagtcctctttgggttaaatctgcttggtgttctattagcttcttgtacttggattttgatagcattctctaggtttgtgaaattctttgctattatctctttggataaactttctaaccttatctcattctctacatttttttaaggccaataactcttagctttgcttttttgaggctactctgtaaatcttctaggtgtgcttcatttttttttctattatgtcctctgagtgtgtattttcaaatagtttgtcttttttgtctatttttattattatattttaagttctagggtacatgtgcacaacatgcaggttagttacatatgtatacatgtgccatgttaatgtgctgcacccattaactcatcatttacattaggtatttctcctaatgctatccctcccccctccccccaccccacaacaggtcccagtgtgtgatgttccccaccctgtgttgccaagtgttctcattgttcacttcccacctatgagtgagaacatgcggtgtttggttttctgtccttgcaatagtttgctcagaatgatggtttctagcttcatccatgtcgctacaaaggacatgattccattcaggacataggcatgggcaaggacttcatgactaaaacaccaaaaacaatggcaacaaaagccaaaatagacaaatgggatctaattaaactaaagagcttctgcacaataaaagaagctaccatcagagtgaacaggcaacctacagaatgggagaaaatttttgcaatctacccatctgacaaagggctaatatccagaatctacaaagaacttaaacaaatttacaagaaaaaatcaaacaaccccatcaaaaagtggacgaaggatatgaacagacacttctcaaaagaagacatttatgcagccaacagacatatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttatatggttggtgggactgtaaactagttcaaccattgtggaagacagtgtggcgattcctcaaggatctagaactagaaatagcatttgacccagccatcccattactgggtatatacccaaaggattataaatcatgctgctatcaagacacgtgcacacgtatgtttattgcgccactattcacaatagcaaagacttggaaccaacccaaatgtccatcaatgatagactggactaagaaaaatgtgacatatttacactatggagtactatacaaatagtttatcttaaaggtcactaattctttcttctgcttgatcaactgtatttttcaaatccagaatttctgctttattctttttaattatttcaatctctttgttcagttcatgtgatagaattttgaattccttctctgagttatcttgaatttctttgtgttttctcaaaacaggtattttgaattctctgtctgaaaggtaccatgtgtctctttctccaagagtggtccctggtgccctatttagtttgtttggtgaggtcatgctttcctggattatgttgatggttgtagatattctttggtgtctggacattgaagggttaggtatttattgtagtcttctcattctgggcttatttgtaacggtctttcttgggaaggctttccaggaattctcaagtacttgggtgttgtgatctaagcactgcctgcatgaaggggcaccccaagcccggtaacactgtggttcttacagactcataagatgccgccttcgtggtcttagataagatctggaagagttctgtggattaccaggcagagacacttgttctcttcccttgctttcttccaaaccaacagagttctctctatgttgagctgcctggagctgtgggttgatacaagtgcccctgtggttaccaccactgggattgcactgggtcagacctggagccagcatagcattttgtctcactcaaggcccagtataaccactaccaggttatcgcctatgttctctgaaggccctagggctctacaatcagcaggtagcaatgccagaaagtcttgtgtttttcctttcagggtagtgagttcccttaggcccaaatgggtctagagtagctgtccaggtgctagggactagaatgaaaaccttctaaatctacctgatgttccattgtactgtgcctgagcctaagccacgagtcacggtttttcccgttcttccctcctctttccacaagcagaggagcctcagcccacggccatcaccaacacaggcccatggggagtactgccaggcttccaccaatgttcatttaaagcccaagtgctctttagtcagcttatggtgaatgttgcctgacctaggactcacccttcagggtggtgggctcccctctggcccatggcagactcagaaatgccatctaaaagccaaggcctggaatcggggaccccaagaacctgcctcatgctctatctccctgtggcctagctggtacctaagatgcaagacaaagtcctgtttactttttcctctgctttcttcgagtagatggagtctgtcatcatagctaccacagctgggaaagtgctgtgtctcacctgaagccaacatgtctcagagtctcacccaaaacccatggcatactccatgagtattgcattggttattcagggccaaagggttctttagtccacaggtgatgggatctgccatgactgggtacttcctttcaagtcaatgcgttcccttctggctgagggagtttctcaaaatactttctgggagctaaggcctgaaatgggggtctcacaacattgtctggtaccctatcctactgtggctgagctggtatccaagatgcaagttaaaatcctctttactcttccctttcctctcctcaagcagaagcaaggggtcccttttggagccacaaggggtctcttttgcagcctggagctggaggagggtggtgcaagcactgtattaaccattgtgtctggtgtctcagtaagttacatgtccccccagtccactggctctgacaccagcccagcacaaggactcacctacgacttagagtccttatggcctagattgcctttcaagtttatttaggtgcccagagcactccatcctgcagtggcaaggcttgctggaactcagattttgactgctcagatgggtgattcccatctggctagagccagtccatatgctccttccatgagtggctgtcagctaagtacagcctggttctgcttttgctatgacaggacagcactgaattaagtgcagcgtgtcacaatcactgcattctttctccccagatgcacagattcttcttgccatgcagccactgctgggggatgagggaatgattgtgttggcagttcaagactttttcctgccctattcaatgcctctttctgtaatattcagttaaaaccaggtagtgtgaatgcttacctgatttttggttcttagaaggtgcttttttggtgtagttaataaatttggtattcctcttgggaagacaatcagtgtagctttctattccgccatcttgctccaccctctatgtcgaattactttttttttttttttttttttgagacaaaatttcactcttattgctcagactggagtacagtggcataaccttggctcactgcaacctccgcctcccaggttcaagtgattctcctgcctcaacctcccgagtagctgggattacaggtgcatgccaccacgcctgactaattttttttttttttttttgagatggagtctcgctcttgtcgcccaggctggagtgcagtggcacgatcttggctcactgcaacctctgcctcgcagattcaagcgattctccatctaagcctcctgagtagctaggtttacaggcacatgccaccactctcggctagttcttttgtaattttagtagagacggggtttcactgtgttagccaggctggtctcgaactcctgacctcaggcgatccgcctgcctcagcctcccaaagtgctaggattacaggcatgagccaccgtgcctggtctacttttaattcttcaaatgcactgtattcttatctccacccaccctgcctcaactgtactgtccctattcctcctctcttacacaaataatacttccattacatgaaggctttgttctccttccctttgaataagtcctacggattttaaaaattttgatttaaatcttaagccttttgtgaagggtttcttccttcatcactcactgcctttccttcccctcttccatatgtataagcaggtatactcactttttgtttccatagcaccttgtacttccaccgtagccttaatacattgcagcattattgtccatttaattatctttttcattaggctttaagctccatgaggttagggactatgtctctttttcatcattgttgcattcccaggcttggcataatgtatattttaataaatatttagaccaggcacagtgactcacacctgtaatctcgcactttggaggctgaggcaggaggcttgccttagcccaagagtttgagaccagtctaggtaacatactagatcctgtcactgcaaaaagttaaacaaaattttagccaggtgtgttggtacatgcctgtagtcctagctacttgggagactgaggtggggaggtgcttgagcttaggagtttgaggctgcagtgagctagaatcacactactgtacttcagcctgggcaacagagcagagaaaaatatataagaaaatttatatctagaataacactcatgaaatttactagtaatctcagatgtgtccaaaataatactctcagtctaggtagatatgaatattgtttttaggttgtttattagctcatttgttgaagttcatagccctacccaatattaaagttgatgataattttataggcttggccagatgtggtggttcatgcgtgtaatcctagcactttgggaggctgaggtgggtggattgcttgagtccaggagttcaagaccagcctgggcaacatggcaaaactttgtctctactgaaaatacgaaaaatcagcctggcatggtggtgtgcacctgtagtttcagctacttgggaggctgaggtgggagaatcacctgactccgtgaggttgaggctgcagtgagccgagatcatgtcagtgcacttcagcctgggaaatgggagtgagaccctgtctgaaaaaaaaaaaaaaaaaaaagtataggcagaatgtaacctcctgtaacagcaaaatctacttttaagtaaggtatttgaggtttatccagagttcaaagttgacatcttgacattgtttcacatttatatttgaacttaaatactttttggcagttgccatttttcagttagatggtatttttcaaacaaataattttattttttctgactttccttctttggagcctagtaattttgggagtatatatttagaacatcgtgtatagttttttaagaaagaaaatggcattgatctatttcttttgaaaataatactctgttggtggtttggaaaggtttatgtagaggtaaatgggtttatgtctgttgatgggctcctgcagataaagccacagacatcttcagccatgctgcttttgtgttgatgttctgtttttcccttgggacaataggtgctgttccttgtaaaaatatgataggaaaggaaatttgttctgttttgctgctatttaaagcaccacagacctgctcagtagactttgacactctattcatctcatcctccgttgaattattgttgttgttttattagggaaaagttttccttggagataattcctacaaagtaattataatttacaaagttttcttggttttccatgtgaaatgaaattatttctggagatttgggcctatgaatatctggtttcagagtcttaatcattaattgttttgcctcctatttagatgattaaagttaaagctaatttattttctctgttttcattactaacgtaaaatttttaggtggccagtagaaagaattcctaacagccaaaatctctggtcttttagaatgtcattttaaaccacttttctctcatcttcttatacatatttgctccgactctacctttcactgtgggtttcatttaccctggaacctaggttactaggggctgcaggaagtacctggtgcagggaatactagtacccattctttcatagccaggaaaaaggggagagggtgttggaatatacacaaacaagtcaaagttggggagacttgagtgcatcaagtcgataagtctttgccaagtcctgcctactgagggatgctcagtttctacagggcagggaagacacctttggtaagaaaataatttaccttctagcattgacccccttatcaatcccttatcctcctttagaagaattgaattgcctgtggttagcttctaacttccccaaagcatgtagtactctgcagcctgggttgtaaggcttataatgagtgtttgccctagtctggggattctttttaccataagtggtgtgtctgatggaaactgcctccctctggaagatatatatcatgaactctcattgtttcagtgtaacttctagtctcacaaattcatggagtgaaagtcagagagtgaaatttagcttagtttctatggggatgtgagtaatctttagggattattaaaacaatatactttttttccccccaagttttcccttgctcctctttttctagctcttcccccattcacctatggaatcatctgcattcattatttcaggagagaggtagatacagtctaaaatgtaggagtaattgctcagctctgagacttacattttataaaaataaattcttatcttaatgtaaaatacttcttcaggaacaaaattcaaaagatccaaaaggatctaattgtacataaatctcctccttctttctccccaacccaccagcattctttctctttgtcattcagttctgtatacacaaacagtacatagtttacactcttgtacaccttgcttttttcaagtaatacctttgctatagttctagattggtacatattaaactacctcattctttttaattagttatagtaatcatatcttactggtagatattacttcagttcctcatcttatgctttcacaaatgatgctgcggtgaaaatccctagccacacatcattttgcacacatatgagtttatcgataggataaattcccaggagtagaattactaggtcaaagacttattttattttttagagatgagatcttgctgtgttacccaggttgctctcgaaccctggacacaagcatttctcctgcctcagcctgccagtgtgctgggattacagatgtaagccaccacatccagccaagactaatatttttaactttgagtttaaatttttttttctatgtcaaactgtagacatgaaagtttagggttttttcctgaaacaaatgaagattttctaaattctagaaatttcacaatatgtattaacaaaatttgaaaatctgtacataattccactatactctatggtgtagaaaggactgaagatgatacatggacaatttttgccacattagaaggaaaatcctttccagtgttgagaagaagagccgtaggtcagtgtctttattcccctgtataccttttcaggagctgaacttcaaaagtaggaaacagggaggtattgacagtgatagtgatagtaatagtgaaaacagtcagttaggttctggagagaatctgagaacagcaagattgtctgagaaagacgaccctctaagggatagagaacttctaagagcactggtagactggccaaagcctataaacagagcatggaggctgcagaatacttggaccttaaaaccagaagatacagcaaaatttgagggcatcagtagtggttgccaagaagaccagccaaatctcagtgaacacaacaagcacaggatatttagtgaccaggtcaagtgataaatatctcaattgaaggcaaccaattgcctgacctacagcaagtgaactagcacgcgtgtcctctccaccatgaccatgaaacaactcagcttcctccttgtacctagttgccatcccaggaatgaagagagagtagagagattccttaaagaagttggactttttatggaaagattgtttgcctgaaagagactgctttaaactaggagaccaagttatgtttagttggtaaatttgtgacaactgcccatcctacccacacccatcactattagagaaaatcgatgctgcagagaaaaatgatataaaatgtagaaatgaaattatatatttcttgaatgtctcagtcattgtgtataaattttatcacccttctccagcatacacacacatgtgcacacactactggggagtatctctctaggttcttctaccacatgtaaggcatacccaagggtaaatcatatggcaacatacacaagtttctatattttttctattagctttaatattaatagaattttgtgtgagtatatagcaacttctggttgcctgtagctatctttactgaaatattccatcatatcttcaccatatcacattaacttaaataggatctcttttccttttatcaagtatagtaatagctaacattagtgagtgtttattatgtatccagcactgtgcccatatgtaatactttgcaaggatcaatgtgctgtatatgaggaaactgcaagttaaggaacttccatgtatactttgaagttcattctcttaaataaggaagctatattgccttccactgccttgcatttttgttttcagccctgtccttcaaaaccttactgtgtttgtgtaaattctgtcttcccatgttccttctcccccactcccttgtcccatttggttttctggtccttctctgttgcatgaattctatttccctccttttattgcctgaggtctttctggcacactgattctctgagcctgttcttatgctcctctttccctcccactctttgcccttttgtcattggcagcttcttacagattcccttgctgtttttattttctctctctcagtccaacaaagactgcttataaagagcagtgaccttgtcatttgaacaaaagattccaagaaccctgtgtaggttggttattgatttgcttaactgaagaaactgattagctacttcatctgttgttgagtatctctattaatgtcagggagttacatgttacagtattagtagctctgacagtgactgtcttcaaattaattttactgactgattttatctcagagttcttatctatagagtgatcactataatacctcccaaaaggaaagataaaatccctgaaagtgcattaccttagaggcttattttaaaacaagttttatttttttatttcacatttttaaagttccaaattatgcttggaaaagataatatcatttaggcctttaagttttttttagctttgaattcactgatatgtatttttcatttagatttgaaatatgataattgagaagagtatattcaacaaaagaagagtgaagtaatatatgaatgtatatgtaaacctaactacatatatttatagaaatatgcatatgcttccataaatattaaccatacgtgattatgtttgtaatattcacatattgcttaggaatgctaattaattaaaaggtcttgttgaattcaaattggttttacaagcttcattttaatgatttgttattattactgtgcgactttgaaaaaccaggtctattgaacttatggatatgggaaatacatatatttaaactgaaacaaaacgttattttatttttattttttattttttatttttttgagagagttttgctttgttgcccaggctggagtgcagtggtatgcgatctcggctcactgaaacctctgcctcctgggttcagataattctcctgcctcagcttcctgagtaggtgggattacaggcgcatgccaccacgcccggctaaattttttttttttttttttgtatttttagtaaagatggggtttcaccctattggccaggctggtcttgaactcgcgacctcaagtgacctaccaacctcggcctcccaaagtgctaggattacaggtgtgagccaccgcgcctggcctgaaacaaaattttaattgtgactttttagcattactttctcctcaaaaagccaagaattgactctttgatatgttatctagtgaaataaatttgatattattttctttgatttctgtagagaatttttgtttatagtttaaattccttttggataacattaggaattattttaataagtagagtaggttttctaattattagtaagttgtaattatttaccccctcattttttttcaatcttacaaaaggccaaaatatcacaatgaacatatccagtagaactggggggaaaattaaaaatgagtttctttatgcaaaattgctaccacatataatgcattatgatatggggagtggcttacagttcatatattcttatagtttatatattcttgattaaatcttttacagaacttagaaatttaagttaaaaacacttaaattaaaaaaatttaagttattttatgtggattaattttaaaattaatagcatagtagaaagatgattgtaatcttcaaagattttcaaattagtgtataccgttcatatgacttagaacatttaggaaaactacaggtatattttggcatagaaaataacaaaatgtggattattgtttttacttttttgttggatttcaatttgatgtttacaagtattgaggttattttatatagtattggaaagcttggatacctagaaacatggattcttagtggtgggttttggcatcaaacacacattggcctgagtcagagcttcatccatttcaagcaatgttaccttgggctaccattccgagcctcagtttccttggttatgaaatgggagtgatggcaattatctcaacgaattattgtgaagatgaaatgataagatgtttagcgcagtgcctggcacttattgagggttggtaaatggtagttgttgctaattgtagcaatgacaacagttctagtgttgtatagtgtgagaaaataaaatcaaatctgaaacatatatcacatcactttcatagctttctctctctgttttcaatttctgttcctgggactctcttttaagttcatatattataatgttattaattttagaccctaataacttctaaactgtttagagtcatagttatgtaatcataaacttttagagctgaagggaatttggggatcatttagtccaaacctcttattttacaagaaagaaaattatgtttggagtagtgaagtgatttacccagtataaattacttgtggcaggcttcttcttttttttttttttttgagatggagttttgctcttgtagcccaggctagactgcaatgatgcgatctcaactcactgcaacctccgcctcccgggttcaagcgattctcctgcctcagctttcagagtagctgagattacaggcgcacaccactacgcccagctaatttttgtatttttagtagagacagggttttaccacattggccagggtggtctcaaacttctgacctcaggtaatccacccttctcggcctcccaaagtgctggcattacaggtgtgagccactgagctcagccggtgggtttcttataagtggaacgctgttcattgtaccacatactggccccctcaatgtatcattcatttaaagtgtgaggctctgttagtttgatttgttcacttgagaccctgttatgcactgggtactgtgcatgaaatgagaactataaagttcctaccctgcagatattcatagtgaaaggaactgattgacaatcacagtagtgtgataagtattatagaagtagggtatagtaaatacagttaaacgaaaacaaagggataggaaccgtagtttattaagtgtctatatgacaagtaactcccatacactcatttaatgccataaccttctgatatagatattattatccataatttcttatttcatagcaaagctcagctcctgattgagaaggaaggaaggaggcatggtatccctgagttccagtaaaaaactcagtgctcatgaggacatgggccttctataaaagatttggtagatattggttgataattaaatgggagtgatgaatcattgagactgtctttttacctgccgctgacattaaagaccaagttgctttttttgtcatttgttttttacaaattcattgccttaattgagtagaagaaactaaacattttctaatttcttaagagaataaccttagtgatctaaactgaggaataagcatttcctgttgtaaatgtacttctctcagttctcttagtatttctggagtcaaaaatctagggcaaggccaaaagcttgggaaagacacagaatcttccatgccctctgagaccctacattttctaaacttaacttgattttctcactttgtttactctttttttttttttttgagatggagtctcactctatcgcccaggctagagtgcactggggccatcacggctcactgcaacctctgcctcccgggttcaagcgattctgctgcctcagtctcctgagtagctgggactacaggcgacctccttaagcagagagggggtttcaccatgttggccaggctggtcttgcactcctgacctaaagtgatccatgtgcctcggcctcccaaagtgctgggattacaggcatgagccaccgtgcctggcctcactttgtttacttttattacttgcttttctcctgctatgccttcgtaaaatctcttagttgcatcactgatgggcatttaaggcattgtgagaagatttagttgttcagtgacagtagtaagttgtcatttttattgctggcttaaaaaataatttttggaagagctgccatgtactaacagtccattgcataacactttactttttgtttttttaaagagatagtatctttttattaacatttttttaaaaatccataacttagtaggtgttagtgtttctaaaacacttgattgctcttggttccaaataggttttcagtggggaaaaaaatacccatttagagaatatttgatatggcatatatgctctctttctaggggaaaatatccttctgggattcttaggatacctgtttttttttttgactttcagttttataaatagagctgacctaggtttacgggtttctttcatttctaaaattctgctgttttactagaactactattatctttggaaactcttaattaaaagaaagaaaaatatataatattaggcagaaaccatgaaaattataaatagaaaattatattaattataatatgcatcagaatttggtgctctttatagttactgaaatgtatataaaaataaatttgctaacatagtgaactttttataagcaacaagtatgcaaaaagttcattaattattataagcagctagaatgccaggcagaatattagcaaccaaatttatattacataggcaataattgacagattcgtctctggagaaactgactattccaaaggaaaagaatcccaaagagctggccaggtcactactccactgacaatgaggcacacccttgaacaaaccccactgaagtccacagagcttctgatcacatttttagttcttttagttctttagtatttaatatataaaatagtctagaattactagattttcaaggaatacctttattgtgaatgaaaaccaaataacacaaaacagaaaaaaaggaaactcaggaaacaactcaagagaaacagagataatgcagaagaaagtacacggtatatatatatatatatatatgtacatatatgtgtgtatatatatgtacatatatatgtgtgtatatatatgtacatatatatgtgtgtgtgtatatatacatatatgtgtgtgtatatatacatatatgtgcatatatatacacacacacacatatatatatttatattccagaatattccagaaattctttcagagaatatgagatgaattagtgaaacttttcaaatgcaaaaatgacacagttactaactctaggaaaaaccaagcttgaacaagaatacataattatagaacattatatggcctaactgtgaataacagatatgtggttataagacaataaatagtgattaacctaaattggagatataatgatattagggtaatagatgtagtagaagagagtgtgtgtatgtgtgttcattcatgtgcttgtgcatacatacatatgtgagtgcagacatgaccatgggcatatgtgttggtgggtgggtaagtgctgtattctcatcttccatgttgcgaagtcagtagataaggggtttgcaaactatgacctggagtccaaatccagctgcccactgttacttcaaaataaagtttcattggaacacagctactcctgtttatttacatattgtctacagctgctctggtgccactatggcagagatgaattgtcaagaaagaatccatatggcccacaaagcctaagatatttactatctggctacacaataattaaaacaaattttaaaaatcaggaaatagcagttcatcatttagaaatatacatgtaaggcccagcatgatggctcatgcctgtaatcccagcactttgggaggtcaaggtgggtggaccatgaggtgaggagatcaagaccatcttggctaacacagtgaaaccccatctctactaaaaatacaaaaaattagccagatgtggtgatgggctcctgtagtcccagctactggggaggctgaggcaggagaattgcctgaactcgggaggcggaggttgctctgagccgagattgcaccactgcactccagcctgggcaacagagcgagactccgtcaaaaaaaaaaaaaaaaagaaatgtaaatacaaaaaaaatcagttgtgttctatgcagtaataaggaactatctaaacaagaaatgaagaaaacaattccatttacaatagctacaaaaaaattactcaggaataaattttaccaaggagatgaaagacctctacactgaaaactataaagtattgatgaaataaattgaagaggacacaaacaaatgggaatatatcctgtgttcatagattagaagaattaatattgttaaaatgtccatactacctaaaacaatctacagattcaatagactcttttttttttcttttctttttttttttgtgacaaggtctggctctgttacttaggctggagtgcagtggtgtaatctcggctcaccacaaacgccgccttcagagctcaagccatcctctcaacttagcctcctgagtagctgggactacaggtatcagccaccatgcctggctaatttttgtgttttttgtagagttagggtttcgccatgttgcccaggcttgtctccaactcttgagctcaagtgatgtgcccaccttggcctcccaaagtgctaggattacaggcatgagccagcacgcctggccagactcaacaccctttatcaaaattccaataacttttttcacagaaatagaaaaaataaccctaaaacttgttttaggattgtttaaatcttatttgtttaaatcctgtttagaccctgaatagccaaagcaaacttgagggaaaaaaaaaaaaccaaacaaataaaaacaaagctggaagcataacacaacctgacttcaaaatacaatacacaggtataataaccaaaacggcatggtactggcacaaaaacagaaccatagaccaataaaacagaagagagggcccagaagtaaatacatttatagtcaattgatttttgacaactatgccaagaacacacaagatggaaaagacagtctcttcaataaatggtcctaggaaaactggatatccatgtgcagaataatgaaattagagcctcatttcataccatatacaaaaattcaagtcaaaatgaagacttaaatgtaaaacctgaaactgtaaaactactagaagacagtgtaggggaaaagctccatgacattggtctgggcaatgatgttttagatataattccaaaagcacaagcaacagaagcaaaggtagacaaatagaattgaatcaaatgaaaaagcttctgcacagcaaaagaaacaacagggtgaggagtcatcctacagaatgggtgcaaatatttgccaaccatacatctgataaggggttaatatccaaaatatataaggaatcaattcaattgtaagaaaacaacctgatttaaaaatgggcaaaatacctgaatagacacttctcaaaagaagacataaaaatggccagcaggtatataaaaaaatgttcagtgctataagaggaatttgcatatctttacagatttggcagtgatcaaagcaaaagtctgggaaagctctacaagcagaattctcctttgactccttgaggagccttacctttcagattgagaaaagctataatatgatttaaaatccatctggcatttgctgttagattgtgatttttggtaacagcagacagtgtcaggttttattttattttcctagaatcagggtagtcaagaatatttcgtttactctagccagttctttttcacattttggcccaaactttattcccaaaacattatatcggtacatattttaaaatctagcaaacacatgggcatttgtgaagaccttttttttttttgtacaaaatgtgttctgaatttttgcttgtactgaaaaatacttgaaataaacacaggaagttgtatactaaaaaatgctgaacatcactaatcatcaggaaaatgcaaatcaaaaccaaaatgtcacttcacacctgttagaatgactgttagcaaaaagacaaaagataagtgtcaatgaggatgtggagaaaagggaacccttgcacgctgttggtgggaatataaattggtacaaccattatggaaaacagcatggatgttcctaaaaaaattaaaaatagaaccaccataggatccagtaatcccaataatgggtatatatccaaaggaaatgtaatcagtatgtcaaagagatattttcattcccatgttcattgcagtattaatcacaatagccaggatatgtcatcaacctgagtccatcagtggatgaatggaaaaagaaaatgtgaatacataatggaataccatccagcctttaaaaagttagaaattctgtcatatacataaacatgaatgaacctggaagatgttatattctgtgaaataaactaggcacagaaagtcaaataccacatgatctcttacgtgcaatctaaaaaagttgaactcatagaaacaaagtaaaatgctaactaccagaggctggaggctggaggattgggaagatgttggtcaagggacacaaaaatttcacttttataggaggaataagttcaagagatctattgtatatcatggtaattatacttaatgataatatattgtatacttgaacattgctaagtgtatatttgatatttacatattgtctatagccactctggtgctaccatggcagagataaatagtcagaaagaggttatacggcccacaaagcctaagatatttactgtctggccctttacagaaaacaaccttgtgatacacaataattaaaacaaatttaaaaaatcaggaaatggcagtacgtcatttagaaatatatatgtaaatacaaaaatcagttgtgtttctgtgcagtaacaaggaactgtttgacaagaaatgaagaaaacgattccatttacaatagctacaaaaaataggaataaatttaagcaaggaagtgaaagatctctatacaacaaaaaaatgataagtatattaggtaatgcgtgtgttaaatagcttgatttatccaccttacagtgtatgcatatatcaaaacatcatgttgtctacgcattgggtaaagtgtacactgcttgggttatgggtgcaccaaaatctctgaaatcactgctaaagaacttaattcatataaccaaaaaccacctgttccccaaaaactattgaaataatagtaataaaaaaaactcacacctgtaatcctagcactttgaaaggccaatgtggttggattgcttgagctcagaagttcgagtccaccctgggcaacatggcgaaacctcatctctacaaaaaaaatacaaaaattagctggatgtggaggcgcgtgcctgtggtcccagctacttggggggctgaggcgggaggatcccttgagcctgggaggcggaaacttaccttatacaccataattttaatttttacttgtcaatttaaaaagaatttaaggaacaatgtttgaaaatatgagaagaaatagcttaataaattgacaatgttcacctaaaatgagtaagagtctgaagtgcagaggaatgggacagaatactgctgcttttcatttaagcctaatagtatagtactgttttaaaaccatatacatgtattgctttaatacaatttttaaaaattaaatttagaaaattaagaaaaggtagctgttagaattaggcttgttggtgtagggttgccatgttacactgatgcataattcaccaaatactgtatttaaaaataaagtatcagagataccatggaaaaataaacatatgttaaaaaaataccagtaccttcaaacaccctattccctatagtatcaattttttattatatgctttttgatataactgtaataggtaattgatgcaaataacctccatctcttattttagtattattagtggtttcaaaacttcatatagcaacttctttttaccatagctgctaatgagaagcaaaaaagaaaaaaaatcaaaccaaagaaaattgatttactatcttgtcacactcttttggtgatggtaataaaccagaggagaaaaaaattaaaggagtagtgaattggctcaaagtgaatcagacaagtacttctgagggtcaatgaaccctaaaacctgatggtagataataaaatattgctgaattttgatttactattaagtatctttaatgtactgtgttttatattcaccaaacagagttatcttttcatataatgcaagatttttaaatgtaaaaaccatggtttatttcgttttgtattctctacagggtagtgtttggactcagtaggtgcccagtaaaggcatgctttaatatgaatggattttcactactgagtagcttgttctggttgattttcaaaagagtcttaaatttgtaagtgaataaaaaattatatgagtattatgagtgttcaaacaaatggaagcatttcttttccctgatttcgcataatgtgtatgatttgtgctaagtgataataaagacccttccgtttttcactcttggaagagaaacccttatcttctctacaaacaatttcaggttgttgttgctgtaaaacaagccctgagacctgttatcgactcattgttattttttctattttccaccatcctgtgagagaacatctttttaatgtggttttatacagtcttcagtgtgtctcagatatgggtttagtaaatctgttaagtacttttgtttgtcttctgttttttctctgaacaatacagttatgcaatttcctttgttattaaatgtcaggattattttcttatttatcaaccctgtagttttcaatcatttctgccatgttctttttggaagactgttgattgctttttagctaaatggtaccacagccagagaaaaagtggctaagatctgatgacatttgatgaattggtatgtcatttgcaattgtgtattctacccagttccctatttgagagaggtgttttctcctggaagtgctagagaaattgttatagcataattccttagaaaaattattcatagtaatgtatccgtgagacacatctagaccagggatatctcatggaaatgattgtcctttctgaacaagtgccacatgtttttatttgtaaacttattttcttctcatcctggaaataatgatattaaaaacattgtgtgactagtgatctatgactctgatatacaaacaatgcctattttattgtttctgtataataagcaagtcctgttgtgttcatttagctagaaatgaaaaaaaacccagcacacctgcattttgcatttaattaatttatggtggtgtagtattataccgtcttttaaaaactactggcaaattttaaatgtgcagtgcactatataaataggaatgagaagagtctattcatggcaaggtaattagagcatctttggctagaatatctctgagtaaaaatagctagtctcaatgttggagtaaggtaattaagtcctgaagaataatgatgaaaaccttttgctcagataccctttcttcatttaagttcaatgccgtacattcaaataaaatctgtgtaatcaaactagcccattaagtactactgagtgagataaattgtaatacctattctatatccttgcaaaagggaaatgcatgttatctagaaacataacagcttataaattaaaaacattcatttttcttctcttttgtcttatatcaactttttgtatatttatatacataatcacctaactcctacctcctcttctttcttccttcttcctcaggtaatgtacaataatacattatagtaaccaaaatcgagattgctggattttttttatgttcttagctctctgacaaagagagcttgcttgccctttttccccccaaatcttaaatataggcatctttcaatgagttgtctcagtcccattttttccccctgtaatccatgccttggtaaacctttattcctaccacaacactttatgcagtgattcccaaacatatattcctggtcaagtctcttggactccaaaattgtatttccagctgttgcctggatttctatatttgaaatgtaatgacatcttaaactaaatgacttcaaagtcaagaatcattctctagtccatctaatcatcccacctcctcttcacacagccttcactacctcagttcatgacaccatcagtcacttttgaacaacttgccgcattttacacatccaactaaagtcatgtccgttctacttatgtaacatcatcaaattcatctccttcattctgttctcattgcccttgctgaggttgaggcccacatgtcctcttgccaggagtatagcagttgctcttgatcttcacgtgctgcttcaccagtccattctacccacagttcatagatgtgctttcttaagaactggactggtaatgccattactctaaaaacttccactggaccttcgctgcctcttaatctaagaccagaatttttagcttcatttgcaaggcctgtcccagtttagctctttagcctccttttgcatatatgccatactctagaaaaatggaatggatttttccccctcagatacgttatgttattttccatccatatgtcttttcataatacgtaaccttcatgagggcaatgattttcttttaatctgttttgtttactgttttatccgtagcaagtaaaacctatatgtcacacgtagcaggtactcagtaaatatttgctgaatgaataggtaagtaaatggatagaagaagaattggaagatacatttcatgagactcacctattcctttctgactttgggttctgagcaagagtcctgtatcttctcagtaagttttctttgtttatgctaacttaagtgaattatattacttctaatctaatgatactttactgagacagcataaaaaagttagaatggcaacttggatagagggacttggtttagagacctgtttcattttgaaaaggtttctctcagctttgctttgtcatttacatagtataaatgaacaaaaccccactcaaaggtcagatatcccacaacccaaacatgtactgaaggaagaaacatcctgctttaaatggaacaacaatactatgtttttggctgcatgtaacaaagaaatttaataagagagtcatgtattaattacagacatatttatcctaagatactaatttatatactaattagttgattttcaaggcaaactaatttggttgtttttcaggccacaataaaactatccccaatattttgtatccacattcattttcttaataaatgaccaaaactttaggcaagaagcaaaagcagaatcatgatgaaaatgtgatgtcaaaactttgaagttttaactactagttatgtttcttaaggaatcaagacctgagatgggggactccagattcataacctgataaagtattttcaggtttgaatagatgtttgaaacacctttaaaagccaactacatagcttcagttatgtggaagaatgtgatagataaaggacagcttagattttaaaaacaaagtcaagaaataaatgtgtctataaggtacataaggctacagattaagaaggatgagacctgtttctttaccaaccaaacacttatgcagagatatatgttttcagtgaaacataggtgctgataaatatgcaattttctttggttataaaagattctaaggctcataggtattgctgaatgtttataattaagtaagcttactctaagaagcatgaatttagaacacaagaaactaaaataaattaagccataatttctgcctaagagaaattaaaagttcatgctttttttcatgactactggagtaattgtaggtatactgagcatgcttctttcatttgatttaattttgactctatcaatctatgccctggttaaaactaattctctcctagtgggcttttcttttctttcttttgtttttttttttttgagatggagtttcactcttgttgcccaggctggagcgcaatggcgtgatcttggctcaccacaacctccgcctcccaggttcaagcaattctcctgcctcagcctcccaagtagctgggattacaggcatgcaccaccacacccagctgattttgtatttttagtagagacggggtttctccatgttgaggctggtcacgaactcctgacctcaggtgatccacccacctcggcctcccaaagtgctgggattacaagcataagccactgtgcccggctgtgtccttttcaatagcatgtaattttcttacatattgtgaagtgttttagatgattttttccaatcctttatttatttaatattttgcttgataaagtataattgtacatattcatgggggtacataatgatagtttgatccacataatgtatagtgatcagggtaattaacatatccattgtctcaaactagatgatttttaatgaataataaactgatcttatttctaactagttaggaaaaacaaagaattcttcattatatttatgcacaacacaagggtacttatgagaagataacacttaccatctgggacacaacatttctaccctagtattctattcatggtgatagctaataactgacactattctcagggacagtagcagtggtagtattgccactattatagcccctactctagtcactgccttccagcaaacatgttcttgttatatattttccaattaacacttacataatgtctgaaatgtatggtggtaggtgttttagcctgttttacttcaaaataggaacgtaaggaagataaacatatacataagaagtgagtgtttaagcccatactaaaatttacatgttatactttagcacaacaccttcttcgaagtaaaggggacaactgaaatgtatcatcttgccatgtataaaaaggcatgtttcaaagcataatgaccacactgtaagccttcactctttctctaatcttctttaaatttgcacatgggtaacaggtcagacattcagaatagtgtagccaggtaaatcagaattttcattatctggatttgtatgcctcactgggtgcactgggggaggcctctatgacaagcatgttaaatgtgtacttttctggagcccaaaatgctgaagacattgctttagcctaggtaattcttctcagagaagaataattatttacacatgtacacatacaaaattatatatgctgttcaatatatgttttaaataaagagatatacatacaaattttctagctcttgcttacatttttcatctatagtgctgtaatgcaatgaaattaagcctctctggtaactgcagttctccctgagaataagtttctgttatagtaccattatgctagagggtcccacatatgcctgaaggaaatactttatgacagttgttaatattatagccaaatgatgcttttattccaatttaatcattcataaaaggcacaaatagcacctagtaagtactttcgtttatattttcccgtgcttttaaaatgttgattctatagcatcactcaatattaatataattttaagtattatttacttgtatttggtttgaaatataatgtctgccacttaatggattatttactacctgaaaaaataaactttgaggccagatgcagtagctcacgcctgtaattttagcactttgggagaataaaattgctgaggcaggaggaacgcttgaggctaggagattgagaccagctggggcaacatagtgacaccctgtctctacaaaaattaaaataaaaaaaaatagccaggcttggtgatacatgcctgtagtccagttactccagaggctgaggtagaaagatcacttgagcccaagaggttgaggctgcagtgagccatgatcacaccactgcactacagcctaggcaacagagcaagacattatacccccaaaaataaataaataaaatttgagcctagtagttgttgtcatttgccacttttctagactaaatcattattataagctataccatattactgacatgttttgattaatgtaacaaatgcttttccagcttaacatttttcacagcttattttgatatggaatttctcttaatgttatagtaacatctaaaaatagttttatttagataaatttctttaaaatgtatagtacaaataacatctttgttagatctgtaactaagaggcaataaatttgaagcacactccatatgagaaattgtaaagccaaactaacaaaatcgtgattactttgggatgacacagtgtcatgaaagtcaagaggagagtatcatgaagactgaaaagtgatagcactgaatgctgctgttcttttaaagatgaaggttcagctatcagagcaggaacctaagggcaaaatctgaaattaataaatcaagaaatagcaatataagcatatggctatttaggaataattattactattagataagaagttgcttctggaaagaggactcatgacaacaatggaatcatgggctgttttgtgatactggatttttaaatcatgaagcatgtgttatattttaagccaaaaaaaaaaaaaaaaaaaaaaactggggagggatcttcgtgttggtaggattcgttttccacctttaaaaatttaggtaaggaaagtgggatagaagccagactttaaggagacaagaaatggaaaggaagtagaacagcagccatagactagttcctcaagaagcttgacctgaaagagttatgtatcagttaaagaccatgagatagaggagggtaatctgctgtaagttataacttacacagtttgctgatttttatcatgaattaaaaatatgtacttgtttaaacgttgcactgccatttaccatttgctaagtagatgcataagaacattgaggccaaaattacagtcccaggagcctcagtttcactgtggagttttccctcagcaaatgtttgcttttgcttgtccttttttcttagctaaccttggtttctagatcaagatgattttccttctttgttttcacacagcatattcaattgcaccacactctttttaatcacaattctttctgatgggtttttgattggatccaaatttgcaggctgggccctgagaatctaattcagtctgttgcagtacttctcaatcattttagtcttagaactgctttatatgcttaaaaattattgagggccctgataatttttgtttttgtaggttttgtcttttgacattttccatattagaagtcaaacctaagaaattttaaaaatgttctttatttaaaataacattattcatcccattatatattaatataacatttttctgaaaaagttactattttccagtatcaaataattgaagaagagtgtatattttttccaattaaaaaaattctcttagcaattttcaatgcgttgttatttactatagtcatggttttgtacaacagatctcttgaatttactccaactgaaattttgtatcctatgaagtagttactataattacagataatcaggaaaattgacaaatattaagaacaactctcattcattcaaaatatccaccacttttgggaagtaaaattatctgctcttgtaataaaattagataaaatcttaaaatcaattagatagtacttgagctattacagctttgaaaatgtgtgtccctgtgtttgtgcatgcacacacactgaagtataatttattcagaaacagggcttgttcccacttggcaggagtgttgattttctagcttatctgcagtttgaggtaataagtctaacaagttttgggagatcttaagtattatactgtagtttgaagactgatttgttacatttgcaaattggttggtttccacatacagaccttaatacacctacctgtgttagttactttctaaatgtttgttattgctacaaccatacttacgtgtttcattgaattacaagttccttaagaacagtgatggtattttaaaaatcaggagtagcccaccatgactaggtatatggtattgaagtgctctctgcatatttactgacccatagttggtagataagggttactataaatagaaatagtccgccttattgccgataatggtggtaaaggcataactctggaaattatttttatttttaaaataaaaatgatagaatgagcactctatcttaagttgggtcctactatgatatttgtaacttagatcacttggagacatttcttaggtaccggctaattatttgttaatcaaaataggagccaagcttctaatagaagtgtgtaaaaaacagtaataatgatagttcctggaaaatcacttgcaaatattcaactgcaaaataaacttaagaacttttattaacaatatagattattatgaaagtcaagggatgaaaactgaagctctacacacacacacacacacacacacacacacacacacacacacacacgctttgagatagggtctcgctctgtcacccagactagagtgcagagtggcacaatcacagctcactgcggcctcgacctcctgggctcaagtgatcctcctccctcagcttcctgagtagctgggactataggcatatgccaaatacatctatacatgtaatttccagagttatccctttactacaattctcaccaaaaaatacaaaaatgcgactaatttttgaattttttgtagagatgggggtcttcctatgttgtctaggctggtcttgaactcatggcttcaagtgatcctctctccttggcctcccaatgtgctggtattacaggtgtgagccaccatgtctggccctgtctttttcaatattaatttgaagaacatccttgaatcaatgactattacttgaatataaaggccaaatttagagtttatcaagactcaatagataattacagtagataatatttactgagtacacactgtgtgccaagcactgtgatacatactgtatgcattttcacatttaatcctcaaaacaagtgtgttataattagggcttagcaaggtttaataactattcctagttaagtggcagagctgagagttgaacccaagaatttgaacggtgatttttaagaaattattgatgttgggaggctgaggcaggagaatcgcttgaacccaggaggcagaggttgcagtgagttgagatcgtgccactgtactccagcctgggtgacagagcgagactctgtctcaaaaataaataaataaataaataaataaataaataaataaataaaataaattattgatgctttgaaacgtatgttgttaatatagtcctgtattcaagtgttagcacacaattattttaaaatgtggagctcatcaattattccaaagagaaacttgttataaagtccctaaaatttcactaaggggaaaagctcagatacagacgtgaataatatttcactaagatataagattattagcatgaatgagatattatggggatgcaatgtaacttaaccatatgttattaaaagtgtttttattacattgatgagttatacattcatgggaagtatttatttcatatgttttgtagggagaaatttaaaaggatttggttaaatcattttgaggacataatttgagagaaacataccttttgcaatatttttatatccctgaaaattttttgttaaaagactccatctttaagagagctagagattctctcctggaaagtgactagaccagtgataaaacattatagatctggagtgaacaaattatatcactgcagttctaggggggctattgatataatttctagaaagggaagtttaaaaaatgcctgtatccatagaagtagattctgtagaaatacactgtagaagtacctgttaaacttctcccttccttattatgaggtaaaaaaatcaactatagctattgaatgtaaatgctatttgattatagtagactcttccagatgtaccccattctactcagtacatctgtttctttcactaagcaatgtgttccactcctgaagaatgtttgtctttaatgtatcacattgaaattccttcttattattttatacctttacacagttgatattgttttggttgttattttgcattgacatagttctttatattttcagtgacatcgttctttatatatgcttgttaacatttggcagttaagcatattactaagtttctttttaatgtttttaaagctagttaagagttttaggaaaaatattttctggtgtcaatggatacagaaggttaaatcatttgtctttgtcttgaaagacttaatcagaattgatatcattatatcagtggttttcaaccatggtcgtacattaaaatcgcctaagggaagttaaaagcaaacaaaaatgcgcattaaaaaatgaaaaccagaaaacaatgccaggacctgagattctggtcatctgagattctgatttaagttgtctgggacaaggtccaggcaagagtatgtttaaattactgcccaggtgtttctgatatgtgaccaggtttgacagtcacaggattgaactatccgtataaagcctccctcagtatctaggggggattggtttcaggacgcccacagacgccaacctccaggatgctcaagtctcttatattaaatggtgtagtattaacatgtaatctacacacatcctcctgtatactttaaattatctccagattgcctataatacctaatacattgtaaatgctatttaaatagctattaagtgtatttttgtttgtatttttattgctgtattgttatttttttcctgaatattttcaatcactggttgattgaatttgcagatgcagaacctatggattggagggtagattatattctgtgttcatctcctcttgggtgttaaatatacatttagtacagccatgttgtacagttcaaggagatgctgttcacattgtgttctatatgaatggcacttccttcaggaatgaatggtgccttctggaagttggctgctagttgtataaataagctaatggcttcagtaattgctgttagaggaatatgcattatggcagtagccttcttcacttccggcgtacaaatgattgccttgacagtcactctctatttaaaactggtcagatgtatataacagcaagaccagaaaaagtttgtattttacagtagctgaggatttcaaagttcccaacaggaatgatgggagctgtgtatgaaattaaaatttgcttgaggtttcagaactaagagcatgggaaatggttcagtataattttttcatcattgctgtttatggaagtattatggaaagctgattgcattaggcagggttccctagaaagacagaactaatatatatatacacacacacacacacatacacacacacacacgttatatataatatatatgtatatactttttgtttgtatttttgtataaactcccatgtgtaaatatatatatatacacacacatacatatatatatacacacacacacacatatatatatatttatgtatatgagtttattaacttacatgatcacaagttcccacaacaggctgtctgcaagcttgaggagcaaggagagtcagtccaagtctaaaaacagaagaacttggagtccgatgtttgagggcaggaagcatccagcatgggagaaagatgtaggctgggcggctaggccagtctcaccgttttatgtttttctgcctgctttatattcgctggcagctgcttagattgtgcccaccagattaagggtgggtctgccttccccagcccactgactccaatgttaatctcctttggcaacaccctcacagacacacccaggatcaatactttgcatccttcaatccagtcatgttcacactcattattaaccataacatttatctttctaaaatagaacaggaaaatatccatgattataaaaagagatgcctcattaaatgctattagaataaagaatacatggtacatctattgagtctcttgctaacatgacaaacatacattgctaactgtgcgtaggttctttacattttaattaattatcagtgatgtaaaaatcactggcctttaacaacagtttgatttcaaacccattaaagaggctaaggcaaaaatgtggctttagtctctcagccccattgtgtattctttactgtggtgaatatcaaaacagcagttaattatagtagtaccatttctgttcttcatttcattatctctgtcttgcactattattttttgttgctgctggctatacagcatcaggcctggcaccagcgaagtatgaacacaatgccagcactgcattcagcacaagaatagaaaggcagatggcagattttactatttatagttgtagccaatctgcctgaggtgagccctgccgaaatggttcttatcaagaatgttttcatttattaaagggataggaaatgaaagccaaataaaaagcctcagtcctcaggactctgagagcaaaactcttgctatagattgcaaagcaattccaagtattgactagatatttatgaactagaaaattatatatttaactctctagtctcaaagtaaagacttcaggccagcagtgacttcacagcagaacttgaggaattcattgttcagtgaagttgtgctgccatagcaactgatgcagagtgaattttaattattaagatcaaaataggcttatgataaaaactatttaacaacatcaaatatataaactgaattgtttttactttctcactaatcatttcttgactgctatagaaacagcacaacataactctacttcacatttgattctttatattgttttaaaaaattcattgtttgaaactccagtaaatattttagaatatcaattagtatgttgagataaacattgtgttcaaaattaaaatggcgtgtgaataatctagctttcttatcctctagacatctgatttaaaaagtgttttagtctcggctgggcatggaggctcaggtctgtaatcccagcactttgggaggctgaggcagggagatcatgaggtcaggagattgagaccaggctggccaacatggtgaaaccccgtctctactaaaaatataaaaattagctgggcatggtggtgcatgcctatagtcccagctacttgggaggctgaggcaggagaatcgcttgaacccaggaggcgcagtttgccgtgagctgagattgcaccactgcactccagcgtggcgacatagcgagactctgttgcaaaaaaacagtgttttagtttcaagaacatattgtggtgataactaaaacaccgtattgaagaacccaggtggttcatgtaatctgaaatatagcagtgagttatgatagtggctaataaaatttatattccacagaaaataaaaaccttaattataggctaaagaaattaatttgattcaatcatagtaattaaagaaaaatattttgattggatgtattggaatgtagcagattatttagtaatattctaaattattgcaaagcatctgttcattttaaatcatggtaaaatctgtcatgtgagtttattgattttatttaaatgaaatgattagttgattggaaattttcattttttcaatggcttatactttgatagaagaagcttatagaaaactagttttggaaaggtacagctacaatctaaatttagaatcagattttttgcttcatgaattttatgttccttttcaaaatatagcaaaaaagcaaaaaggacttctggttagatacaaagatatgcagatagcttaggtctttcccaatgaccctccaaaagtaaagaagtttttaaataaataaaattgcaagggcaaagaaaattagcgtggagataagtaataaaatttggaagctggaaggcaggtggatgagtgctaactaatttagacctgaggaatctcaattataagtttgtagtggggaaaactgacaaaaatctgatgtatatatcagcatcttatacaactcagaaattggaaacactagggccttttggaagtaggagttaaagtggtggctgggtgcggtggctcacacatgtaatcccagtactttgggaggttgaggcgggcggatcaggaggtcagaagttcgagaccagcctgaccaacatagtgaaaccccatctctactaaaaatacaaaaattagccagatgtggtggtgcgcacctgtaatctcagctactcaggaggctgaagcaggagaatcccttgaacccaggaggcggaggttgcagttagctgagatggtgccactgcactacagcttggacaacagagcgagactctgtctcaaaaaaaaaaaaagtagtagttggttttcaagatcccatcctcctcatacagctaggccgtcatacagtaaagcctctcctacttggcagaagactaaaggcatatattctgtagagggtaaaatatagttgccaggactgtggatattgcagaacagcagaaggcagagggcaggtgtataaggccattcttgcattgctataaagaaatacttgagtccagacacagtgactcaaacctgtaatcctaacactttgggaagcctaggcaggtgatcatgtgagctcaggtgttcgagactagcctaggctatatggcgaaaccccatctctacaaaaacttagctgggcatggtggcatgtgcctgtagtcccagatactcaggaaagcttagctgggaaattcacttgagcccgggaggttgagaccttgtctagaaaagaaaagaaaaaagaagagggggaaggaggtgaggggagggagacgagggaagggaaaaaaaagaaaaaagaaaagagaagaaaaatacctgaggctgtgtaatttataaagaaaagagctttaattggcttacagttctgcaggctgaacaggaagcatgatgctggcatctgcttagcttctggggaagcctcaggaaacctacaatcatggctgaggtgaaaggggagcaagcatgtcacatggccagagcaggaacaagagagagaggtgggaaatgccatacatttttaaaggatcagatcttatgagaactcactattgtgaggatagcatgaagaggatggtgctaaatcattcatgagaaatctgctcccatgattccatcacctcccacctaagcctcacctccaacactgaggattacttttcaacatgagatttgggccaggatacacatccagacgatattagctggtgaatagtagattgaatcagagatagtacatggaatttttgcctgttgagtgttgagacttcagtcttctgttagccctcagcatattggtaatcaagtatatataatcaaggcaagagaccagaagagttttctatgccaaatttaagaagtccaagaaagaaagacttacaaattccctgggagttccccagggatatagctcagtcacatcatccttcaatgaacacaactgtcaacaagccctgtccgttctactggccttccacttagcttccacttagccctattcttaaatatgagcatacagccaaatatcattaggcattggaagacagcatttgacttttttttagagaccaaaacaaaaaaataaaaacaacttgaataagactatgcagggaagagggaaaaaaacaaacataaaaagaagctaaactaaaattaatatctggggagatgatagaaaatgaaacaaaatgaagatttttaaacatttcttttattgattcataatatgttatgtatttatggggtacatgtaagtatttttacatgcataaaatgtgtaatgatcaagtcaggatatttagggtatcatcaccttgacaatttatcatttctatgttttggtaacattttaagtcccctcttctagtggttttgaaatatatgataatactgttgttaactatagtcagtgtagtctaatatctagtgttagaacttatttcttctatctagctgtaggtttgtacccattcattgacctctcttcatttccacctcccaccatcacgctcttccctgcccctggtacctcattctattctcaatttgtgtgagatcaagttttgtagctttcacatatgagtgagaacatatggtatttatctttctctacctgggttatttcacataccataatgacctcctgttacaatcacattgctgcaatgacaagattgacttccttttatggctgagtagtcttccattgtatatatgtacaacattttctttatccattcatctgtcaatggacagttaggttgattccatatcttagctactatgaacagttctgtgataacatgcaagtacaggtatccctttgatatactgacttcttttcctttggacagataaccagtagttggattgctgaatcatatggtagttctattgttgttgttgttgttgttgttgtttttttaagaaatctctataccgttttccatagtggttgtactgatttatattcctaccaacagcgtataagagtttccttttctccagatctttggcagcatctgttatcttttgtttttttaataatagccattctacctggggtaagatgagaactctttctggtttcgatttgcatttccctaatgattagtgatgttgaacatttttttatatacctgttcgtcatttgtatgtcttctgttgagaattgtctatttgtgtcatttgcccactttttaatgggatatttgttttttcattcttgagttccttggatattctgaatattaatcccttgttgaatgaatagtttgcagatattttctcctgttcaacaagttgtctcttcactatgttgattatttcctttgctgtgcagaagcttattagtttaatatagtccccttgtttatttttgttttagttttttgtgcttttaaggtcttagctgtaaaatctttgcctggaccagtgttctgaagtaatttcactatgttgtcttctattagtttcatagttttgggtcttacttttaagtctttaacccatcttgaattgatttttgtatgtgatgagagataatggtccagtttcattctttggcatatggatatccgattttcccagcaccatttattgaagagtgtgtccttttcccagcatatgttcttggtgcctttgtcaaaaatcagttagttgtaaataggtggatttatttctgtcttttctattttgttccattcgtctttttgtctgttgttgtgctattcccatgctgttttggttactatggtcttgtaatataatgtgatgtcaggtagtgtgctacctccagctttgttctttttgctcaggattgctttggccatcctggctcttttttggttccataaacattttagaattctttttactaactctgtgaaaaattacattgtaattttatagggatcgaattaaattttagattgctttgggcagtatggtcattttaacaatactaattattctgatccatgagcatgggttgtctttccatttgtttatacccttttcaatattttccatcagtgttttatagctttttttggtagagatttttcaccttcttggtcaaatgtattcctaagtattttattttactttttagctattgtaaattggatttccttgatgcttttttggctatttcattattggtgtctagaaatgcttccgatttttgtttgttgattttgtattctgcaactttactgaatctgcttatcaactctaagagattttttgttggactcttttagtttttctaaacataagatcatgtcatctgcagagagggacaatttgacttcctcacttccaatttgtatgtcttttatttatctcttgactgattgctgtggctggaacttccagtactgtgttgaataggagtggtgaaagtgggcattcttgtttcattttgtagaggaaaggctttcaacttttttcggttcagtatatgttagctatgggtttgtcatttatggtctttattattttgaggtatattccttctatgcctagtttgttgacagtttttatcatgaagggacattgaattttgtcacacttttttctgcatcagttgaaatgatcgtatggtttttgtctatcattctgttgatgtgatgtatcacactgattgatttgcatatattaaatcatctttggatctctggtataaactccacttgatcatgatgtattatttgattttcgtttccctgatgattagtgatgttgaacattttttcatatacccattggtcatttgtatgtcttcttttgagaattgtctattcatgtcctttgcccatgttttaatgggattatttgtttttctattgtcgactgagtttcttgcatattctgggtattagtcctttgttggatgaatagtttgcaaatattgtctgttgtgctgttgaattacggtttgctagtattttgttgaggattttacatctgtgttcttcaaagatattgacctatagttttttgttgttgttgttgttattatgtccttgtctggttttggtatcatggtaatgctggattcatgatatgagttagggaaaatttgctcctcttcaatttcttggaatagtttgaggaggattggtattagttctttgtgtgttcggtagaactcagcagtgaatctctccagtcccggcttttctttgttgggagacattttaattattgcttcaagttctcgttactggtcttttcaggttttctgtttcttcctgattcaatcttggtaggttgtatgtttctaggaatttatccattttctcttaagttttccagtttgttagtgtatcgttatttataatagtctattatgatcttttgtagttttgtggtatcaattataaagtctcctttttcattttttaaaaatttgggtcatttcttttcctggttagtctagctctagtggtttatcaattttttcttttcaaagaaccaatttttcatttcattgatgctttatattgcttttttagtatctattttgtttagctctgctcttatctttattatttcttcctttctaccaatttgtggtttggtttgttcttgctcttctagttccttgaggcatattgtcagattgtttatttagaatctttttactttttaaatgtaggcatttattgttttatatatctcacttactactgcttttgctatatcccacacatcttggtatgttgtttttccattttcatttcttgcaagaaatatttgtatttccatctgaatgtttttattgacccagtgtttgttcaggagcattttgttcaacatccctgaatctatggctttcaacattcctcttggttaaaacttctagttgtatttcattgtggtctgagaaaacatatgatttttattttgtttttttttttttttttgagacagaatctcactctgtctcccggaatgaagttcagtggcacgatcttggctcacttcaacctttgcctccctgattcaagcgattctttgcctcagcctcccgagtagctgggattacaggcacctgccaccatgccccgtgaatttttgtgttttgagtagggactgggtttcaccatgttggccaggcaagctggtcttgaactcctgacctcaggtgatccgctgcctcggcctcccaaagtgctgggattacaggcgtgagctaccatgcctggcctatgatttctgtttttacaaatttattgagacttgttttgtgccctaacctatggcccatcatggataatgttccatgtgctgatgaaaataatgtctattctgcaatttttggataacaatctctgtaaatgtctgttaggtccattaggtctgaagtccagtttaaatccaatgtttctttactgattttctgtctagattatttacctaatgctgagagtggagtgttgaagtctcccactatcgtgttggagcctctgtctccttaggtctaataatattttatttatgaatgtgggtgctctagtgttaggtgcatatattaatatatttagaaccattatatcctcttatcctcctcctggaataattactttatcattatatacttgtcttttttttttttttttttaccttattttgactcaatgtctgttttatctgatgtaagcacagctactcttgcttccttttagtttccatttgagtagactttttccattccctttactttcattctatatgtgtctttacaggtaaagtacatttcttgtagacagcaaatagttaagtcatttttttaattcattcagtgagtctatatctattaagtgaagagtttaattcatttatattctaggtggttattaatatataacattttgttgctgtcatatagtcaattgtttttggttcttttctatattttttgctcctttctcttttcttgtttgtcattgtgttttggtggttttctgtagttgtacctttctcctcctcatttgtgcttaagttttaaacatttgcgtattttcatgatggtagatggttgtcagtttgcttccaggtttaggactcccttgagcatttcttgtaggtctggtctggtggtgatgaattccctcagcttttctttgtctgggaaagactactttttcttcattttttaaggataattttgtttgctatggtatccttgactggccttttttttttatttcagcgcttggaatacgtcatcccattttctcctggtcagtaaggtttctgcaaagaaactcattgttagtctgatggttttttttttttttaattataggtgccgaaacacttttctctttttgtttttagaagtatttctttgtctttgactttagacaatttgactataatgtgctatgaagacctttttatgttgtatctgcttggggatctgagagtctcctgtatctggatttctaaatatcttgccatacttgtctgttatttcattaaattggttttctaaccctttcattctcccttcgccatctgggaccctggtaattcagattttggtcattttatgatgtctcacatatcacaaatgtttcactcattcttttttattcttttttatttttggtctgtgttatttctaaagacctttcttctgcttgttctactcttttgttgaagctgtagttccagaacttttgtctggttctttttttttttaatgatatctatctctttggtatatttctcattcatgtcctgaattatcttttgttttttgttttcagaattctcttatatctccctgagcttctttagaattgataattttcattttctgggatttcatgaatttctttttgattgggatgtttctggggaattattgtgtttctttggaggtattaatatttccttgcttttccatgttttctgtgttattacattaatatctatacatctcatataacagtcgcttctttcagttttttgaatttctggcttttatagaggaggacttttcctgaaaatgcatctatgatgttggttttttaggacactttggctttgattctgggtgcaggctagtagtataatctttgcatgatttctttaattgtaaacaacaccagtggtgtctgtgatttccttagtggcttagggtgtagttattagtggaggttgtgctggagtttttatggggatttggataccaaatagttcagtatttggggcctagtggtggcagtggtaggtttggtgtgcctgttcctgggcctcagagttgcatacaccagcactgatgttggcacgtctaggtgggccaatacttgggcctccaggtgacttacccaggtgttgaagccttggttccagcaagtgggcaggttcttaggcctctgggcagctagtgtggcatgggcaatgacagtgacaatggcgggacaaccctctggttcctgagcagtttgctttcatattgggttgctgcaatgggatgaacaggccagtctccaagccctcaggcagcatgtgcttgtagatgttagttgtagtggtattagttggatggaaaggcccaccctcaggcccatgggagtagtgttcagatgccaacaatggtggactgggctgggtactcccctgacccccagactctgctctggcatggagaaggcaaagcttggccaggtaggcttgtccttaggtcctctgatagtgagtgcaggtaccagccatgttacgcaggagtgggtcaatgcgcatgctaccgtcaggatgctcagctggtgggaggaagcagttgtgctgctgccttgacactgggaagggcgggactgccttcagtggcaggcagcctaggcctctccagtggcaaggcagcagcacaactgccttgtcactgggtgtactacttgcacctcagtcccagtggtgcttgtgcctcagtctcctgtgcagtagcccatgtttgctcatgtctaagccacataggcagctgccatgcttctcttgagcttcagccctggcactgttgggttccaggacagtacataatctgttgtagacagcactcaaaaatggtaccttgctgtagctgtttaggtctcagggagtgtgtaggacccagcatgagctctttcccctccttagagcagtgctgttgcacaatctcatggtgttaccctctgttagtttcagagcctgtaaggactgaggggttctcccaaagctaggatttcaggagtccatggtgggaatgtgatctactgaggatctttcaattaccttttccccacattggggagtagctctcagctccctgctgatcccagccaagcagtctgcctcccttcctttctccttgctttaggtatttcctgtcactttctgttaaatcccagtgttctctcttggatgatctatttgaagtatggttattcactcactattttggttcttcttagtggaggaagcaagtaagacaatcaaaaccaagatttttatacatacatacatacatacatacatacatacatacatacatacatacgtacgtttgtgtagggaacatgcagggtattaaaatcagcttgtggaatttttttttaaccagaaaaaaattttaattgaatctaataaagggttagaaaatgaagttgagcatatctctagaaaacagtacagagagataggaaataggatagacaataaaattagagaactcatagcagtaaaaagaacagacttgctacacataaccccatgggtgaatctgaatacacagttattgagtgaaagaaaccattcacaagggagtatatagtagacgctttcatttatgtgaagtataagaatagataacactacgttcatggtcataatagtggctacctattaaagatggctataatacaggttagttataacacaggaagatgggttgattcatatacctatcagagatggtataatacaggaagataaattgtagttcaccaagtatatatacatggaaaaattatttgtgctatatacttaagttttgcttattgtgtattataaacacaattgaaataatagaggaggaaaaaatcagagaagcagtctaagatgcacaacacttcagcaataagaatttcagatttagataaaaataggaaaaatatagggcagaaaaaaagaaatacatcaaggatgttttctggtattgaggacaagtattcaaaatgaaagggcacactagttatccagcatattggataaaattcaataaaaatgactgtgtggcttagacaccagccaggggcagctggttgcatctttagttcaagctacttggggggccaaggtggaagaattgctttaagctaggaatttgaggctgtagtgtgctttaatcacacctctgattagccactgcactacagtccaggaaatatggtgagatactgtctcgggggtggggggggggaagatataccaaaacatattattgagtaattgtggaaccctaggaataaataaaagatcttacaaacttccaaatgagaaaaatataggttttgctgttcaatagaaatactggaagaaaggagacaatggaacatcatcttcaatatctgagaaaaaattatttccaacctagaattttatacctagcaaaattaccaattatgaacatctccattcagcttttctcaagaagctactgtagtatgtttgctgccaaaaataagaaaacaagtagaaaggaagacataagatatagaaattagaaaatctagtatgagtaagagaggtgaaaggaacccttgggaagagggaaaggaaaattccaactcgacagctgattagagggcctattgagaaagcagtttagatcagaagtcagaaggatcacaggagttttttgttttttgtttttttgtttttttttttgggacacagtcttgctctgtcacccaggctggagtgcagtggcacagtctcagctcaccgcagcctttgcctcccgggttcgagcaagtctcctgcctcagcctcctgagtatctgggactacaggtgcgcaccaccacacctggctaatttttgtatttttagtagagacagggtttcaccatgttggccaggctggtcttgaactcctgacctcatgatccacccgcctcggccttccaaagtgctgggattacaggcatgagccactgcgctcagccagatgtttttcaagaagatgaaattgataaatattgagagtatttaaacacattcagggaagattcataaaactgggggactgttttgagtacatagaaaacagcaaacaaaaaacaagataggtatgaactgtggaggaaactgagaaatggaatggaaagacaatactatattatccagtcatgaatggattatgtaactacatgactctattaatagaaatatctcatccagatagtgtattacatataacggaatactataaagcagcaaagaggagttaatcacagatatataaaaaaaaatggggagtaagaaaaacaagttgccactaataccacttataacaagttttgttgtatttctaaaaactgataaaaaactatagaatataacatgataaatatccatgtatccacaactaagcttgagaaataaacactatagccgggcacagtggcttacgcctgtaatcccagcactttgggaggccgaggtgggtgggtcacgaggtcgggagatcaaggccatcctggctaacacagtgaaaccctgtctctactaaaaatacaaaaaattagccaggcgtggtggggcactcttgtaatcccacctagtcgggagactgaggcaggagaatcgcttgaacccgggaggcagaggttgcagtgagccaagatcgcgccactgcactccagcctgggtgacagagtgagactccgtctcaaaaataaataagcaaacaaatataatggaatccttccatgcgctcccctctggtaccatcgctcttcgtctttgtctgaaggtaaccactgttttaaagttcatacttgtcatttctgcatacgtctttatactacatacagttgactcttgaacaacatgggcttgcactgtgcaggtctgcttacatgcagattttcttttacctctgccacccctgagacaacaagaacaatccctcctcttcctcctcctcctcagcctactcagtgtgaagacgatgacgatgaagactttcatgatgatccacttctatttaataaatagtaaatatattttctcttccttatgattttcttagagtttcttttctctagcttactttgtgtgacaatgtagtatataatacatataacatacgaaatacgtgtttttgtttttgtttttgttttttgagatggagtttcgctcttgttgcctaggctggagtgcaatggtatgatctcagctcattgcaacctccgcctcctgagttcaagcgattctcctgcctcagcctcccaagtagctgggattacaggtgcccgccaccacacccagcaaattttttgtatttttattagagatgaggtttcattatggtggccaggctggtctcaaactcctgacctcaggtgatccactcgcctcggcctcccaaagtgctgggattacaggcatgagctaccgcgcccagcccacaaaatatgtgttaatcaactgtttatgttatcaccaaggcttctggctagcagtaggctactagtagttgagtttttggggagtcaaaagttatacatggatttttgactgtgcatagggccagtgccccaactcctgcattgttcagaggtcaactctgtgtgtgtgtgtgtgtgtgtgtgtgtgtgtgtgtgtgtgtgtgtgtgtgtccctaaacaatatttagcaagttgactgtttttaaactttatatcaatggtgtatattaaatatgatcgtctacagtttgcttttacagctcaatagtttaaaaacaaaacaaaacaaaaagctgcagtaatccccctgccgttattcatgaggattacatttcacgacccccagtggatgtctaaaactagattagtactaaatcctgtatacattttcctatacatatgtacctatgatggtttaatttataatgtttgcacgggagattaaaaacaataactaataataaaatagaataactagagcaggccaggcaaggtgactcacgcctgtaatcccagctctttgggaggctgaggtgggcggatcactggaggttaggagttcgagactggcctggccaacatggtgaaaccccgtctctactaaatacaaaaattagccgggcatggtgtcatgtacctataatcgcatctactcgggaggctgaggcaggagaattgcttgaccctgggaagcagaggttgcagtgagccgagttcatgccactgcactccagcttggatgacagagcgaaactctgtctccaaaaaaaaaaaaaaaaaaaaaaaaaaaaataattagaatagtatgccagtatcactaatcttgtacattgtactttggagcaattattagggaaaataagggttacttgaacatagcactgtgatattgtaatagttgatctgatgacagttgaatggtaacccagaaggtgactaacaattagtgtatacagtgtggtttgattcattgaggttatgctcacatcatggtcaaaagatgaaagtggaatggtttatatctccttgttctcaggaaaaaataaaagtttttgaatgccactgttcaacttgacaccataaggttaagtattgttttgttttcttgatctgttgcagttaagacaatttgcatgcatcttttaggtatagctgtaaaattttctcttttgaaatgtcatgagtcaaaattgaactgtgggaaataaaaaataaagaatttgtctctatttatttttttaatgaaaatctctttgtatctcagaatttcatgatggtctaggaggcctgaaactctgtaggtctagactgtgaggatctctgagaactgcatgctctgcatattataggtactcaatcagcactgattgctggtggcttaaactgcaagaactacgttatagccagcaagcaaagatgcccaattagtcagtgagtgatttgccaggggaagtctattttcagcctgggtagttactattaagagaggatcctagaagctgcactttttgcctgctaggtgttcggaatacttttgaaagaactgaagtgttcagttcagtggagacatcttagatcctctatatttacaaatttacagcccttcatttcccaatttcttcaacctttttccttcctggaagtcatgctttcatagtttaggggaaataattagttttataaaacattcagttcctaaaagattaataattccaaaggaaaatatattaattgtagttatgaaaaatgcactgacaacaggctatcagctttcagaattgcttcttagtttttcattaaaatagaaaactcaaaatgtctcatgagttttatagaaaaattgagcatatttaaaaattaaatatgtataattttataagaacaaaaaaggtttgaccttgaaaatttttttcttcagttttattctgttacaggacagtgcctgcacattagtaggcacttggtgaagatttgtgaaatgaatgtgatagcataatgttattggaattcatcattgctgaattaatgtatatttgtggtttctgtaggaaatcttgtccttatctcacctcaggtttttaccataacatttttttcctctttgcaaatatcttttgattggtattttaattattgataaggtgtgcacttggaacattcattcaaaatgaataattccagtgtcaggggaaaaaaaaaaacctctggaaatttaatgtatggctttttttaagtgtatatatcacttttttttccaaaggacagtttgaaagtgaaatactccaaagtaaaagcaattttaactttctgaaactgtgtatgtttgtttgcgtgtgtgaaaaaagatggaaaaaaggaaagatagaagaagggagggttgggagattgagagagggagagagaggagagaaatgtgctttctatgaaattttgacacatttccaggataactgagaatgataaattaagtaaaaagaaaaataagcattcttattttatgtgggaagaattatgctttttttcctttaaagaaattgatttttatgaaaacaagcaataatagctttaacaaatacataaaaatttttagatcaagctgataactgcttttagataatagcctaagtcactgattagaagggaaaacccatctttggaaaatatcttttggaaatcatcttttgtgtatcatgttaaaataaaaatttttcttagtcatttcaaggaaattttctaacattaggaagggaaatattgttaattcttttcagcagaaggtagagtaccggcattaatgacaaatacatttttaccttagaccttttaaataattacttttttccttttaatagagaaaaggacacatttagatattggatgtttattttacattttaaaacaattttctttggggaaaaaatagggtgaaagttcttgtaaaaccaaggaaattttgaatttgtagagcataagtagatactgacaatttttcttgctacatctgaagttagttatttgacttaaaaggccaacaatctcatttattggtttctttgaagtagttggttgccttttttctctcccacaccaaactataaagataatttcataaacctctttttagttgagcttttgggttttgctaatttttctgacttagatgaagtttcaattaaaaatagactataaacttatatgtgggtggcagttgaatgagttgctatgacagttcatattatgaggttgaaccaaatgcaaagtagcttaacagaatttgagaaacatagagctatatcagtactaatgattacccttctttaacctatgctgcgtataaaggaacatgcctttctctcagggtacaaaagttttactggagaaatcagtgaagcctgtaacccttatcctactgctactaagaacctattttcctaaggaacaccccactttcccacttgtggatattggtaaaaggtcttgggaatatcaagtctggtctgtattttcccatcctctacaggtaatctcagaagaggtgcttaataaatgctatacaccatcatccaattcttgctcctcctgttcctgaaagaaagtttagccaggcagggtggcgggcacctgtactactatggagagaggtgtagagtggtgctacctgagagcataacactaatgatctgccatcgtgtgaattttccatatttttctgcattgtttgtggtcattgtggaaaagtatgattctgatgcatgtatcaagatcttttaaagaacacaaaaaagttataatttttttcaactctaaaatcttccagtgaaactaacttttaaggaagatcttccatgagtatcaagtggcttcacataccctatgcaagagtattgttcaataagggctcacccagttagttactctcttccttagtccaccttttaaaaatgctgccagatgaatctccttgaagcttacattgttatgtaatttccttattttctttagaaacaaattcagaactccttagcttacctggtaatgctctctacaatctgccctgaacctccctttccaatcttagacctcatttctctcgtcatacgtgctgtggtacaacaatctctgaaccctgctttgggaaaaccatttctttgcttatgttggtacttccatttctctttgctgtgaacatttgaactatttccaaagtccagatcaaatgcctagtccctcttaggctttctcctgcttttcaacctaggagtagtaatttttctcttttttggtttctttgtaaatctcttctaaattttattagtatttaacccttcccttatagttctttacacatctttttgttctctgccagaatataaactacgtaagaataatcttttacatgtttccaaacccaacattgtctactctgtatcctgtatagtttgtgccctgtaaatgtctactgaattgaacttaaactttgaagtataaccctatagacataccactaatctagggacgtttgtatactctttcaatgctaccatgtactctttgaactgcatcttgacatttaatttttctatgacttagttttttttaacccacaaggtggttataatgatatttcactgtgcactataaaattgttatgttatctttcaaagaactactttgaattccctgggagacaaatggtcaaatatatgaaacccattatagaatttcacctctgacatatggcacaacttagagataattttgtttaaatgccaagtaacctggagctataagtcccgtaataccacataggtatacatgtttatgtatatgtaatcgttcatgtttataacctcattttgtagtgtgatagtaggctatggtaaatttgtcttaaaattttttaggaggccaaaattcttacagaaaaacatattagtgtagtgttgagagtctaggcactagagatagactgcctacgttcattaaaaagttaaataagttgcccggggtcacacaaaagactaaagggtgatttgaacttaagtttcctcatttatcattcagaataataagagctcctatttacagtatagttttcaagaataaattacctaatactggcccatagtaaatacatatttattatttttattatattttcatagataaatcatacataggcttagttggaggttaaacttagtggtaaagaacttagcatcaggtaaaccggggttttatttttgatttatttttttcatttcttttttttcttttttttattattttctttattatacgttaagttctagggtacatgtgcacaacatgcaggtttgttacatatgtatacatgtgccacgtgggtgtgctgtacccattaacttgtcatttacattaggtatatctcctaatgctatcccttccctgtccccacaccccacaacaggccctggtgtgtgatgttccccaccctgtgcccaagtgttctcattgttcaattcccacctatgagtgagaacatgcggtgtttggtttaaaatccttgtgatagtttgctcagaatgatggtttccagcttcatccatgtacccacaaaggacatgaactcatccctttttatggctgcatactattccatggtgtatatgtgccacattttcttaatccagtctatcattgatggacatttgggttggttccaagtctgtgctattgtgaatagtgccacaataaacatacgtatgcatgtgtctttataacagcatgatttataatccttcgggtttatacccagtaatgggatgtctgggtcaaatggtatttctagttctagatcattgaggaatcgccacactgtcttccacaagggttgaactagtttatagtcccaccaacagtataaaagttttcctatttctccacatcctctccagcacctattgtttcctgactttttaatgatcgccattctaactggtatgaaatggtatctcattgtggttttgatttgcatttctctgattgccagtgatgataagcattttttcatgtgtcttttggctgcataaatgtcttcttttgagaagtgtctgttcatatcctttgcccactttttgatggggtagtttgattttttcttgtaaatttgtttaagttctttgtagattctggatattagccctttgtcagatgggtagattgtaaaaattttctcccattctgtaggttgcctgttcactctgagggtagttccttttgttgtgcagaagctctttagtttaattaaatcccatttatctattttggcttttgttgccattgtttttggtgttttagtcatgaagtccttgcccatgccaatgtcctaaatggtattgcttaggttttcccctagggtttttatggttttaggtctaacatttaagtctttaatccatgttgaattaatttttgtataaggtatacggaagggatccagtttcagctttctacgtatggctagccagttttcccagcaccatttattaaatagggaatcctttccccatttcttgtttttgtcaggtttgtcagagatcagatggttgtagatgtgtggtgttatttctgagggctctgttctgttccattggtctatatctctgttttggtaccagtaccatgctgttttggttactgtagtcttgtagtatagtttgaagtcaggtagcgtgatgcctccagctttgttctttttgtttaggattgtcttggcaatgtgggttcttttttggttgcatatgaactttaaagtagttttttccaattctgtgaagaaagtcactggtagcttgatggggatggcattgaatctataaattaccttgggcaatatggacattttcaaaatattgattattcctatccacgagcatgggatgttcttccatttgtttgtgtcctcttttattttattgagcagtggtttgtagttctccttgaagaggtccttcacatcccttgtaagttggattcctaggtattttattgtctttgtagcaattgtgtatgggagttcactcatgatttggctgtttgtctgttattgatgtagaggaatgcttgtgatttttgcacattgattttgtattctaggactttgctgaagttgcttatcagcttagggagattttgggctgagatgatggggttttctaaatatacaatcatgtcatctgtaaacagggacaatttgacttccccttttcctaattgaatatcctttatttctttctcctgcctgactgccctggccagaacttccaacactatgttgaataggagtggtgagagagggcatccctgtcttgtgccagttttcaaagggagtgcttctggttttggcccattcagtatgatattggctgtgggtttgtcataaatagctcttattattttgagatatgtcccatcaatacctagtttattaagagtttttaggccgggtgcggtggctcaccacctgtaatcccagcacttttggaggccaaggcaggcatatcacgaggtcaggagatcgagaccatcctggctaacacagtgaaactctgtatctactaaaaatacaaaaaattagccaggcagggtggcgggcacctgtagtccctgctactctggaggctgaggcaggagaatggcatgaacccgggaggcggagcttgtagtgagccgagatcatgccactgcactccagcctgggtgacagcacgagactccgtctcaaaaaaaaaaaaagtttttagcgtgaagggctgttgaattttgtcaaaggccttttctgcatcttttgagataatcatctgttttttgtctttggttctgtttatatgatggattatgtttattgatttgcgtatgttgaactagccttgcatcccagggataaagccaacttgatcgtggtggataagctttttgatgtgctgctggatttggtttgccagtattttattgaggatctttgcatcaatgttcatcagggatattggtctaaaattctctttttttgttgtgtctctgccaggcattggtatcaggatgatgctggcctcataaaatgagttagggaggattccctctttttctgttgattggaatagtttcagaaggaatggtaccagttcctccttgtacctctggtagaattcagctgtgaatccatctggtcctggactttttttggttggtaagctattgattattgcctcaatttcagagccttttattggactattcagggattcaacttcttcctggtttagtcttcggagggtgtatgtgtcgaggaatttatccatttcttctagattttctagtttatttgcgtaaaagtgtttatagtattctctgatggtagtttgtatttctgtgggatctgtggtgatatcccctttatcattttttattgcatctatttgattcttctctctttttttctttattagtcttgctagtggtctaccaattttgttgatcttttcaaaaaaccagctcctggattcattgattttttgaagggttttttgtgtctctatctccttcatttctgctctgatcttagttatttcttgccttctgctggcttttgaatgtgtttgctcttgcttctctagttcttttaattgtgatgttagggtgtcaattttagatctttcctgtttactcttgtgggcatttagtgctataaatttccctctacacattgctttaaatgtgtcccagagattctggtatgttgtgtctttgttctcattggtttcaaagtacatctttatttctgccttcatttcgttatgtacctggtagtcattcaggacaaggttgttcagtttccatgtagttgagcagctttgagtgagtttcttaatcctgagttctagtttgattgcactgtggtctgggagacagtttgttataatttctgttctttaacatttgcagaggagtgctttgcttccaactatgtggtcaattatggaataagggtgatgtggtgctgagaagaatgtatattctgttgatttggggtggagagttctgtaggtgtctattagatctggttggtgcagagctgagttcaattcctggatatccttgttaactttctgtctcattgatctgtctaatgttgacagtggggtgttaaagtctcccattattattgtgtgggagtctaagtctctttgtaggtcactcaggacttgctttatgaatctggatgcttctgtattgggtgcatatatatttaggatagttagttcttcttgttgaattgatcccttcaccattatgtaatggccttctttgtctcttttgatctttgttggtttaaagtctgttttatcagagactaggattgcaacccctgcttttttttgttttccatttgcttggcagatcttccttcatctctttattttgagcctatgtgtttccctgcctgtgagatgggtttcctgaatacagcacactgatggttcttgactctttatccaatttaacagtctgtgtcttttaattgaaacatttagcccatttacatttatagttaatatggttatgtgtgaatttgagcctgtcattatgatgttagctggttattttgctcgttagttgatgcagtttcttcctagcctcgatggtctttaccatttggcatgtttttgcagtggctggtaccagttgttcctttccatgtttagtgcttccttcaggagctcttgtaaggcaggcctggtggtgacaaaatctctcagcatttgcttgtctgtaaaggattttatttctccttcacttatgaagcttagtttggctgaatatgaaattctgggttgaaaattcttttctttaagaatgttgaatattgtcccccactgtcttctggcttgtaaactttctgccgagagatccgctgttagtctgataggcttccctttgtgggtaactcgacctttctctctggctgcccttaacattttttcctttatttcaactttggtgaatctgacagttatgtgtcttggagttgctcttctcgaggagtatctttgtggcgttctctgtatttcctgaatttgaatgttggcctgccttgctaggttgggtaagttctcctgggtaatatcctgcagagtgttttccaacttggttccattctccttgtcactttcaggtacaccagtcaggtgtagatttgtttttttcacatagtcccatatttcttggaggctttgttcatttctttttactctttttttctctaaacttctcttcttgcttcatttcattcatttgatcttcaatcactgataccctttcttccacttgatttaatcagctgctgaagcttgtgcgtgcatcatgtagttctcttgccatggttttcagctccatcaggtcatttaaggtcttgtctatgctctttattctagttagccattcgtctaatctttcttcatggtttttagcttctttgcaatgggttcaaacatcgtcctttagctcggataagttcgttattactgatcatctgaagtcttcttctctcaacttgtcaaagtcattctctatccagctttgttctattgctggcgaggagctgcgatactttggaggagaagaggccctctgatttttagaatttttagcttttctgctctggtttctccccgtctttgtggttttatctacctttggtctttgatgatggtgacttacagatggggttttggtgtggatgtcctttctgtttgttagttttccttctaacagtcacgaccctctgttgcaggtctgttggagtttgctggaggtccactccagaccctgtttgcctgggtatcaccagtggaagctgcagaacagcaaatattgcagaatggcaaatgttgctgcctgatccttcctctggaagcttcatctcagaagggcacctggctgtatgaggtgtcggttggcccctcctgggaggtgtctcccaattagactactcaggtgtcagggacccacttgaggaggcagtctgtccattctcaggtcccaaactacatgctgggagaaccactactctcttcaaagctgtcagacagggacatttaagtctgcagaagtttctgctgccgtttgttcaactatgccctgcccccagtactggagtccaggaaggcaggcaggcctccttgagctttggtgggctccacccagttcagtcttcccggctgctttgtttacctactcaagcttcagcaatggcggatgcccctccctcagccttgctgacacttgcggcttgatctcagactgctgtgttagcagtgagtgaggctccgtgggtgtgggactctccgagccaggtgcgggatataatctcctggtgttccgtttgctaagaccattggaaaagcgcagtattagggtgggagggtcccgattttccaggtactatctgtcatggcttcccttggctaggaaagggaattccccaaccccttgcacttcccaggtgagcaatgccccacgctgctccttgggctgcacccactgtgtgacaagccccagtgagatgaacccggtacctctgttggaaatgcagaaatcacctgtcttctgcgtcgctcacgctgggagctgtagactggagctgttcctttttggccatcttggaacctcggttcaaacctgagttgtaatactcactcttcctgttgctgcctatgtaattttgtagaagttacctaattgcttccaagcttctgttggattttttgagaactgaatgacatagtacattttgaatgcttaatgtattgctttgtgcatggtattatttaataaatattagctttggttatacttgcaatgttctgttatttctctttttcacacatgttgcttgcaatctatatggcatctattttagcattaaagtagaaagttttaagtagaaaggttctgtcataaagaaaaaaagaatcttaagaagataaatctaagtggaaatttaaagaaaataaggcttttttagatctagcctgtaaactcctttagactcttgaatttgatattctggtagctcttccgagtattaggaaaaaaagtcctttaagctgctctaaagttgggtctggaagcaatactagaaaaagtagaaactggaaaaatttcacatctttagatcaatgatgtccaaagtgaagagtatactataaccaagtgggtgagagaacatattagaccacctacttacatatattttatctaaaaaattttaaagtacaggttgatagtagtgtatgtaggtagcctattaggtataaatatattgagatagtgactcagttttatttttaaaaaatagactattaaaccactgctctagagaatggctgtattaagccaaagttttagtataaacaaagtttagatatttgttgttcatatattttagataacacccagttctgtacatttatcagctctttgctttcctgtaatgtgccatttgtgataagggggaataggaacttttctctgaatccttttccatagaaggtgcttttaaagatgcctctttcagtccttgctaggtaagggaattagaaccattagaattgctttacaaaaattgaggaaaagattatttgtttagctatttgtttttagtaaattgcatcctttgcattaagataaagcagttggccgggcgcggtggctcacgcctgtaatcccagcactttgggaggccaaggcaggcggatcacgaggtcaggagatcgagaccatcctggctaacacggtgaaaccccgtctctactgaaaatacaaaaaattagccgggcgtggtggcgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaaaaaaaaaaaaaaaaagataaagcagttaaattaacacaaggccaatagggattttattaaatttcctttttaaaactgagttttgacatagagatttaaaattaaacagacctgtattcaaatcttcattcttgatcttgctagctgtgatgtttctttgtgtgtaaaaagttaggggtataattatagtagccttttcctgctaccacctggcatttagcagaccagttctcagtgaatgtgagcgttgattatttttaaggtggtagagagctgatgaaaagagcaagtaagcctgggtgcagtgactcacacctgtaatcctggtactttggaaggccgaggcaggaggatcacttgagcctacgagtttgagaccagcctaggcaatgtagcgagacctcatctctgcaaaaaaataaaaaattagctggatgtgatagtgtgtgcctgtatgcccaggtacttaggtggctgaggtgggaaaatcacctgagcacaggaagttgaggaagcagtgagctgtgattgtgctactgtacttcatcctaggcaacagagtgaaacactgtctaaaagaaaagaagaaaagaaatatatcttataccatagggcttaactttctttaaatgtgtgtaaattgaaagtaattctgtgttcttttagacatggggaatttatctgcaaagtttggatatggagtcattgtatttgtatttaaattgacgttagatgcatcagtttattacctattacatagtatttgaaaataatcatatttattttgtcttttagcaacagatgaaatttagtcttacaccgagacagactattcacctagttaaatatgaagggtctatgaaggtctccatgacaccctgtaaccagctgcaatttgacattagacttgatgttctgattacttatactttttgttttagttcctttcctgagcctgaattgtacaaatatgtcctaaaacaccaacttattaagaggcttaatgcctgttaaatgcgtcagtgctcttggcagcttagcatgagtgctttctttgcatgggaggttgcagtttagaagcaactttatggatcatttcccaggttgatgttacatatgttcattttacaacctgtgtgcataatctctcagggtgaaggtaattaagagaaagcataatctacagaattgaagccaagtaatctaagattctgtttttaaactctttgctatataacattagttaagttgtttaccctcttaatttatccatttgtaaaatgatagtttttgtttttaaagtgctctattacccttactttaaaagtcctgtctaccatatatttaaaactataagtggaaataatgaagaaactctgaacttgcttttgcttatatatggatatatcatattatatgcctaagattggagataaattttataacctgattttctcatggcagtgtacaaatgaaattattctgtaagtttttcaaaacagtaaaatcactatttttcatctttttgtgagatgtacttttttcatacccacagaaatttgcagagggcttctgcataccacccatcttccaatatttcagtatttggctaggttcccctcattttgcttaattattcattttggttggaaagtttaactgccactgaaacttcagattctatatccttaccactttcctgatttttaagtttaacattcagtaattatttgatgtttattttagctgcataggtttaagtaacactaaaagtatacctgaatctctaggtagcatatttacaagcttagttagaagtaccaaaaagggcttagaaaataatttaaaactacaatagtgatctaaagtttttaatgatttttcaattatgaaaatgttttactattgtgcttatcccatgaagatttaaaaatttagtggccgatacttgaaattgtataggtagataggatacagcatatgttattttcagtgtatctaaaaccatgaacttgggtcctgtgtgagtgcaaagtggatactgaaaactagtttaatttcctcagattcatctgataggttatatcctactcaaaaatgacaggaaagccaaaggctactatgttagccatttctgctgactcttattggtatcctgtaccctatacttcttaaacagattacattttttcagtatactagtagatctcaaaaggagatagaagaagcagggttatttctccagggtagagtattgttttgactatttcaattttttcttaatgtaaattatagaaagtaaactcaacaaaattttctttcagaggatgggaaagtggtggctgtaggtacttgaaagataacataagaaagcattaaagggggagactggattttaaacattggaatgcaatcctatttagatattgtaacatagcattcttgtaaagagaaaagccactgcaagtctctacaaagttggccaccattccaggctaaattttagaagtatgtagagatgaagtaaaaatctgagacttttagtaatagctcttgagatctcaagaaatggaacaagctgaagaagtaaaactattgaaaagccaagccaacttgttgctgaattccctaaaccaagaataatttcagaagcttaatttttttcctacaaatagtatagaagaattaacattaccattaaataggggttgagcactataccagtctgaaacccttgagattaaaactagctagaagacaagctgcagaagacaagacagtttataatcccttccttcagcctcacccaaggttttggaaataatcttatgacagctgagagtaagccaggtgcagtggcattccctgtagatccagctacttggggggctgaggtgggagcattgcttgagcccatgagttgaaggctgcagtgcactgtgatcatactgtaaatagctactacacttcagcttgggcatcatagtgaaaccccatctctaacaataataataacattttaaaataaattattaaaatttcacatttagaattatttttctactacagtaattggtacctcagtcacttaaaatggtaacactagttgagaattatacctccacaaatatatatctagataatccattatgttgtctctagcagatttttctgaggaaaaccaaaaggaggattggtaattaaaagtagttaatttttacattcaagaaaggaaaggactattctttgaacaaagtcccaagtcatgaataagtaatcaccagtaattagaaatcacttttgatcagtacacatgatgtgaaaatcagccaatcagtgacagcctcactccagtggccatgcttctgaaaatcatcgagtcaacaacagccttactccagtaactatcttctgcaaattagcaaatcaacgatagtcctaggcttctgaaagtcagccagcgactactcttgtatgttctgcatactgactcattatttgtcattaaaaattcaatggacaaaagaacaaagtatgtctgatgtggctgctttagaggccaggatctaaatggacccaagattcctagttagcatctgatagaacttttagatagaaagtcagcaaggatataaaagatctgagtaacacaaccaacctacagaatctaactggcatttataaaacccgctaccaagctgggcgcggtggctcacacctgtaatcccagcactttgggaggccaaggcaggtggatcacaaggtctggagattgaaatcatcctggctaacacggtgaaaccccgtctctgctaaatatatatatatatatatatatatatatatatatatatacacacacacatatacacacacacacatatatatatacacatatatatacacacatatatatacacatatatatacatgtatatatacatatatatatatacacatatatatatatatatatatatacatacacacacacacatatatatatacacacaaaaaattagcctggcatggtggcacacgcatgtagtcgcagctactcgggaggctgagggaggagaattgcttgaacctgggaggctgaggttgcagtgagctgagatcgcaccactgcactccagcctgggcgacagagcaagactccatctcaaaaaaacaaaagaaacaaaacaaaaaccactctacccaacaagagtagaatatgagtggaacatcaccaaggtagatcccatcctgggccattaaacaagcctcaacatatttaaaagaattgaaatcatatagagtatgttgtctgaccacagtagattcaaagtagaaatcagtaacagacaacaggggaaaaatgatccatgggtcaaagaggaagtctcaaaggaaatttaaaaatacatacaactgaatgaaaataatatatatcaaaatatgtgggaggtagttaaacctcccacatgtgtgctgacagggaagtgtacagcagtaagtgctcacttttgaaatgaggaaggttctcagatcaatagtgtaagtttctttctcaaggaactactaagtttctatgtaagagactagaaaaagaagagaaaataaacccgaagtaagcataaataaataaataatgaagacaaaaacagaaatcgaagaaattgaaaatacaaaaacaacagagaaaaaccatgaaacaaaagctatttttggaaaaaaaaattaataaaattggtaaacctttgacaagactgaaaaatctaagaagggaaggcctgaatcaccaatatcagaaatggaatagtggatatcagtacagatcctgcagccattaaaaagttaacaagaaaacactataaacaacttgatacccataatttagaagaaatgaatctcaattctttgaaaaccacagactaccaaaattcaaccaaggtgaaatagacaatctgaatagctatttaaccattgaagaaattaaaagctcctgaaaaagaaatcaccgtgtcaagatatttcttcttttttaaaaaagatattaatacatgtttaacaacattcattttatcctttccattttggcatggcacatgatcttcatctggatttatattttatgtgataaatgattttttaatttaagttcaagggtacaagtgcaagtttgttacgtaggtaaacttgtgtggtgggggtttttgtatagattatttcatcacccaggtattaagcctagtattcattagttgtctttcttgattatctccctccttccaccctccgcctccaccctccaaaaggccccagtatgttgtttccctctatgtgtccttgtgctctcatcatttagctcccacttataagtgagaacatgtggtatttggttttctgttcttgtgttagtttagtaaggataatggcctcctgctccatccatgtccctgcaaaggacataatctcattcttttttatgactgtatagtattccatggtgtatatgtacaccatggaaagaatgagataaaaaagaatgagatcctatacaccatgaaataccaatactctttatccagtctatcactgatgggcatttaggttcattccatgtgtttgcttttgtgaatagtgctgcagtgaacatatgcgtgcatgcgtctttataacagaatgatttatattcctccgggtatatactcagtaatgggtttgctgagtcaaatggtatttctgtctttaggtctttgaggattcaccacactatcttctacaatggtggaactaatttacactcccatcaacagtgtataagcgttcgtttgtctccataacctcaccagcatctgttattttttgactttttaataacagccattctgactggtgtgagatggtatctcattgtggtttcaatttgcatatctctaatgtaatgatcagtgatgtttagcttttttccatattatttttggccacatatatgtcttcttctgggaagtaactgttcatgttctttgcccactttttaatgaggttgtttttttcttataaatttgtttaagttctttatagatgctggatattagacgtttgtcagatgcatagtttgcacaaattttctcccattctataggttgtctatttaatctgctgatagtttgttttgccgggcagaagctctttagtttaattagatcccatttgttgatttttgcttttcttgcaattgtttttggcatctttgtcatgaaatatttacctgtgcctacaccgcaaatggtattgcctaggttatcttccagggtttttgcagttttacgttttgcatttaagtctttaatccatcttgagttgatttttgtatgtggtataaggaaggcatccagtatcaatcttgtgcatatggctagccagttatcccagccaagatatttcactagtgaattttaccacacattttaggagaaattaacttcaagttcacaaaatctcttccagaaaagagaagaggagggaacacttcctgactgattttatgaagctaatgttattactctaaaacagacagattgtacagaaaaataaaactatagaccattatttctcacaaatgtacatgtaaacattttcagtaagaatcataatgcagaaatcctcaacaagaatcatagaattagggtcaggcgcagtggctgatgcctgtaattccaacacttaggaaggcagaggcaggcagatttcttgagcccaggagtttgaaaccagcctgggcaatatggcgaaatcccatctctgcaaaaattagctggacgtggtggcacacacctgtagtcccagctccttggcagggctgaggtgatagaatttgggccggggaggtcgaatctgcagtgagctgagatcatgccacttgcactgcagccagggtgacagagtgagaccttgtctcaaaaaaataaagaagcatagaattagaaggaattacaatcaatattcctcctcttcaagattaataaagattgcaactttaatggcaacctcaattctgtgctgttttagttactcctcctatagtctgaaaatgaattgatttaaggcaaattcagtaggtttttacagtttcatttgtcatcagtgtttttcaaatataagtacttttgcaaattggaccaaattcttggtgcaatttaaaaacttgggccttctatcatttgcctattttgagaaaggctatttcccttttctttgattttctattttttagagtgttgaacctacttaatctgaagtttacctcccttttaaaggaagtgtctagaagtgtttctggcaatgtgttcataattaggttaaattttcctcttgataacctggtggctgtagaactgaaatcactgtgagttaaaataatcttagtgtgtctgtgtccccttggcatttgtaaatgagttccttgaaattttgtattggtatgttttaaaacatcagtacttttatttcaaagtaaaatatgccataatatgttttataggatgaagtgtttgttttttatttatacactataattacgtgttgtatcaccttctttgaaaagacatattttaaaataatatctcaattttaggcaaagcacattcctagaagtttaaaattaacattttctgtctaaattaaggagttaattttctgtgaaaataaaatgtttgtggggggtgagtcttatcacatatcacagatcatacttgttttaaaggaagaaaatgaaagtcatttttaaatttagttggtgacataagcagaaagcatgtttactttttgatacttaataacacttgaggtaataataaacaatgataatttcctaatcttttttgcattgttgtaattaagcttacacttggagtttccaaggccaacatgtaaggaattgctctttaattaggtttccaacagttagaataagcaaaaggatggctcatctgacattgcagtgtgtcctgatagagttcccttagttatggttaatgcagataaagaaaacagcaagcatactttcacaattttatattttctgtataaatgagaattcttatttttagagaagtatattgaaaagtaataacacaaattaaataaatggaatagactataaatttagggccatttaaaaaggattacatgtatgccaaggtacaaattatctttcatactcaatttcagctgttactcatcactgcttaacctactcttgagtaataacaacattctttaagctttaaaacattctctaatgtgtttttaatatagacagaatacccatcattagctttatggcaaaagcccttgcaatcatttatttcccttaatcacgtaagcatcaaaaatttattgatcacctggtctaattatatgtagtgttgtaagtatgtctcaggattcattcaacaaacatttgtcgagcatttattatgtaacaagaaaaatgtatgtcccccccccaaaaaaaatgtatgttccctttctttaatgtttactgtgaatagtgaagatatagatatacatagaaagactaataattcatggaaggaaattatcagtgttgactctcaatttggggaagagttttgaagagaaaaaagatcacttttggtttgcagtggatattgatagtctcaaaggtgatggaatctctgtgtaaagatgattttgataaaggaaggatttagggactacattatggtagagaaccgagagtgaaattataggaatgggaaagaatatgtctcctattctttttcaggagaagtgactatgtcagtttgtttggagtgcaaagttcatcacagtagatgaatgaatggttagaaaagaaaggtattagggactggatattgtaggactatgtttggatcatatagtgggaatgaaatataaaagctgagttcgtttgccttttttttttttttttttttttaagatggaatcttgctctgtcaccaaggctagagtgcagtggcgcgatcttggctcactgcaaccttcacctcctaggttcaagcgattctcctgcctcagcctcctgagtagctgggattaaaggtgcccgccactgtgcccggctaatttttgtatttttagtagaaatggggtttcaccatcttggccaggttgttctcgaactcctgacctcatgatctgcccactttggctccacaaagtgctgggattacaggcgtgagccaccactcctggcctcttttgactttgaaaaattatttcattacatatgttcattttagaaagattagaatatactgatgaagaaaaagtagaaaataataacacaaaatcaaagtttttagaaatgcttatttggtgttatccaggatggatgaaataaaaggatgactgaaggtgggaggccagttaggaggctgttttggtagtcttctttccctcttccccatcctgtactcttctcttttatcaaatggttgtactggtggcaaaagcttgaaatttgaggagtcagagccaaaagaaggatgcagcctgaatagtaactctgggatcaggttacacagttgaaataatagacattacacattacttttctttcctgggtcttgaggaagttctttagtgagggctcaagaaatttggaaatatttgtagatggatgaagtaagttcaactttggtgatggctttatgcagtttgataagtgcacatttctccgagtacaaacttatgggaacattattggtggtgagaaggaggaatctggagatttgtactaatgagttagtggcatttttgtagagggagattcacatctctgaattcttcaaccatcccaaaattgagcatgtcacggaatctttctggctaacagtaagctgtaggttgttacatcctttaatgccatatgtctgcaaaggatcttatctcatctatatatactcttgaatgacatgaactggcacatttatgactagtgcaaagggactaactcgcattcgcatgcaaatttctgtggctggaaaggtcagcccgactggcttgtgcagcaacctttgccattgcccttgtttgataatgctgtgaatttcccatgattttcctaagtgtagcttggaggttccactcaagatcaagcctgagattccccatgaactcttcaggactatggcaggtctaatatcttcaatttggacattatcaactgccttgctgatgccttgattgaggctgagtgataccagtgtgtatctgctggatacaaatatcacttctgtcattccgatggccatgtgtatctcttgcttaggtagcatttctggcctgaaccagtgataggctatataccaccagagtatcctccagaaattcttctccttacttctgtgaccctaccccatccccgtcattctacttctactactttggggaactgtggctccaccataaccttgatgtaagagcaggtgctagcaccccattgaatatttccacttagatcatatcagagactgtacctgaattatatcatcctgttgttctcatggccagatatgggggcagccagcccaagctaggatcccagtggtttctttagctttataccaagcttgaatgaactagagatgttgcccaagaattctaagcctctggagactaaactgcctgtctaaatccttataggaatacagactcattcttaggagttagagttttacatccttcaggatatacattggaaaagaacaattgctctgccaggagggctgctgctttttgattgagaaagatgatgcggccatggaaagcacatggaccacatcaacttggggtcagggttatcagagggcaggcagttccagtgctaccacctgagcactcttcttcagaagaaaaagaaagcactccagcttaatccttgtattttaactattcccaatttaaagagttacactgcagccttttgcagccgcttccttatcccctgaaggggaatgggataaggaaaacattctcctttccctgaagagtttcccttgaaaattgaagagagaaaaattttaagtcatcagataaaggcaagggcagttcatccgtattactctttgaggcacggatatatctcaattaaaatctgtgttaattttcccacagttcagttgtattgacctttttcattcaaaaggtccagcctggggctgcatgccagccaacttggtgctttctgtaaaagccatgatgttttctctcagcctaaggaaattctttgtgctgttttatagctttactgccagagtaagttataattgccattgaatcaatatatatagcttaataagtttgctgctttacccagtttaatcttgtctcattttcaaagtttgccaagagttaccctagagagacaaatattctttctgtgtcttctatcattctgttgaccttcatagttgatttggctgatctttctaaacaaaggaagaccaattaatggttaaaggtagaagtatctggacctctactccaaataaaagctttcaagttacatttggagatgatactcttgaatattttttaaccatactgtgtctcttaaacaaatgctgctgcttacccataacatgctaattaataccttatatatctcattcctgataatgaaaagttactagtaccatggtgttgggaggttcattcccgtgggcattatatgaggctagaagaaaacaaagacatgacaaatctatagacttatggttcaggcagatactttctttagtttttttctcagtcattatgaatcttgcattctagacaaatgtagatgtatttctctcagagtaaagaatggaagaaacctgaaggtagctctctgttgacagagaaagaaggaattacctatctggaaataatctgttcagtatagttttattgtcagagtaagttaaaatgaatgattctgccaaaatgtcaagaatgggtcacctaggcatcctttccagaaaaggggcatctagtcagtcatcctttccaagctatgcttttgttacttaagtattcactgaaatgtaaataccatgtgttttatcattttttatactctgaaagtatcattttactaatatgtttttgaaataggtactatattttctattgctcatattatcataagtcttagaactttatctattcaaggtaataaaaatttcaactttggtctgcccagactgtagaaaaccaagcattgacacacacataaaaatatgtatatacacatacagaacatttactttatcaaaaagaagagtgcatagggacttcagatcactgtattgtgaagggacttatccgcatctttgataatttaggatagagtatcttaaaataacctttttatgttctagacaccaaactgtgctggactggtaacatattaagaatatgcttaaaacattctctcaatggaaatattacctttttaaaatattttaaatttcaagacggtagaagtccattttcttgtactgttgagtgagattgaaaataagactagagaattgagtggaagaaataatttcatttgagccattccatttcacgtctttcctaaatggtcagttcttttggttctggttctattgaagtcctcatgatgagaaacagggttagtaaagccaaaagcatgacctgggaacaataatgggttattgattctgccagaagtccacctaccagtggccctggcactgtgagaatagagcaggcacatgtatccaaaaaagttcccttttggccgagtgtggtggctcacgcctgtaatctcagcactttgggaggcctaggagggcagatcatgaggtcaggagttcgagaccagcctggccaacatggtgaaaccctgtgtctactaaaaatagaaaaaattagccaggcgtgttggcacatgcctgtaatcccagctacttggggggctgaggcaggcaattgcttcagcccgggaggcagaggttgcagtgagctgagaccacgccactgcactctagcctgggcaacagggcgagactctgtctcagaaaaaaaaaaaaaaagtttccttttatgaaagctgtatttcagtattgacaattgcagttcccttttgggtttctgtgtcaagaagacttttttttctaccacgtttcctcatcctgcagactgcactaaactgtgtctccaccttcaccccctcagaatatacccaagtgtagtattcatggtagtcccatatatcagttcttttttcagtcacatcaaagttatgcaactggtgggtgccccatcctatgagttaagaatttaagaactgtgaatagaaaagaatattgcgactggtgggtgacacagtaaataagtaagctgagaataggggcaggggaatctactttgtaagtcgtgttaattgtgatgattctgggaggcagaattgctgctgatggagaaccactactttatttatttacttttttcagcttttattttagcttcaagggatacatgtgcagattgttacatgagtaaattgtgcaatgctgaggtgtaatgtacaaatggtctcatcacccaggtagtgaacatagtacccaataagtagttttttggccatcctccccttcgcaccctcccccttctagtagtccttagtgtctgttgttcccatctttatgcccatgtgtactcagtgtttagctcctgattataagtgagaacatgtggtatttggttttctgttcccgtgttaatttgcttaggataatggcctctagctgcatccatgttgcttcaaaaggacatgatttcagagaaccactgctttaaatcacataaattatttacggaaacatacttcttgtaatgcaattagtcttattttgccacagtggagttacttatgtgtgtaaataaaatttagagccagggtgaacaaacaaggccctgaggtcaaatctggcctgccttgtgttttgtaataaagtttgtctctgtttgcagatgacatgatcgtatatttagaaaaacccattgtctcagcccaaaatctccttaagctgataagcaacttcagcaaagtctcaggatacaaaatcaatgtgcaaaaatcacaagcattcctatgcaccaaaaacagagagccaaatcatgagtgaactcccattcacaattgctataaagagaataaaatacctaggaataaaacttacagggatgtgaaggacctcttcaaggagaactagaaaccactgctcaaggaaataagagaggacacaaacaaatggaaagacattccatgctcatggataggaagaatcagtatcgtgaaaatggccatactgcctaaagtaatttatagattcaatgttatccccatcaagctaccattgcctttcttcacagaattggaaaaaattactttaaacttcatatggaaccaaaaaagagcccacatagccaagacaatcctaagcaaagagaacaaagctggaggcatcatgctaccttacttcaaactatactacaaggctacagtaacgaaaacagcatggtactggtaccaaaacagatacatagaccaatggaacagaacagaggcctcagaaataacaccacacatctacaaacatctgatctttgacaaacctgacaaaagcaatgggggaaagattccgtatttaataaatggtgttgggaaaactggctagccataagcagaaaactgaaactgaaccccttccttacaccttatacaaaaattaactcatgatggattaaagacttaaacataagacctaaaaccataaaaatcctagaagaaaacctaggaaataacattcaggaaataggggtgggcaaagacttcatgtccaaaacactgaaagcaatggcaacaaaagccaaaattgacacatgggatctaattaaactaaagagcttctgcacagaaagagacagtatcatcagaaggaacaggaaatctacagaattggagaaaatttttgcaatctatccatctgacaaagggctaatatccagaatctacaaagaacttaaacagatttacaagaaacaaacaatcccatcaaaaagtgggcaaagcatatgaacagacacttctcaaaagaaagacatttatgcagccaacaaacatatgaaaaaaatgctcatcatcactggtcattagagaaatgcaaatcaaaaccacaatgagataacaatctcacaccatttagaatggcgatcattaaaaggtcaggaaacaacagatgctggagaggatgtagagaaacaggaaagcttttgcactgttggtgggggtataaattagttcaaccattgtggaagacagtgtggtgattcctcaaggatctagaactagaaataccatttgatccagcaatcccattactcagtatatacccaaaggattatcagtcattctgctataaagacacatgctcacgtatgtttattgcggcactattcgcaatagcaaagacttggaaccaacccaaatgtccatcagtgatagactggataaagaaatgtggcacgtatacaccacggaatactatttagccataaaaaaggatgagttcatgtcctttgcaagtacatggatgaaggtggaaaccatcattctcagcaaactaacacaagaacagaaaaccaaacaccgcatgttctcactcgtaagtgggagttgaacagtgagaacacagggacacagggaggagaacatcatacactgggatctgtgaggggctggggggctaggagagggataacattaggagaaatacctaatgtagatggtgggttgttgggtgcagcaaaccactatggcacgtgtatacctatgtaacaaaactgcacgttctgcacatgtactccagaacttaaagtataataaaaaaagaaataaaaatgaagtttgatattatcatttacatatcatctgtagttacttttgtgctacagagtcagagatgagtaattcctgtagacataagtactggccaccaagcttgaaatatttactatctggctctttaccacaaaagtttttcaacatattagagtgttttagagtttgacagtgcatcctttgctatgcactgagtcgtgagctgtagtgagtgcttaaacttaaaatttatgtttggttttatgtgaaagctttgatgaaaaaagatttcaatttgcacaagtatgttaattagatatgaaattaacagttattgcatatatttgtgctggctgccatatggatatacaatatagtacattaattaaaagagcagaaactttggagccagactgctttggttcaaatcctggctctacttttctgtcatctaaggcaagtcacttatcctttgtgtgccccagttctcttaaccataaaatgaggataatattaaaacttgcaaggactaaataaattagcgtatgcaaagcatgtagaaaatgttttccatgtaataaacactaattattactgtgataaccgaagggttccaaaatcaactcaatttttggcctctttaattcattacatagcaatgaagtacaaaggtgtgaatgtgtaatagttgttttcagagtaaaatgggggaaaatgatttcacttaatttgtttctttccctaatgctagcatctccagtggcacagaatataccttttctgttctggtccgcaaaattgtacagaaatgaatgaatggggggaaagctgttgaattggcatctacccaggctacacatttaactccagccagagattaaagtcacagaaaaaaatgttgttaccccaggtcttgccactagtagaaaacatgacctctaaaaaaaattatgcctttttcaaaatatttattactttcaatgccttccctgggatggttactccagctcctgcaaagctctgccttgtagtaataaggggtatccatcagagtttgtgtgccccagcaagtctcctcttcttgcttcttagaaatgcacattttagtataattttctatttatggtatatcattgttcccaaaacacaaagatgattataaatctttttaatctcatatcatatctaacagttatcgtttccttatttttctttttggaaaaccacaaacaagattggtaaatctcaagataaaatttttattcccatttttttcccctgagacatactggttctgttagatctgtcacatatattatgattgatcagcttgcaactaattattgaactcctttgtatgcagttaatatttaccatttaggatatcagctactctaccaggtgctttgcatgtgttgctttgtttaatcctcacagcaacccataagatacaactattattatcaccattttacagttgtgtatagtgaaacacagagaagacaagtaactttttcagctcacacatctggcaaagtaggctgccagggttaaacttgactgtgtctgattctgatattttcaatgactcttattctgcttcctgtactctttttcctacttgtttgaaacacctcagatcccctgggcagagtagatagatgtaattcagggactctggttggatttcaggcagcccaagtgccttggaaagcattttcctggcttagagatgtcaacttcagagatgtgaaatatatgtaaaattagaggagaaaaaaacttatttaatatttttagaattctctagatcctatggataggaaaattgttttaaaagtagtatacctgaataaggtgggccaccctgaacacataccaaggattagctgtcttctagttcccaaatacaatacaactcccccctgcccgaaaaaagttattttataatatcatgctatgtatcttcttgagtattgtgatcattttctcctagaatatcaaatatttgccataactttaataattctttttaaaaggacagagagcatttgttattgagtatgcaggcagtatgctttgaagatagaggtcacatttagtgagggattcgtggtttaatagattggaagaagggattattagatgggatgggtttggtggaatatgtgagttttctaaagtcattaggtgttttatgcatgagaacataaaagagctggggctggaatcaattttattctaatctaacagatgtcttctactcttaagacacctgtgtaatgaaacgtggctttccccatatctccctactttcactccacttaattaatatacgtggctgtacattgacatactatatcatctattcctaatagaggggttttgcttccttagattttaattatcaataacttcattgcagtattctctgctttcttggtttccagctaattgccccacttgttttttgtttgactagttactttcttcttcatttatgacccctgtctgtagcttatcttggcttctactttctcttatgttctcccctgaattcctttacgtatgttaatattaagctgattgtcataatatttataaggttttcactgtctggacttgacgcagtttggaattttcctagcacatctgaagttaaattttaaataccaaacaaagttgtgctggtttgtatagcttaaacaccagcattttaaataaatgcaaaatgcaataaatgttttcagacaggtaattgttgatttgttgtataacattgtattaataatttctcattcctgattaggttaaatttctttacaattcattccaaaaaatacaaagatatctcagtgatacttacagttggtgaatcctttacatttttttttttttttttttgagacaggttctggttctgttacccagtctggagtgcagtggcaataccttgctcactgcagccttgacctcccggcctcaagtgatattcccacctcagttcctcaagtagctgggaccacaggcacatacatgccaccacatccagctaatttttgtagaaattaggttttaccacgttgcccaggctaatactttactttttattgagtcttttttctgtggtgtcaagcttttggtaatttcattgttgttagctatttgtatcaccaatagaagttaagcagagagcaagagaagaaattccaatttgctgtttgtcagtaactggagaggaagtgaggggtgggagacggagaaagatctggctggagagctgtagtttcacctacaaagagtttttttgtttgtttgttttaatttcgttttttcttttaatttggggagcttgttggatgctatagggaggaaaggtggaggagaacttctggtggtaattgttattcaccctgctctgctttagtctctgatagaattagtgtcatggttgatgttttgtggcattttttaagactgcataatccagcaacttatgattccctgttaggcaaggaaccatagctttcagtgtatacttacagagtgactgagacagtatcacttcttctctttatgccttatattcttcatttataaaatggagattatagacttgtccttgaatacctattgaagtaattgcaaaaattccatatgtatttgagtctttgcgaggccttgaacgtagagtttaattaaacaagaccgtactaagagtcttttgtatttatgtgcaagagttttttcctgatggcactattgatcatgttgggaaagcaaggcctggttagtggatttattgtttaggtgttttacagttatgatagttttcatttgctattggccacaggtttgaaaagagtatgaaacaactatgtagaaaattttctagcatctcccagtcccagaaaagcttcatcagccttcaagagtctatgaagtatgactataatgtaatgtgcctgatattttttattgtggtaaaacataatatttatcattatactctgtgtatacatattgtatactgataagtgtataattacactgataagtgtataattcagtgacactaaatatgttaacagtgttgtataaccattaccactatctatatccaacactttatcattatccccaacaaaaactatgcccattaaacaataactcccacccttctacctctccccacagcccctggtaacctactctactttgtctttatgaatttgcctattctaagtacttcatataggtacaattatacattattttccttctatatctgccttatttcactaagcataatgttttccaggtccatccatgttgtggcatatgtcaaaatttaatttctttttatgactgaatattattctgttatatgtgtaggtcacatttgggttagccatttatctcatgccttatattttaatttataaaatggtttcataataaaaggctgtgatttaatatctaaataaaggataaaggaagagtatattttgttagaggggaaatgaattatggaagatgaatgagtagtaatatggcttagcagttttaaatgaggataattatggtctaagttataggggttgttttgaggattaaagagttagtatatgtgtcttaacaacaatgtagtattataacagtataagtgctatttggctgtttgctatcattgttattagttgatgagagcttcgtagtagagatcacaaatgaggcagaccttaatgcaactctgcaggatttgattagaaaaggaattttaaggtaaatgtagagagaaagcagatggcatgtttttacaataagaaagatgtcacactggttaaacacatagtttttgagaccaacagacctgtgctccagtctcagcattgccgtatatttactgtgtgacttggaatataatctttctaagctttaattgtaatctataatatgtggatatgtgttaattcattcttgcattgatataaaggaatacctgaaactgggtaatttataaagaaagtacgtttattttgtcacatgatccgggaggctgtacatgaagcatagcaccatcatctgcttctggtgaggaccccaggaagctttcagtcatggcagaaggtgaaggggagccagcgcatcacatgatgaaagagagcaagcagggtggagaggcaccacactctttcacacagccagatctgtgaacctagatgagtgagaaatcactgatcaccaaagggatggtgctaagccatttatgagggtctgccccccatgacccagtacctcccactaggccccaccccaacactggagattatattttaacatgagatttggagggaacaaacatataaaccgtatcaggataataatgataacatcaaagtattattatgaggattaaaatgagtaagacacttggcatgttacctggcaatgacaaaaaactttcaaacagtgatagcctctattaatttaatacttttggtggttaccattttttatcattgttagcattatccacattggctcatagtgggtgacacctttggaaaggtattagggaaataaagaaagaggagttgtaagtgattatggcatacctttaaaataggagtgtgcacttgaatttaggcagtgggatgccactaaagttttatttgagagaaagactgagtgtgtgtgtgtatttgtgtgtttgtgtaagtgtgtgtacatgtttgtgtattttggcaggaacattaataagaagaggggccttgctgaaagcagtgatttgtaaagatctgtttacactatgcagataatttgggatttggaaaagaatagataaacaaaagggaacaaaattgcttatacaatttttaacagttagaaggaaattagtaagagaaaaaaatctgaagaaaaatgtttacatgtgttgggtatttaattgtatgccaggcactttgctaacctctctatgttgattactaccatttcatgttcacagtaaccttataatggaagattctattattgtctccattttatagatgagaaatcaaggacataaagtggttacggtcacacagatagtgtggcagagacagctagtgtccccaaatcctttctcaccttttccccatactaacaacattttcatctgggcatgtgatgactccaagtgaaaaaccacatttcttaatctcctttgtagtgaagtatgactgtgttgtgcaccccacccagccctcaaaaaaagagttgtgaataattttggagaactttgagagttggcttgtaccatctgaccttcttcccttccttattctgccttcctcctgttacagacatgtgacagtcatagctcatcttagatcatgaaggccagggctgcacggtagaatggtagagcgtaaagcagggagggagctggatccctatggaacttggaaaacagagcatccacaccaatcctgtactgccaacctttgggcatttacattagaaagaaaaataagctgctctctggggtttcctcttactttttcacctgacacgaatccttactaacaaagatcagagggcactctcatccacagtgtatactctttaccttggctactctcagatgcccaacagtttttataaggaattgtaaagatctaactcttgtattgtatagctcagaaagccaaatttactgaagttaggcccatgtccagagatggattcaagaattcagtggtgtattttctcagctttcttgagtaaaaattaacgaagtagagaagtttgaaagctctgctgcttcttccttctgctagacaaggttgtttgcatttctttttactttgcataaatatctctaattttgagaaaagtaaccttagcagataaggaaagaagttgaagggtagtttgtttaattatcaagagcaatgatgtataaatggcttttgggaaaaaatgatatctaactttaagttaagaacctgtgtagttattatggaatgaagtgaattctgtaaaaccattgatataaggtaagtgtgcttttagatgctgcatgttattctatgatttttattttgagcaataacaaaaagatgttgaaattataccagttgaccagttgctgacaggcaatcctaaagtattggctggaactgataagaggttaccagcattacatattcatagatattctcaacttgaagtactttctaaagcaaacagttctgtcatcatcactatgcatagaggtataacggtgatgcagggtggttttcagatagactaggtttttattttgcctctatactggacaggttgagtgaccacagagctttatatcttagtgactagtggttaaagagattgcatttgcattatcctaagtgaattagcacaggaacagaaaacctaccactgtgtgttttcacttataagtcggagctaaacatttgatacacacgaacataaatatggcaacaatagacactggggactgctggagaggggaagaggggaggagagtaaagattgaaaatgaactgttaggtactatgcttactacctagaggatgggattaatcatacccccaatctcagcattgtgcaatatactcatgtaacaaacctacacatgtcccctctgaatctaaaataaaagttgaaattataaaaaataaataaaaagacaaaaaaactatagtgagatatcatctcatcccagttaaaatggcttttataaaaaagtcaggcaatacccaatgctagcaaggatgtggagaaaagagaacccttgtacactgttggtgtataaaattagtacaaccaccatggagaacagtttagagattcctcaaaaaactaaaaatttagttgccatatgatgcaccaattccactgctgggtatatacccaaaagaaaggaaatgagtatatggaagagatacctgcacttccatgtttgttgcaatactgtttacaatagctaagatttagaagcaacctaagtgtgcatgagcagatgaatggagaaagaaaatgttgtacatttccacaatggagtactagccagacataaaaagaaggagatccagtcatttgcaacaacatagatggaactggagatcattatgttaagtgaaacaagccagacacagaaagacaaacatcacaggttctcacttatttttgagatctaaaaatcaaaacaattgaactcatagagagagaatagaaggatagttaccagaggctgggaagggtagttttgggaggcagggttgcaggggaggagggatgggcaaaaaaaataattagaaagaatgagtaagacctagtatttgagagcaccacagacactatagtcaataataatttaattgtacactttaaaataactaaaatagtataattggattgtttgtaacagaaaggataaatgcttgagggggatggatacccagttttccatgatgtaattattactcattgcatgcctgtaccaaaacatctcaattaccccataaatatatacacctactgtgtacccacgaaattaaaaataaaaaaatttttaaaataaattatatttcataatcagtggtgtatgcatgcaatataaatgcttgttcctagaggatttcaagatcatatggtctttctaagtcacatactataccaaagctcttcagacaagagcttcttatacagtctgaatttgtgcagaatctcaaaagggcaataaaattttgaaataatgtgattaactccaaattcattacgaattatgtagtttccgtgctgggaaccaaatgaattataaagtatgtttacactgcttcaacacggtggctccattttagctgcaaacagaaattcttatcatttttttcaggattagtcccaaatactcaagtttaagttatcctaaatctttctttaggaacgcctcacaaataaaatataagaaattttgatattgtactcttggcaaagttttgctctgcttccctaatctaatgggacagtgacagcttacaatgaaacattttcaaaaacattccctgctaaatcaaactgaaatgcaggggatttacatggacatttgagatcgtttggtgtaatagagcatggactgtcaagtaagaagtttcacatggactacggagtaagaccagtccttctaccatcttggaacttgacctttttttgtaaaattggaaacataacagctcaccatcttgttgagaagactaaatgaagtaatgtgaaagttccttaaggaagaaatgttaaatgttattacgcttgacctgttttcttgttaacatcttatatcttgaaattttctttaaagcctctaaatgttgtttttgtttgtttgtttgttttgacggagtcttgctcagtcaccccaggctggagtgcagtggtacaatcttggctcactgcaacctctgcctttagggttcaagcaattctatctcagcctcctgagtagctaggactacaggcatgcaccaccacgcccagctaatttttgtatttttagtagagacggggtttcactgtattggccaggctggtctcgaactcctgacctcgtgatctgccctcctctgcctcccaaagtgctgagactgcaggcgtgagccaccctgcccagccaacgttgtgtttttaaatacgttaaagttacagcatatggttttaaaagcctttatttctccagtcaaatattagaaactcaagaaaaaggatgcactaagttgaaacttgctctactactttggcagccacacttaaggcagaaaagtaagttaaagatcttatacctttgagtttaaaaacaaacagtgatttttctcatttagcagccctgtgcagaatcatagcagaatcatctcatctctcttgggagaaatgttggcagttaattaagccaattccttcattttgtggttaagtgcactcagatccagggattaatcgactttgccaaagtcatttatctagttaactgtagaaaaggcagaacctcttgaattccaagctagtggctatttcacttagctagtatttttaaaatcattgactttagtgtgtatatatatgtatacactatttatgtgtgtatatttttaaaatcattggctttagtgtgtatatacactatatgtgtgtgtatatatgtgtgacatatatacacactatatatgtttatatgtatgtgtgtatatatgtgtgacatatatacacactatatatgtttatatgtatgtgtgtatatatatatataatttgtgtgtgtgtgtatatatataacttttaatgttattttccagtgtcaagagaccatttgaaattaaatctggcttcaaaaaatgttaccatcaaaagtcattaagtgttttctggttttgatatttgtattgcgattatataagagaaggtccttgctcttggtttacacagaaatattttgtgatttaaaaatattaatgattactgcccaccaatttttatgttaggtatttttcaaggcactgggatttttcttttgaaaatcttatccttgagagatttgatctattactatgttatggtatatttttgccttatagtgattatgatttttttctttctgcttctgaaatgtggtagatatgtgtagaaatcataagaaatggccattcttggtgtcaaacttgttttatcttcaattatcataataaactattgaatgcaaaaaaaaaaataaagttgctgagagtagtaagtgcttaacagaaatatttagaaaaaagtaaaaccaaacccagtaaagacctcattaatttaaactctattaaagaaggattgtgaacagtacttgaactgaaatttagttttggatccagaattctatttaattgcctatgcaaaataataatgtgaacaagattagaaagggaatgttttcaatagttaaaagaacaaaatgtctctgagcagccagccttcagtagttgagaatgctgattaacatacacataagaggcatgctaattacgggcagccttatcgggtcattacagcaggtcccccaggacctttctgttactgggtagaacttgaaagtaataaatttgcttttctttacaattattctataattagaaattccacagatttaagccattttctcatggaactgcccttattaaacaattgatttttagcaaatatccacacatttcctgatatataatacaaaatagatactgatatgtgtaaaagaaagatggtgaccctattagaaagcatcatcctttttagtttttccacactcattttgatgagaaactttaaaatcccttttagttttttttaatcgatttacgtctgaaggctcatatcgatcttgttctcaatgaaagtcaacatagtattcttaggtcttaggtctagtctttttattcttcgatgaaacagatagaaatttgtctctcctattgatgaaaagattgaagctttaaacagaagggagataccagtaccattttttcaaagaatatgcccatatttaaattgtacaagttttgtttttctgtgagtacaacaatcagatattaaaatggcatgtttttttaacttaaaaagagtattatgtagttattattatgcacgttgatgtggcactttttctcaactgttagagtattcttcttagatatcattaccaaacaactgattggccatttaattttggtcatatttcacttttcctaatacctaaatggcacaaacagacatgaaaatagtgtaaggctcagacttcattgtacctaagaaatcagtgaagcttttcatcaggtggaaggaagagtagactggattttctcttagatctgtctgcctttttctttgaaaagtttgtttgtttgtttgtttttgagacagagtctcactcttgttgcccagactggagtgcaatggcacaatctcggctcactgcaacctccgcctcccaggttcaagcgattctcctgcctcagccttccgagtagctgggattacaggcatgcgccaccacacctggctaattttgtatttttagtagacacggggtttctccatgttagtcaggctggtcgcgaactcccgacctcaggtgatccacccacctcggcctcccaaagtgctgggattacaggcatgagccatcatgcctggcctcttttaaaagtttttgtagttttttccagatgggataactttttacctggataatatatttggtaaaaaacataccattttccaaagtgtttatatcatttcggttgttgttttgacccttctaattatttagcagctctatccatggagactactgggggaagtcttgagttttgcctattcatggaaggcaggaagtaagccagaaggaacctcattccatccccagatttgtttatctgaaagacccatcatcagttgtgaaatgtggaaattttaagcaaggtcttgtatataaattttatagatgggaaaactgttgaaaaaagaaaatgcaactgagagatattactggtatttttgtcattgacaaccaaggataacaattgcattgctcccttgtttgtgatgtatagagacatctatacttaaaagacattttatttgagcaccaaagtaattataaatggtttattgtatttattgtgggatctggccagcagcccgcaatgcagcggggctctctttcttttcccaggcagatcggcaggtcgataaataatagacacacacaagatagtgaaagctgggtccaggagggtcaccgccttctggtcctgcaatgctgccaatgcactggatataccagcatttattattaagtttagtgagggcaggggtaggttagtgagggatttagggttgtttgattataaggtgagatggtcacgtggggatgaagtaattctttaacataacatctgtatgcagaagtacagtatacagagaaaagaatttacagtatagtgtgtgcatcagtaatttctaacagagccttaaaacagaaacacagtctttccgtaacctatgatcagcaagatattaatcagcagtaacagttgcagcaaaagctggttacaaacaatccatagaaacaggatgtgaggctagacaactggttagaccagaaatactcagaagggagtatgccttaaccctaaagaggcctagaagagccatggcaagatgagggcatttatagccctatcttatccacatgaacaggcgcccctcatgcgtccgtttataggctctccacaagggtcacattccctcatgcgtccgtttataggctctccacaagggtcacattccattcccagagctatgaacatctgcttttctgggataggaatcttggtgatgtgaaacctccctgactgcacatccattcataggctctctgcagggggaagcaaatcacacgctgttggctcattctggcagtccaacctggcattgtctttacacaatcctgcatgcaattttatatttacaataatcagaagcatttcatcttttattccatagcagtagtttcagggggtctccctacatatatttataactttttccctatttatttatgctgtttatgtttaagtatggttccctgagagctcacctgatatatcacactgctgaaactgagctagatctctaaagctttctccagatttaacatcctatgattcactgactgtgtaaattaattctaaccactgatgttgaaaatgtcttctcatggatctgtaaaggttatgcagaaaaatctagttgctaaataacggagctatcttcaggaatgaaaactggtaaagaatattattggctgggtgcagtggctcatgcctgtaatcccagtgttttaggaggctgaggtgggaggattgcctgatgcctggagttccagactagcttgggcaacataaccacatcttacataaaacaaaaaacaaaaaactagctgggcattgtggcatgcacctatagtcctagctactttagaagtctgaggtaaggaggaccccttaagcccaggagttagaggttacaatgagctatgatagctccatgatagcaccattacattccagcctgggtgacagagtgagaccctgtctgttagggggaaaaaatacacacacacacacacacacacacacacacacacacacacacacacacacacacattgagagtcagtgatatgtatagtcaatggaagaatttagtcaatataaatatatttatatatatatatagtcaatataaatatgtacatatagtcaatggaagaatttccatacatttttggtccctaagtgtacaacttcactgggttattaaaaatattaaaaaacacctataaagtgcttagaacagtacctggcaaccttgtaagtgctatgttaagtgtttactgttactgccaccaacaccactgaggatccagcagaggattctatgataagttgtctttgtcctaaaaatagtatatcctcttgcagtcattggaaataatatggccagtaatctaaaatatatagtttcctagtagctataggctattttgaagtcattctaaaaccaaccattaaacctgagcgtaatctgtttaacacatgaagaaagctgtttcataagactctgaaagagatttataaaatgaaaatgctgtggcatcaaatattaatattttgctagcagcaggtagcccaaatgttgatggctggtatgcatttgaaggcctacttaactgtgaattttattaggaccattcctcagagctggagttacaaatgggcttataaatgagaaattaaccacccctctagggaacagcagtttctttgaaatcttaattaaccaatcacactgatcttctcttttttcaattgccaacacttggataaatgttgaataaaacattgtctaattggaaatagcttaagtactgggaacaccattcttttatatgttgaaataagtatagtggtaaaatgaaataaattttaaaaagtagtgcatatgtgcctgtttgaatattttcatttgtccactatacttttaaaaaaattaaactgtaaaaaaattacattgtgaaactaggtttttttcttttttctttattgagacagtctcactctgacacccagggaggagtgcagtggtgtgatcaggactcattgcagccttgacctcccaggctcaagcagtcctcctgcctcagcttcctgagtagctgggacaacaggtgcacagtactatgccctgctaattttttgatttttttatagagaggagatctcactattttgccctggctggtttcaaaagcaattttcccaccttggcctctcaaagtgctgggattacaggtgtgagttaccaagcctaggcagaagttgttttttttttaattggaaaataagcataagaaacataggatgtttcatgttcagaaagaccattacttacaatatgactttgtagtatcactttattttcttccacacagaacattacaagtagaggcaacacatttgtgaagaggttaattttaacaaaatataaataaactgatccactgtaaagtgttacctagaaaagatagtttatgtagtggaatggaaatacatatataggtgaaaatttaatgacctttctaattgaattttttgaagaaataaacattgtattttctaagataaattcttctatgttatattattactttattaaaatggatactgcagtcaatatgattttcttaaatttataagaacatagagaagatagttttgtgaacagttaggtctcccttaggcttattatttctttgaaattgttttatttgtgctgtatagttttcatacatatgagactttccaataatagctattgaatggaaaaaatacatatagaacacagtcatttaagtcgctcaaatttctagaaataaaatatggagacctgctttcccaaatatatttgctatgtcctttttcagatttagcaaacattatgccttctatatgccatacacatttgcatagttatatttaatgttgagtacaatgttgtaaactggagatatgtgtttcaagcagaaggaataacatgtaggtacaaagggatttgattataatgagcatggcacgttggatagggtcagagagtttttaatgctaatcagtgggaagggagttggagaccagatgactagtaggctaaaatgatgggttagggcagttcctgttggacattgaatggcaaaggggagtccacaagagtttatattttattcttttgtctgagggtccttgaatgggctttagtccattgtgaatctctttaaattacgtatgtgtatgtgtgttagtatgcatatgcacttgtacgtccgcatccactgaacacacgtgctgtggaaagggtttgtagttttcattagattctgtaattccacaaagttaagaatcactgcagtagatatgacacatcctattagagattctaattatgtgatgatggagtaagaattgttggttgtttgctttttaagaaagatcattttggcagcaagaccacaggtcactatctcacatcatatacaaaaatgaactttaagagctaagactgtgatgctcttcgaagaacacaaaggggtaaatcttcatgactttggatttgttttgttttgttttgagatggaatctcactctgttgcccaagctggagtgcaaggcactatctcagctcactgcaatctctgcctcccaggttcaagcaattctcctgcctcagtctcctgagtagctgggattacagtgtgtgccaccacgcccaactaatttttctatttttggtagagacagggtttcaccatgttggccaggctggtcttgaactcctgacctcaggtgatctgccttgcctcggcctcccaaagtgctgggattacaggcatgagacaccgtggccagccatgactttgtatttaatagtggtttattatatatgaaaccaaaagtacaagcagcaaaatataaaacataaactggacttccttaaaacttaagacttgttgtattaaacgacatcatcaggaaaatgaaaaggcaatctagagaagaggaaatttgcaaatcatatctctgataaagattgagtattcagccatttgacccagcaatcccattactgggtatatgcccaaaggattataaatcgtgctgttataaagacacatgcacacatatgtttattgcggcactattcacaatagcaaagacttggaagcaacccagatgtccaacaatgatagactggattaagaaaatgtggcacatatacaccatggaatactatgcagccataaaaaatgataagttcatgtccttcttagggacatggattaagctggaaaccatcattctcagcaaactatcacaaggacaaaatctaaacactgcatgttctcactcataggtgggaatcgaacaatgagaacacatggacacaggaaggggaacatcacacaccggggcctgctgtggggtgggaggaggggggagggatagcattaggagatatacctgatgttaagtgacgagttaatgggtgcagcgcaccaacatggcacatgtatacatatgtaactaacctgcatgttgtgcacatataccctaaaacttaaagtatagtaaaaaaaaagattgagtattcggaatatatcaataatttttataactcaataaaaatgtaacccaactgaaaaattagaatcaatatttctccaaagagaatatttctccaaagaagacatacaaatggccagctagcacatgaaaagatgcttaacaccattagtcatcagggaaattcaaatgaaaaccacgatgagataccacttcacacccactaatatggctgtaatcaaaaagtcgagtgttggcaaggatgtagagaaattgggacccttatacactgctggttggaatgtcaaaatgctgtagctgccttggaaaacagctgacacttcctcaaaagattagatatatagttaccatatgacccagcaattctatttataggtaaatagccaagagaattgaaagcaaagcaacacaaaaacttctacacaaatctatttagcaacattgttcataatagccaaaaaagtggaaacaaccaaaatgttcataaagtgctgaagaaataactcatccattcatagcacatccaaaacgttatagtcatatgaggaatattactgagcagtaaaaaggaatgaagcattgatgtatgctacaacgtggatgtaccttggaaagatgctaagcgaatgaaatgagtcacaaacactacattttatatgattctgcatatatgagatgttgagaataggcaaatttatttgagatactgaaagtagaggctaccaatggcctctgctttcagtaggagaatcagaattattggagggtgatgacaaaaagatacgatgtttattttggaggtatgaaaatgttttaaacctcgacttgtgacaaatatacaactctgaatatgccaaaagtcatggaattgtacgctttaaacgggtaaattttttcgtatgtgaattttatcttaataaatttattttttaaacaaaaagattatttataatatttctgggagacaaagctcaggtcctgaaataaggtaggagcaatagaagtggagcaatgatgatggatttgagggtcaataataagaaacaacaggtaaaatgttttaaattgctttgacactaaaaggaaggagaatgcatatatggtaattcctagatttctggctagcagggctagatagagaatggtgccattaccacagtggggtaggaatatggaaaggaaagaatggtttggggaaaagatgatgagttattgttttaagtaggctgactttgacttagctgtcggacaaccaggtggaggtgctcagtaggcaatttaacatgtaggtcccagactaggtgaggtagctcacacctgtattcctagccctttgggaggccaaggcaggtggattgtttgagcccaggagtttgataccagtctgggcaacatggcaaaaaacccatctgtacaaaaaaatacaaaatattagctgagtgtggtggcacgctgcactccagcctgggcaacagagtaagacttagaaaaataaaaataaaaaatgtagatctgaagcctagagacatgctttgaaaaaaaatcattagtgaacatcttgaagttgaggctttgtgtatgaaaagctgcaaagagatgagatgaaaatcaggcaagaggtattctggagcccatgaaggaagaggttcaagaagaatggagtggaacctggcagtggtgcgtgcctgtagtcccagctactgaggaggctgaggcgagagaaattacttgagccctggagtttgaggctagtctgggcaacacagcaagaccccatctctttaaaaagagagagagatggagggaatgtttagctttgtcagtcgctgtccacttcatacaatatgagtactgaaaaatatcctttgtgcgtggcaattcagaggtaaccttaatgagcagtttcagtggagtgttgagggtataatctagaagggttcaaaggaggatttctttaaagataggatattgttaggtttataaaagacaaacttgttttccctaatccttttatgccttactactaggactttttcctttaatccaagcatttccaaaccatggtgcttcattgtttagaaatcacatgtgctttaataattcaggttggtttttcttttcttaaccaaaaatagcaatgcaaactatggcgtatgtattatacactttattagggatttcaaattatgtaaatctctaaattaacacacaaaaaggatttatatcagattctatttatgaagtcagaaaaattcctttttccagagccttaactcttatatttcccaagtgcttttatgaagaaacagtcattaaggaaaaaatgactgttttattcagtgaagatttcatgtcatctagttagcaaactatactttgtcttagagtcatttgaaggtagttggacttaacacagacatattgaccaaaattacgatcattatatccttattctatgtccatatgtcagagcccatcttttacagatctctcatgattgccctaaaaattccatttcaagggagtcaaaggctctcttctttcctgcccatctgcatctcctaggaagtgagttttggggctccttgaaattctagtgtgttctaagatagtggtgatcaaactttttttaccctccccatacatatatgtatgtttgcctgtgagtcagatgcaaaagttttcagtaattattctatgagatgctatggtattcactatctcttttttccttttcattctgttatgagctaacatgctgagtagtaggtcataatcatgattcaccaatggagactaaaagttcccatagctcatagaggagtcccaggaatggccatgtatttgctaaaccctaatttgttcaccgtgaattcatcttagaagttttaggtgtgatctggcttcctggtaacatcagaatgctctaggagttgcccagtttccagatactagacttattgcccttgtgctgtagagaaagagcaaaagaattttaggcttaataataccttactatgtttactatgtgtcaggtgctatgattggtatagataatatctaatcttaaaacaattttgaaaattagaattagcatcacaattgtggtgggttagtaggggaaatgaagaaaacaaagcttggcgacattgagtaacttgtctaagagtatacagtgtgtaggtggctttaaaacccgagtttttttcacttccataagctttctgaaacaggcattccattatgaagggtcagcctcagtgcttgtccctattgtgcctaaagaagattgagaaacatggggtggggcggggaagtcccaaaatcatcttggatagcctaagcctttatgcattctcactgcttaaatggagaactctggcaatgtcaacataatcagatcactgccatctcaatacaggattaaataaaattgctctcatattttttggcagtctgtgggtaaaaattatctctgagatctgtacaatcatatgtggagttcatttaagccaaagtctataaagaatgtttaagaccatgcccctgtttgtgctttttactggtgtttctctattagcctggagtgataggatcagtccttgttaattataactgatagggaaacatggctaagaaatatcattcttgggtcaggcacagtgtctcatgcctgcaatcctggtgctttgggaggccaaggcaggaggattgcttgacttcaggagtttaagactagcctgggcaacatagcaagactccatctcaacagtgacatttaaaaattagctaggtgacagagtgagcttctgtgtcaaaaaatatatatatcattcttggtgatgggcttggccactttgtaagaaaccttggtatctcagatgatagatagaagaagcaaaaccgtgagcatttttctctgtaatgtttagttgtgaggccaataaacttaacactcttggaggcaggttttaagaacttcttttctatcattttcttcttccctgtttttactcccctactcaaaagatgtatgtgtatgtgtttttttttttaatccctcctacagagagaaaagcttgtggcaaagggagctaaggtataggatgtagcttctccgttaaaatctagtcctgccctgtccaatgtaataaccactagccacatgtattatcaagcacttaaaatgtgaaaagtcagaattgacaagtgttgtaagtataaaatatttcatactatatttgaaagacttagtattaaaaagagaatgtaaaatattaatagtttttaatatagattacatgttaagataatatttcacattcattgaattaaatgtcattaaaatttctcctgttgctttttactttttaaaatgtggctacagtaaaattttaaattatatatttgtcttgcatttgtggttgtattgtatttctttttgacagtattgattctagggcaatactgcagctactctacccagccatgctttggaatacagctcattatctaattttaggaccccccacccaaagagggctaaattttgcccagccttttcttcctgtccacctgctacctcagcttgaaagagtatatagtgctttactggacaggtaaggcacataaaaataaatcaagttttccccaattggaagtgagaacagatggtcttggatggggtgggacaccagactggtagggcccagatccagtagatttgctgaggatattctgtaaagcaacttgaagaaagtataggaaagttcacatttttcccattatgagtacttcagtggttttgtttttgtttgaaatatcaaattcttccaagacagttttgctccttttcagggcactgtttccctgatgcgctaagcatgtgcttagtctgtgtgatatacttccaaagaccaagcccttgataagtccaccctggagtggtggcatggcaagttgtcaatacctgagccttgggagctatactccttcagtggttggttgactgattgcaggcaaaaagatagaagttgccaatgaaaattgtttcaaaggaagtagtgtatcatgtgtgcatgtctatgtgtgtgtatttattaaagaagattctgcttaaattatttctactttaaaattctctattttaaccattgtggaagacagtgtggtgattccttgaagatttagaaatggaaattccatttaacccagcaatcccattactggatgtatacccaaaggaatataaatcattctattaaaaagatacatgcatgcgtatgttcattgcagcactattcacaataacaaagacatggaatcaatccaaatgcccatcaatgatagactgggtaaagaaaatgtgatacatatacaccattgaatactatgcagccataaaaaggaatgagatcatgtcctttgcagggacatggatgaagctggaagccattatcctcagcaaactaacgcaggaacagaaaaccaaacacctcgtgaacagaaaaccaaacacctcgtgttgtaagtaggagctgaacaatgagaacacatggacacagggagggcaacaatacacactgggacctgtcaggggagggtgggtaggggagagcattagggaaaagagctaacacatgctgagcttaatacctaggtgatgggttgttaagtgcagcaaaccaccatgacacacgtttacctatgtaacaaacctgcacatcctgcacatgtaccccagaacttaagaaaaaaaaatgaaattatttttaaaaattctccgtatgtatatatgtatgtatgtatgtattatttattgagatagagttttactctcattgcccaggctggagtgcaatggcacgatcttggctcactgcaacctccacctcccgagttcaagcaattctcctgcctcagcctcccaagtagctggtattataggcatgcacaccacacccagctaattttgtatttttagtacagacagggtttcaccgtgttggtcagtctgatctcgaactcttggcctcaggtgatccatctgctttggccccccaaagtgctgggattacaggtgtgagccactgtgcctggccaaatgatctgttttaaaaagtacaatatgagtgtgatgttccccttcctgtgtccatgtgttctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatggtcctttgggtatatacccagtaatgggatggctgggtcaaactgttgtggggtggggggaggggggagggatagcattgggagatatacttaatgttagatgacgagttagtgggtgcagtgcaccagcatggcacatgtatacatatgtaactaacctgcacattgtgcacatgtaccctaaaacttaaagtataataataataaataaaataaaataaaataaaataaaatataaaagtacaatatgagaagaaaaatcacgtcttccaattaaataatatacagttaatcaaagagagagcaagaatttgttcaactgtgtaccattataatcagacactataaagggattccaaaagtttgtgggaaaatgcaattaaaagaataaaataatgtgaacttttcttcccaacataagctccatcagggtcaagacactttccaaataaaaagtaatgagtacatagtaggtatatatatttatggggtacttgagatattttgatacaggcatgcaatgcatgacaataacatcaggggaaatgaggtattcaccatctcaagcatttatttctttgtgttataaacattccaattatactctttagatttatttatttatttattattttttgaaacagagtgtcactttgtcacccagactggagtgcagtggcacaatctcgactcactgcaacctccgcctcctgtgttcaagtgattcttctgcctcagcctcccgagtagttgggactacaggcgtgcacaaccaggcttggctaagttttttgtatttttagtagggacagatttttgcaatgttggcccggctggtctcgaacttctgacctcaagtgatccacccgcctcggcttccaaaagtgctgggattacaggcatgagccaccatgcctggcctatttatttatttatttagagacagtcttgctctgtcacccaggctggaatgtagtggcatgatcttggctcactgcagcctccgcctctggggttcaagtaattctcctgcctcagcctcctgagtagccaagattacaggcatgcaccaccatgcctggctaaattttgtatttttagtagagatgggggtttcatcatgttggccaggctagtctcgaactcctgacctcaggtgatccgcttggctcagcctctcaaaatgttaggattataggcatgagccaccacgcctggcccggcctagttatttttaaatgtacaataaattattgttgactgtagtcactttgttttcctgtcaaataatagatcttattcattctatctaactatatttttgtacccattaaacatctccactttgcccccactactcccgctacccttctcaacctatggtaactatcattatattctccatctccatgaattaattgttttgtttttttagctcccacaaatgagtgagaagattgtctttttctgcctgttttatttcatttaacataatgtcttttagttctatctatgttgttgcaaatgacagaatctcattcttttttatggctgaatagtactccattgtgtacatgtaccacattttctttatccattcatctgttgatgaacacttaggttgcctccaaatcttggctattgcaaatagtaccacagtaaacataggagtgcagatatctcttcaacatagtgacctccattcttttgtgaatatacctagcagtgggattgctggatcatatggtggttctgtttttaattttttgcagaacttctatactgttcttcatagtggttgcactaatttacattcccactaacagtgtacaagagttcccttttctccacatccttgtcagcatttgttattgcctattttttggataaaagccattaaaacttgggtgagatgatatctcattgtagttttaatttccatttctccagtgattgatgatgttgagcacttttttatatacctgtttgatacttgtatttcttcttttgagaaatgtttattcaaatcttttgcccatttttaaattggattattagattttttttctattgagttgttggagctccttatatattccggttgttcatcatttgtcagatgaagtttgcaaatgttgtcttccattttgtagattatctcttcacttcgttgatcatttcctttgctgtgaagaagctttttaacttgttaacttgatatgatctcatttgtccattttttctttggttgcttgtgctcgtggggtattactgaagaaatttttgcccagcttgatgtctttgagagtttccttaatgttttcttgtgttagtttcatagtttgaggacttagatttaagcctttagtccacttttacttgatttttatatatgtcgagagaaaggggtctagtttcattcttctgcatatggattattcagtcttcccagcaccatttattgaagagactctcctttcaacaatgtatgttcttggcatgttgtcaaaaatgagttcaatgtagatgtatggatttacttctggattctttattctgttccattggtctatgtgtttctttttatgccagtcccgtgctgttttggttgcagtagctctgtagtataatttgaagtcaggtaatgtgagttctccagttttgttctttttgtttaggatggcttaggctattccaggtctttcatgggttccatcaaaatttacgattatttatttatatttctgtgaagaatgagattgatactttgattcggattacactgaatctgcacattgctttggacattttaacaatattgattcttctaatccatgaacatggaatatctttccattttttgtgacctcttcagtttcttttttttttttttttttttttttttttgtgagccaaataaacttcttttatttataaattaccatgtctcaggtgttcctttacagcaatttaaaatggactaatacacaaagttaatgctctaacaacttttggttaaataaatgaatatgagactgtaaagttattttttaatacctcctttgttttagatgctgtattgtttttttttctttttttttttatttattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgctattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctcatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcatctttctacatatggctagccagttatcccagcaccatttattaaatagggaatcctttccccattgcttgtttttctcaggtttgtcaaagatcagatagttgtagatatgtggcattatttctgagggctctgttctgttccattgatctatatctctcttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttgactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttgggttgtgtctctgcccggctttggtatcagaatgatgctggcctcataaaatgagttagggaggattccctctttttctattgattggaatagtttcagaatgaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatctgtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtgatgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgtctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttgaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgcgatgtgaggtgtcagtgtgcccctgctgggggctgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccctgctgctttgtttacctaagcaagccttggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcacacacactggcctgcgcccactgtctggcactccctagtgagatgaacccggtacctcagatggaaatgcagaaatcacccgtcttctgcgtggctcacgctgggagctgtagaccggagctgttcctattcggccatcttggttcctccctcctcttcagtttctttcatcagtgttttgtagttcttattgtacagatctttcacttctttggttaagttattcctagataatttatttgtagctgttgcaaattggattcttaaattttaaatttctttttcagattgttcattgttggcatatttaaatgctattgattttcatatattgattttatatcctgtaattttatgtaatttacttctcagttctaataatttcttgattaagtctttaggtttttctaaatataagattatatcatctgcaaagaaggataatttgacttcttccatttcagtttggatgacctttatttctttatcttatctgattcctttagctaggatttccaggactatgttgaataacggtggtgaaagtgggcatctttgtcttgttccagatcttggaggaaagattttcaggttttacgcatatgtagatgtggttcttttctatatggcttttattgtgtgttgaagtatgtttcttctctatccagtttttttaggtttttttaaatttaatcatgaagagatggtgaattttattgaatggtttttttgtatcaattgaaatgatcatatggtctacgtccttcattctttttatatgatgtttatattgattgatttgcatatgttgaaccatccttacatcctggggataaatctcagttgatcatgatgaatgatgtttttaatgtgttgttgaatttggtttgctagtattttgttgaggattttttgtatcaatgttcgtcagaaatgttggcctggaattttctttttttgatgtgtctttgtctggttttgttatcagggtaatactgccctcatagaatgagtttggaagtattcactcctccattattttttggaatagtttgaataggattgatattagttcttcaaatgttttgtaaaattctgcagtgaagccatcattttctgggacttttcttgataggagactttttattacatctcagtctcattacttgttaagggtctattcgagtttttaattttttcctggttcaatcttggtaggttatatgtgtctaggaatttgtccatttcttctaggttttctgatttattggcatatggttgttgatagtagcttctaatgatctttgaatttctgtggaatcagttgtaatttttttttaatctctgattttatttatttgtcttctctctttttttcttaatcttcctacaggtttgttgattttgttttcaaaaaacttttcgaacttttcgaaaaatttttcaaaaaactaaccttttgttaatcttgtgtattgttctttttctctttccaatttcatttatttctgctttcatcttagttatttctttgttctacattttaatgtaggcacttactggtataaactttgctctcagtattgctttcactgtattccagagatattggtgtgttgggtttccattttaatttgttttaaggaatttttgaatttccttcttaatttcttcattgactcactggtcattcagcagcatagtgtttaatttctatgtgtttgtatagtttccaacattcctcttgttgttgatttctagttttattccattgtggtctgagaagataattgatatgatttcaggttttaaaaacattttaggccaggtgtggtggctcacggctgtaatcccagaactttgagaggccgatgggggcagatcacgaggtcaggagatcaaggctatcctggccaacatgggaaaaccccatctctactaaaatacaaaaattagctgggcatgttggtgcatgcctgtagtcccagctacttgggaggctgaggcaggggaatcccttgaacccgggaggcggaggttgcagtgagccgagatcgcatcactgcactccagcctggcagcagagtgagactctgtctcaaaaaaaaaaaaaaaaaaaaatggtctgtctttgagatctatgcactgaggagaagcatatgtattctgcagctgctggatgaaatatctattaggtccatttggtttatagtgctaagtccaatttttttgttgatttttcagtctggatgatctgtccagtgctgaaagtggtatgttgaagtctccaactattactgtattggggtctatctctttcttagctataataatatttgctttatatatctgggtgcttcagtgttgatgcatataaatttataactatttatccttttgtcgaattgacccctttatcattatataatgaccttttggtctcttttcatagtttttaatattgaattctattttatctgatataagtgtagctactcctttttttggttttcatttgcatggaatatcttttcccattcctttatttttagtctatgtgtgtctttattgatgaaatatttcttgtagccaaaagatcattgggtcttttttttatttttttaatccattcagccactccatttcttttgattggagactttagttcacttacattcaatattgttattgataaactaaggacctactcctgctattttgctgtttgttttctggttgccttatgatctttctccctccctccctccctttctctctccttcccttccttccttttcccgttctgttgtttttgtgaaggttctcctctctgatggtgttttaatttcttgccatttttgtgtgtttgtatctgttgtaggtatttcagggttaccacaaggcttgcaaataacattttgtaaccaatcatttaaaactaatgacaacttaacactgcttgtaaaaccaaacgaaaaagcagaaggaaaactaataaaaattcacacttttattcatctctcccactttttaacttcttgttgtttctatttaaatcttattacactatctcttaaaacactgttgtagttatttttgatagttttatcttttgatctttatatggaagatataagtagtttacagaccactgttacagtgttatcatattctgtatttgtctatgtacttcctattagcagtgagttttggacctccagatgatttctttttgcccattaacatcattccctttctgattgaagtacatcatttagcttttcttgtaggataggtcagcaattaatgaaatccctcagtttttgtttgtctgggaaagtctttatttcttctgcatatttgaagtatattttcactggataaaagtttttttttccttcagcacttaaaatatgtcatgccactctcctgttttgtagggtttccactgagaagtctgcagccaaacttagtggagctccattgtatgttatttgtttcttttcttttgttgcttttaggattgtttctttatctttgacctttgggagtttgattattgaatgccctgaggtagtcttctttgggttaaatctgcttggtgttttataaccttcttgtacttgaatattgatatctttctctaggtttggaatgttttctgttattatctctttgaataatgctgtctaccctggtctacctctcactacctcctctttaaggccccatgtattagtctgttttcatgctgctgataaagacatacccaagactgggaagaaaaagaggtttaattggacttacagttcgacatggctgaggaggcctcagaatcatggtgggagacgaaaggcacttcttatatggcagcagcaagagaaaatgagaaagaagcaaaagcagaaacccctgataaacccagcagatcttgtgagacttattcactatacaagaatagcacgggaaagaccatcccccatgattcaatcacctccacctgggtccctcccacaataacgtgggaattctgggagatacaattcaagttgagatttgaatggggagacagccaaaccatatctttctgcccctggcccttccaaatttcatgtcctcacatttcagtaccaatcatgccttcccaacagtcccgcaaagtcttaacttatttcatcattaacccaaaagtccacagtccaaagtctcatctgagacaaggcaagtgccttccacctatgagtctgtaaaatcaaaagcaagctagttacttcctagatacaatggggtacaggtattaggtaaatacatcctttccaaatgggagaaattggccaaaaaaaaggagttacagggcccatgcaagtccaaaatccagtgaggcagtcaaattttaaggctccaaaatgatctcctttgactccacgtctcttatccaggtcacactgatgcaagaggtgggttcccatcatcttgggtagctccacccctgtggctttgcagagtacagcctcccttctggctgccttcacaggctggtgtttagtgtctgcagcttttccaggcacatggtgcaaactgtccgtggatctaccattctggggtctggagtatggtggccctattctcacaactccactaggcagtccccctgtgggcactgcctgtgttgggactttgactccacatttcccttccgcactgccctatcagaggttccccatgagggccccaccctgaagcaaacttttgtctgggcatccaggcatttccatacatcttctgaaatctaggtggaggttcccaaacctcaattcttgactttggtgcacccgcaggctcaacaccacatggaagctgccaaggtttggagcttccaccctctgaagccacagcctgagctgtacattggcccctttcagccagggctggagtggctgggacacagggaaccaagtccctaggccgcacgcagcacaggtaaccctgggcccagcccacaaaactactttttcctccggggcctccaggcctgtgatgggaggggctgctgcgaaggtctctgacatggcctggagacattttccccatggtcttgggaattaacattaggctccttgctacttatgcaaatttctgtagccagcttgaatttctccccagaaaaatgggtttttccaaacactgcatgttctcactcataggtgggaattgaacaatgaaaacacttggacatagggtggggaacatcacaccccggggcctgtcgtggggttgggggcagggggagggatagcattaggagaaatacctaatgtaaatgacgagttaatgggtgcagcaaaccaacatggcatatgtacacctatgtaacaaacctgcacattgtgcgcatgtaccctagaacttaaagtataatttaaaaataaaataaataaataagaaaaatgggtttttcttttctactgcattaggctgcaaattttctgaacttttatgctctgtttcccttttaaaacagaatgcttttaaaagcacccaagtcacgttttgaatgctttgctgcttagaaatttcttctgctagataccctaaatcatctatctcaagttcaaagttccacaaatctctagggcagggacgaaatgccaccagtttttttgctgaaacataataagagtcacctttgccccatttcccaacaagttcctcatctctacctgagaccacgtaagcctggaccttattgtccatatcactctcaggcttttggtcaaagctattcaacaagtctctgggaagttccaaactttcccacattttcccatcttcttctgagcccaccaaactgttccaacctctacctgttacccagttccaaagtcacttccatattttcgggtatcttttcgtcaacgccccactctatgggtaccaatttactctattagtctgtttttatgctgctaataaagacatacctgagacttggaagaaaaagaggtttaattggacttacagttccacattgctgagaaggcctcagaatcgctgggaggctaaaggcacctcttaagtggcagcagcaagagaaaatgagaatgaagcaaaagcggaaacccctgataaacccgttagatctcgtgagacttattcactacaccagaatagcaggggaaactcgtgagacttattcactctgcaagaatagcagaggaaagaccacacccccatgattcaattacctccacctgggttcctcccacaacacgtggaaattctgggagatgcaattcaagttgagatttgaatggggacacagtcagactatatcaggccagtaactcatagatttgcctttttgagcctattatttagatcttgtaggcatgctccattgttttttattattattttttgccttttctgactatttattttcagatacatgtcttcaagctctctaattctttcttcttcttgatcagttcgactattgagagactgatacattcttcagtgtgtccattgaatttttcagctccagaatttctgcttgatatttaaaacttattgtaatctctttgttaaatttctctgataggattctgaattctttttctgtgttgtcttgaagtttgttgtgcttcttcaaaataggtattttgaattctcttgtctgaaaagccactatctctgtttctccaggattggtccttggtgccttacttagttcatttttgaggtcatgttttcctggatggtgttgatgcttatagatgtttgttagagtctggacattgaagagttaggtatttgttttattgtttgcagcctgggcttgtttgttcctgtctttttggagaagattttccaagcattctgaaggaattgagtattgtggcctaagtctttgatcactacagctatatctgcattagggggcatctcaaaccagtaacactatgactcttgcagacttgtcaagatcaccttgatgttctttgataagatccaagataattttctggaacaagaggcaaagactcttgttctctttctttactttctccaaagcagacagagtctccgtctccatcctgagctgcctggtattggcaaaggggtgacacaagcacctggtggctaccatcacttggactgtggtgagtcagacccgaatccagcacagtactgggtcttgtccaaatccggaggcgaccactgcctggtaattgccaatcttcattcaaggccagaactgccattcgggaaccagggccaggaatcaggaaccttaggattctacctcctgctctattctactccacctaagctggcacccccaccacaagacaaagtctttcccactcttttctcttctttcctcaagtataaagagcctgttgtaatggccaccacagctggtattgtgctgggtcacatctgaagccagcacagcactagttctcacccaaagcccacagcaactaccgcctggttacaactgatgtttattcaaggcccatgcagatgatgaatgccgccagaactgggttctcccctacaaggcagcaggttcccttctggcccaggatgtgtctagaaatgtcatcccgagctagatcctgggatgtgggcctcaggacactgcttggtgccctattctactgtggctaagctggtgtgctaattgcaagacaaagtcctttttactctcccctctcctctcctcaagcagaaggaaggagtttcttctggagctgtgagctgtgctgccttgtgttggcgaagagctgacacaagtactcctgggctggcctagctggtgtcttatagcttgtgtgtaccccatgtcctctggctcagggtccagcacagcaccaagacttgaccaggaattgcagtccttgtggcctagactgcctttcatgtttatttaggaccccaaagcactttagttcacagtcggcctagctggaactcagataccaaccactgggaaggatgattcccctctggctgtgactggtctaaatgctccctccattggcactggctgaattctgccatgtgtttcttttgctgtgacagatagcactgagttccaaagcaaagtcccacaatcactgtcctctccctctgcctatcacacatactgtctctctgtgccatgcagctaatgctaggggatagaggtgatgttgttggcaattcaagactgtcttttctaccctcttcagtgcctttttccttgatatgatgttaaaaccaggcactgtgattgtgtacctgatttttgattctcatgaaggtgcttcattatgtggatagttgttcgatttggtattcctgtggaggggataatcattagaggattctattcagccatcttgctccaccaccttctctccagacacttttgtaagtgatgataccagtcatttagtccatccctaaaaaactgaggattctgggaatttaccatgtcaatgccatctttgtaagattattacctaagaaaaatgggtgctctttactttaagagtagaaaacaaaaagaagtcagaagtagccacatcaggactgtaaggtggatgcttaataatgtttcatcaaaactcttgtaaaattaggctgggtacagtggctcacaactgtaatcctaacacttcgggaggctgaggcaggcatatcacttgaggtcaggatttcaccagcctggccaacattgtgaaacccactctctaccaaaaatacaaaaatttgctgggcgtggtggcacatacctgtaatcctagcttctcaggttgctgaggcaggagaattgtttgagcctgggaggcagaggttgcagtgagctgagatcacaccattgcactccagcatgggcaacagagtgagaccctgtctcaaaaccaaaccaaaacaaacaaacaaacaaacaaacaaacgaaactcctcctgtaaaactgaccttgtttgatgggaggaatgagcaggaacacttgtcatggtgaggagggaccctctgatgaagctttcctaggcatttttctgctaaatctttgactaagtgtctcaaaatgctatcataagcagatgttattctttatctctcccagaaagtcaacaagcaaaatggcttgagcatctcaaacacctgttgccatgatctttgctcttgactggtttacttttgcttttactggaccacttcctcctcctggtagctattgctttgattatgctttgtcttcaggattatacttgtaaagccttttttttttaatctcctattacaattcttcgaagaaatgcttcagattttgattccacttgttcaaaatttaattgaaatctctgttgttgtctgaagcggatctggtcacaaaagttttggcacccatcacatggaatatttactcaactttaatttttagtcagatctatataagctgaaccaattgagatgtctgtggtgttggcttttgtttctgcaattaattgttgggccctttcaattagagcacaaacaagataattttgttcttgcaaattgatatggatggactgccactgcaggcttcatctttaacatcatctcattccttcttaaagcgaattttctatttgtaaattgatgatttatttgggggcattgtcctcataaacttttcataaagcatgattgatttcaccattcttacactcagtcttcaccctgaatttgatgtttgttcttgcttcaattttggtggaattaatgttgcactgaaaggggctcttttcaaatttatgttttattcttcttagtgcctcagactagatcctatttagacatgttataacaagttagggagaatttattttggtgcaaatttttttgacattcatgcatagcttttaataatgtacactatccatcaacattttgaagactcctcatatagtatctactagtttatgaaatttcaataaaaatttaaaaccttcagaaaaataattacaaatggctaagtgtagatgttaattgtttaaaatatgcaactcataaattttgatttttcctgaattcatagctgtatataaaggtgcttgtccctagcctgccacacccactgtctttcagattgtgccctgatactccttcacatcattatttgcaatgacaatactagagaaataaattgtccattgataaggcataccacgggtttatttcattatgccaattttaaagctactttcttctgtgaccagaacattttttaagacgttaattggttggtctttatttggcatttgatcagaggagagacagtgttgacaaagcagacattttcagtatctttgtcatttattcactagcgggaatctttatctgttctctgccttcatgtctttggtaacctcagaccagtctggtatatcttaatttgatcttgttttccaagccaaaattcagtttttctgtgcctcacaggcttagtattctcactaatgatgatgtctatccattgttatctcaaagtcctcattttcctctgtcttacagctgagatcagatttttctgattctattcatagcagtatctgtagcttttaactagtatttttgcctcttaattaaataaatgtaacacagctagcgtctgaagtaaaatgtgactagtttatattaaatatggtaactttcataaataaatattaaaacctgtttaatcaagaataaaacccaagtatttatgaagatacttgggaattgcttttcccaacactatgatattagtaatctgggtaggactgccagatgtagcaaataaaaatacaagacacccacttacatttttgtttcatataattaaggactaatttttaatatcagtatgttcaatgcagtattaaattccatgtggtttcactgggcattttatattttaactgtcacccctaaattttcttcataggggcattgattcttgtagtagttgccctactgaaatccttcagtaaaatagaaacaaagagctaacaagttatgaattcttttcatgaaatattatcatgccctccacttatgtaatctttttcccccatcactttgccaaagttgccttcagtctctacgggcagtggtcctgtggtgttgcaatacctgctctcagagggtagggccagaccactcttttgccccacttagcccagtctcatctccatctctccctaactgttgggttacagacattcctctggtggcaaaagcagaggtgtcctctgggctgatacccaggatcacaatgctgcatctttgttgtttaaagactcaaaatcagccaccactcctttgtgctctctgtggctctcaaatttgctgcatttgtgaaaaattatctggtttacactattccagttttatttcagggctgtatcacttacattaggagattgaatacaatatcacagccatgattttcaggaaatactaacttggaagagtgttatttccagtggctatttggataattggagcataacatcctcttcataaagcattttagcctaggctgagttgaataaagatttaagcaaaatgtgtgttttagaaacctgtgtaaaagcttctttggttattctttcctatacatcaggaagatagtattgagaactacagtgtgatgacttgctctagggttacctccaagcaacccttacgaaagtgtgattttgaacaatgagataatttgtttcatgtgggtacaaatgtcgtgaatcatggcattgattatgggagtagttccattggataacattctgccttacaatggattttataaactctcttcctagggagacagctcaaagcatttcgcagggcagatgtgagtgcccaacaaagaaaaatttgccccatcctagctttcatatgtgcctaagtgtgaggcatgactcaccttccacttaagcagcaatataacctttttcttcatactctgcctttctgccttggttcaccattttcttctttctatcatatggatcgtttataataataattattcaacaaatatttgttcagcccctactacatttagggtactagatgtgttactataaggtgctgcctgtagtggccaggagcttatctttcagttagtggaagtaagatatgtcttagcccaaggcaatatgtaaaaaagtattatataagtatatacaacttggtattacagtaagtaacataagggaaaaaggtgtttttacctgggtgttttacattatgaaagcactatggaaggaatctgatgatctgtatagatgagcaagatttcagtaggggaaaatgtgggatggaggatcattcagacagaggaaattacacaaaagccttgaagcttaaagaaaagcacaactttgcagaatggaatgtgattcagatggaatggaataagtcctttttttctatttgagggtaacgggacaatattacagatggatttgaatggtatatgggaacaaaatagtgcttcaggtagattaacctaaaagtactgtacagactgattgaagggcagaaagtttaggaaattgattatttgaaatagtttaggcataaagtgataatatcctgacctattaaaagatggtagtgccaaaaaagaacacatggtttagctggcccaaacaatggttagtttgtctacttagacaatatattgaataatattctctatttttcataatattttcatattgtgaactacttaacacttataccgaattacctcaacactaataatattttcatattgtgaactacttaacacttatgcctaattaccttaacacttataactaatcactatgcaaagtaagaacagtcttgtatatgtaatttgttatcaaccacttaaaactttggaaaaatgaaagagtttttatttgtagaactggttctaaataaaaaggcaaggccagacaaatacctggaaagaaaccttctcttagccctagagccactgaatcaagtcaaaataccttccacaaatggcaacttaatacttaaggaataagtgaagttacttttacagtttcttaacagcagttgcattttctttctttttattacaaattcagactttaaaattgttctcttagctgcatgagagtcaattaggaaaaagttacataaaaatcattgttcctcatgacatacatatcaaaagcaaaaatgtatattgattaaaggggtagaagggaatttcaaacgagaggaggactgtaaccataaactgtttctgtctcatatggtattaagaacagcaaagaacctgagcctgttaagcactataatccagaggtacactgaatgggaattttctgatccttacctaaccttcatgtcaatctactacttcaagctatttttctgtgaaaaagttaacatgtaaactaagacagatacctgagatttaaaaacaaaatctattgtaatttgcttctaacagtgttttatacaccttaattatgtaattcatctgtcactttaataagagtgattttaaaataatgcagggattgaatgtatctttatcttttgtacttcttttcatataaaatgaagtaaagctcaatgagcaaaccccaaacagttttttaaattattttggatgaatcaaataatagtaggattttccatttctgttttaagatagagatccattttgttttgttcatagtttatataatatgtaaaattatttttatatatcatctttgatattagaaaagacattttggtatgcgttttttttttctttttttaaatttattttattattattatattttaagttttagggtacatgtggacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcatagttcaattcccacctatgagtgagaacatgcagtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtggacaataaacatacgtgtgcacgtgtctttatagcagcatgatttatagtcctttgggtatatacccagtaatgggatggctgggtcaaatggtatttctagttctagatccctgaggaatcgccacactgacttccacaatggttgaactagattacagtcccaccaacagtgtaaaagtattcctatttctccacatcctctccagcacctgttctttcctgactttttaatgatcaccattctaactggtgtgagatagtatctcattgtggttttgatttgcatttctctgatggccagtgatgatgagcattttttcatgtgttttttggctgcataaatgtcttcttttgagaagtgtctgttcatgtcctttgcctattttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattactttttgtgttttagacatgaagtccttgcccatgcctatgtcctgaatggtattgcctaggttttcttctagggtttttatggttttaggtctaacatttaagtcttttatccatcttgaattaatttttgtataaggtgtaaggaagggatccagtttcagctttctacacatggctagccagttttcccagcaccatttattaaatagggaatcctttccccattgcttgtttttctcaggtttgtcaaaaatcagatagttgtagatatgtggtgttacttctgagggctctgttctgttccattggtctatatctctcttttggtaccactaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttttaagttggattcccaggtattttattctccttgaagcaattgtgaatgggagttcactcatgatttggctctctgtttgtctgttattggtgtttaagaatgcttgtgatttttgcacattgattttgtttcctgagactttgctgaagttgcttatcagcttaaggagattttgggctgagacattggggtttctagatatacaatcatgtcatctgcaaacagggacaatttgatttcctcttttcctaattgaataccctttatttccttctcctgcctaattgccctggccagaacttctaacactatgttgaataggagtggtgagagagggcatccctgtcttgcacctgttttcaaagggaatgcttccagtttttgcccattcagtatgatattggctgtgggtctgtcatagatagctcttattattttgagatatgtcccatcaatacctaatttattgagagtttttagcatgaagcattgttgaattttgtcaaaggccttttctgcatctaatgagataatcatgtgatttttatctttggttctgtttatatgctggattacatttattgatttgtgtatattgaaccagccttgcatcccagggatgaagcccacttgatcatggtggataagctttttgatgtgctgctggattcggtttgccagtattttattcaggatttttgcatcaatgttcaccaaggatattggtctaaaattctcttttttggttgtgtctctgcccggctttggtatcaggatgatgctggcctcataaaatgagttagggaggattccctctttttctattgattggaatagtttcagaaggaatggtaccagttactccttgtacctctggtagaattcggctgtgaatccatctggtcctggactctttttgattggtaagctattgattattgccacaatttcagagcctgttattggtctattcagagattcaacttcttcctggtttagtcttgggagagtgtacgtgtcaaggaatgtatccatttcttctagattttctagtttatttgcgtagaggtatttgtagtattctctgatggtagtttgtatttctgtgggatcggtggtgatatcccctttatcattttttattgcgtctatttgattcttctctcttttcttctttattagtcttgctagtggtctatcaattttgttgatcctttcaaaaaaccaggtcctagattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagtacatctttatttctgccttcattttgttatgtacccagtagtcattcaggagcaggttgttcagtttccatgtagttgagtgattttgagtgagtttcttaatcctgagttctagtttgattgcactgtggtctgagagacagtttgttttaatttctgttcttttacatttgctgaggagagctttacttccaactatgtggtcaattttggaataggtgtggtttggtgctgaaaagaatgtatattctgttgatttggggtggagagttctgcagatggctgttaggtctgcttggtgcagagctgagttcaattcctggatatccttgttaactttctgtctcattgatctgtctaatgttgacagtggggtgttaaagtctcccattattattgtgtgggagtctaagtctctttgtaggttactcaggacttgcattatgaatctgggtgctcctgtattgggtgcatatatatttaggatagttagctcttcctgttgaattgatccctttaccattatgtaatggccttctttgtctcttttgatctttgttggtgtaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttattccatttacatgtaaagttaatattgttatgtgtgaatttgatcctgtcattatgatgttagctggtgattttgcttgttagttgatgcagtttcttcctagcctcgatggtctttacaatttggcatgattttgcagtggctggtaccggttgttcctttccatgtttagcgcttccttcaggagctcttttagggcaggcctggtggtgacaaaatctctcagcatttgcttgtctgtaaaggagtttatttctccttcacttatgaaacttagtttggctggatatgaaattctgggttgaaaattcttttctttaagaatgttgaatattggcccccactctcttctggcttcccccactctcttctggcttgtagactttctgccgagagatctgctgttagactgatgggcttccctttgtgggtaacccaaccttcctctctggctgcccttaacattttttccttcatttcagctttggtgaatctgacatttatgtggcttggagttgctcttcttgaggagtatctttgtggcattctctgtatttcctgaatctgaatgttggcctgccttgctagattggggaagttctcctgaataacatcctgcagagtgttttccaacttggttccattctccccgtcactttcaggtacaccaatcagacgtagatttggtcttttcacatagtcccatatttcttggaggctttgctcatttctttttattcttttttctctaaacttcccttcttgcttcatttcattcatttgatcttccatcactgataccctttcttccagttgatcgtatcggctcctgaggcttctgcattcttcacgtagttctcgagccttggctttcagctccatcagctcctttaagcacttctctatattggttattctagttatacatttgtctaaatttttttcaaagttattaacttctttgcctttggtttgaatttcatcctgtagctcggagtagtttgatcgtctgaagccttcttctctcaactcgtcaaagtcattctccatcctgctttgtttcgttgctggtgaggaactgcgttcctttggaggagaagaggtgctctgctttttacagtttccagtttttctgctctgttttttccccatctttgtggttttatctacttttggtctttgatgatggttatgtacagatgggtttttggtgtggatgtcctgttttgttagttttccttctaacagacaggaccctcagctgcaggtcttttggggtttgctggatgtccactccagaccctatttgcctgggtatcagcagcagtggctgcagaactgcggattttcgtgaaccacaaatgctgctgtctgatcgttactctggaagttttgtctcagaggagtaccctgccatgtcaggtgtcggtctgcccctacttgggggtgcctcccagttaggcttctcaggggtcaggggtcagggacccaattgaggaggcattctgtccattctcagatctccagctgtgtgctgagagaaccactgctgtcttcaaagctgtcagacagggacatttaagtctgtggaggttactgctgtcttgttgtttgtgtgtgccctgcccccagaggtggagcctacagaggcaggcaggcctccttgagctgtggtgggctccatccagttcgagcttcccggctgctttgtttacctaagcaagcctgggcaatggtgggcgcccctcccccagcctcgctgccgccttgcagtttgatctccgactgttgtgctagcaatcagcgagactccgtgggtgtaggaccctccgagccaggtgcaggatataatctcctggtgcgccgttttttaagcccgttggaaaagtgcagtattcgggtgggagttacccgattttccaggtgccgtctgtcacccctttctttggctagcaaagggaactccctgaccccttgcacttcctgagtgaggcaatgtcttgccctgctttggctcgcacacagtgcgctgcacccactgtcctgtgcccactgtctggcactccctagtgcatgaacctggtacctcagatggaaatgcagaaatcacctgtcttctgcgtcgctcatgctaggagctgtagacagagctgttcctattcggccattttgggtgccccccgttggtatgcggtttgctgtgaaattttggtttggaagtctgtgaatccttgtcattatctttggttatggtacaaattattagcttttgctactcctgttgtctaaatgatgttgggagagaatttaaacttcaaagcaaacattttaaaacttgagtctgtctccatcttggggaatagatggttaccctgcctgcttctctaattctgatttattcagtactcatttacctagtgcctactaaagtctcaggcaccagggaaacaaagtaaataagaattggtcatggtcgacctagaggtggcaatcaaatgggggtattcagacatggacactagttaattaaaatagcagagtgaaagcctagaggacgaattgattaagtgaggaaaagggagacaagacttccaaaataattatttgtatgtcagcttagtgatgggagtggaagttcactccattgcggttgagaataaaaaggatacttgactatgtggataattctgaattgagttttatacttcagttttaaatgtggaatgaaagttctgttagaccagtaattctcaagtaacagtttgtggccttttgctggtggctacatagacacttgttaaaaatgcagactgcctggaggtactatgttctgaaaaagcatctcacgtgattcttataattagtaaggtatgacacctactttaataaagatccaggagagataaaataaatggtagttgaagtcacaggaatggataagatttcccttgaaagtgtggagagtaagcaaagcagaagacaagaagtaagtagagaaggagccagcaaaggaactaaaaaggaatatactgtgtccagcagctaggatgtatatttacctgagtcttccagttcttagaatggtaatcctcatttctgaattgatatatagagaaaaaatgtagaagaaaaatctctagactgctatttatgatttggctttattctaaaagggattaatcaagtttcagctttgccctatctccaaatattatgcctacttctggaggaagtataatcacaaaatctgtagcagaaacagcaactgaccctctcgaatagtgaaaaatgaagaaagtagagtatcaggaaagaaagttgtaatattaaccaggctttgtaaaacaaaaaatgctccatcatacagttactggatggaatgaggatatttaatttactgaagtgacctttataattgagaactagaactgttatagtctctcaggaacaaatccttctgttcttagccattcctattcttttgtattgatgttgttgtgatccatgcatcttctacttttaggtaactaaaaccttatgttaatggaaatgtgctgttataaaagggcatacaatggcaattatataacctgaattggcataaaaattaattgtctttttcaaaatccacatccccagatagaatacctgttgatcctgaaggatttttaaaacatatacattaccagggggtgcagccaagaggccaaataggaacagctccagtctacatctcccagcgtgagcgacgcagaagacgggtgatttcgcatttccaacagaagcactgggttcatctcactggagagtgtcagaaaatgggtgcaggacagtgggtgcagctagtcaaagaaaggggtgacatatggcacctggaaaatcgggtcactcccacccgaatactgcacttttccaatggtcttagcaaatggcacacctttagattatagcccgcgcctggcttggagggtcctatgcccacggagcctcactcattgctagcacaggagtctcagatcaaactgcaaggcagcagcgaggctgtgggaggggcgcccgccattgctgaggcttgagtaggtaaacaaagcggctgggaagctcgaactgagtggagcccaccgcagcttaaggaggcctgcttacctctgtagactccacctctgggggcacagcatagccaaacaaaaggcagcagattcctcagcagacttaaatgtccctgtctgaccgctttgaagagagtaatggttctcccagcacgcagctggagatctgagaatggacagactgcctcctcaagtgggtctctgacccacgcgtagcctaactgggaggcaccctgcagtaggggcagactgacatctcacacggccgagtactcctctgagacaaaacttccagaggaatgatcaggcagcaacatttgctgttcaccaatatctgctgttctgcagccaccactgctgatacccaggcaaacagggactggagtggaactcccacaaactccaatagacctgcagctgagggtcctgactgttagaagaaaaactaacaaacagaaaggacatccacaccaaaaccccatctatacgtcaccatcatcaaagaccaaaggtagataaaaccacaaagatggggaaaaaacagagcagaaaaaatggaaactctaaaagtcagagtgcctctcctcctccaaaaacgcagctcctcagcagcaatggaactaagctggatggagaatgactttgacgagttgagagaagaaggcttcagacgatcaagctactccaagctacaggacgaaattcaaaccaaaggcaaagaagttaaaaactttgaaaaaaatttagacgaatgtataactagaataaccaatacagagaagtgcttaaaggagctgatggagctgaaaacgaagacatgagaactacgtgacgaatgcacaagcctcagtagccgatttgatcaactggaagaaagggtatcagtgatggaaaatcaaatgaatgaaatgaagcgagaagagaagtttagagaaaaaagaataaaaagaaatgaacaaagcctccaagaaatatgggactatgtgaaacgaccaaatctacgtgtgacaggtgtacctgaaagcgacggggagaatggaaccaagttggaaaacactctgcaggatattatccaggagaacttccccaatctagcaaggcaggcaacattcagattcaggaaatatagagaatgccacaaagatactcctcgagaagagcaactctaagacacataattgtcagattcaccacagtggaaatgaaggaaaaaatgttaagggcagccagagaggaaggttgggttacccacaaagggaagcccatcagactaacagcagatctctcggcagaaagtctacaagccagaagagagtgggggccaatattcaacattcttaaagaaaagaattttcagcccagaatttcatatccagccaaactaagcttcataagtgaaggagaaataaactcctttacagacaagcaaatgctgagagattttgtcaccaccaggcctgccctaaaagagctcctgaaggaagcgctaaacatggaaaggaacaaacagtaccagccactgcaaaatcatgccaaattgtaaagaccatcgaggctaggaagaaactgcatcaactaacaagcaaaataaccacctaacatcataatgacaggatcaaattcacagataacaatattaactttacatgtaaatggaataaatgctccaattaaaagacacagactggcaaattggataaagagtcaggacccatcagtgtgctgtattcaggaaacccatctcacgtgcagagacacacataggctcacaataagggacggaggaagatctaccaaggaaatggaaaacaaaaaaaggtacgggttgcaatcctagtctctgataaaacagactttacaccaacaaagatcaaaagagacaaagaaggccattacataatggtaaagggatcaattcaacaagaataactatcctaaatatatatgcacccaatacaggagcacccagattcataatggaagccgttagagacctgcaagagacttagactcccacacaataataatgggagactttaacaccccactgtccacattagacagatcaatgagacagaaagttaacaaggatatccaggaattgaactcagctctgcaccaagcagacctaacagccatctgcagaactcttcaccccaaatcaacagaatatacattcttttcagcaccacaccacacctagtccataattgaccacatagttggaagtaaagcactcctcagcaaatgtaaaagaacagaaattataacaaactgtctctcagaccacagtgcaatcaaactagaactcaggattaagacactcactcaaaatcactcaactacatggaaactgaacaacctgctcctgaatgactgccaggtacataacgaaatgaaggcagaaataaagatgttctttgaaaccaacgagaacaaagacacaacgtaccagaatctctgggacacattcaaagcagtgtatagagggaaatttatggcactaaatacccacaagagaaagcaggaaagatctaaaattgacaccctaacatcacaattaaaagaactagagaagcaagatgaaacacattcaaaagctagcggaaggcaaaatataactaagatcagagcagaaatgaaggaaatagagacacaaaaaacccttcaaaaaatcaatgaatacaggagctggttttttgaaaggatcaacaaaattgatagaccactagcaagactaataaagaagaaaagagagaagaatcaaatagacgcaataaaaaatgataaaggggatatcaccaccgatcccacagaaatacaaactaccatcagagaatactacaaatacctctacacaaataaactagaaaatctagaagaaatggataaattcctcgacacatacaccctcccaagactaaaccaggaagaactcccattcataattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccatactccccaaggtaatttatagattcaatgccatccccatcaagctaccaatgactttcttcacagaactggagaaaactactttaaagttcatatggaaccaaaaatgaacctgcactgccaattcaatcctaagccaaaagaacaaagctggaggcatcaagctacctgacttcaaactatactacaaggctacagtaaccaaaacagcatggtactggtagcaaaacagagatatagaccaatggaacagaacagagccctcagaagtaacacggcatatctaaaccatctgatctttgacaaacctgagaaaaacaagcaatggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcaataccattgaggacataggcatgggcaaggacttcatgtctaaaacacaaaaagtaatggcaacaaaagccagaattgacaaatgggatctaattaaactaaagagcttctgcacagcaaaagaaactaccatcagagtgaacaggcaacctacaaaatgggagaaaatttttgccatctactcatctgacaaagggctaatatccagaatctacaatgaactctaacaaatctacaaacaaaaagcaaacaaccccatcaaagagtgggcgaaggatatgaatagacagttctcaaaagaagacatttatgcagccaagagacacatgaaaaaatgctcatcatcactggccatcagagaaatgcaaatcaaaaccacaatgagataccatctcacaccggttagaatggtgatcattaaaaagtcaggaaagaacaggtgctggagaggatgtggagaaataggaacacttttacagtgttggtgggactgtaaactagttcaaccattgtggaagtcagtgtggtgattcctcaaggatctagaactaggaataccatttgacccagccatcccattactgggtatatacccaaaggactataaatcatgatggtgtaaagacacatgcacacgtatgtttattgcggcactattcacaatagcaaagacttggaaccaacccaaatgtccaacaatgatagactggattaagaaaatgtggcacatatacaccatggaatactatgcagccataaaatatgatgagttcatgtcctttgtagggacatggatgaagttggaaaccatcattctcagcaaactgtcacaaggacagaaaaccaaacaccgcatgttctcactcataggtgggaattgaacaatgagaacacatggacacaggaaggggaacatcacactccggggtctgttgtggagtgagggaaggcaggagggatagcattaggaaatatacctaatgctaaatgacgagttaatgggtgcagcacaccagcatggcacatgtatacatatgtaactaacctgcacgttgtgcacatgtaccctaaaacttaaagtatattttaaaaaataccgaaatttttgtaggtatgtagttattattcaatttttttgaaatgaattagcgactggaatgcattcacttttctttgaagtttcaggtggtactttatgaaaaggaatttccaagatcattttaatagttatgtgatcaacttttcacttaatattcttccttgcactgatctgatacagatttttcacaacctcagtgaacaagtggtaaaatggtcaacagtggttctaatatatttagctttggaggttctacattaaaggttatttttagaaagttttcataattaacacagtcttgaggaactattttattatgaataatattttgttaatgtcagaggaaaagttgaacaatgatacgtatatctaaatagagaaaatttactcgtgagaataccacagtgagatcttcaaattttttgatggccaatttgtggagtctaaccaacagcaagttagggagaacacaatccacactgccctcagttctgacaccagttgtaaattcagggagttaccaaaaccacccttaagttcataattaattaaacatgctcatggaagctgacagaaagctgttatactcatagttacagtgtattacaactatagaatagagattaaagccagccaagggaagaaacacaaagggttgagtccaggagaagcaccaaatatggagcttcctttgtcctctccccatgagtaatggatgttacttttctggcatcagtgtttgataatacacgtggagtactgccagctagggaagctcacccaatccttgttgcccagattttttgttgaggctctgtcacatattacctatgtggctgacctttattctccggcctctctgtaggtaaaacttgtatggcatggtccaaagtcttagtcataaataacattgttagactattcagtgtccaaggcccccatgccttggacccccctcatcaggcatgatgttccatgggctagaagtcacctattactagccagtggcaaaggccaaacttctctttgagtaaggttaatttttcactacactctatgtcattcagatagtaaaagcagatgaaaccaaactggaaccaatggcttaacaaaactgagacttcagagactatgacagatgaaatggctccatattgtccacaggattaagttaaagtgtttgcattgaaaatcacctttctgtatcctggttctctctcaacttgttcttttatgaattcccttctgcagtcaattagagtcacatctactgggcatgccaagtgctttcctgctttggagggtttgtttataccacactcgctgttaatatattcactcatgatctgtaggttttgttgagcccagcccaggccccatctcctgtggaaggccactttcaccactttaccacttttgcagacattctccactgatttcccatagctaacattgcccatatagttttttttggctgttagcatatatttctttccattgatatgtatacctatatcttgtctttacaagttgatcttaagccttttgcaatttaaggaaataatggactatgccctgtgtttttttgagcccccagatcctattacaatgtcttgcacataacaaatgttaaataaatatttgaatgggaagttttcatatagacttgcaagtaggagtatattattcaaatatatgaattaaatcatcttgtaaaaatgatgtaaattatacttataaatttctgaggtaagttaatccagaaaaatattggaatcatttttggcaattcattgaagacactggaaacataaaggtcagaaaaatgatggaaaatggtaagagaagtattgccattccacttccacttcagggcctttcacattgctttcccctctgactgtaacactctttctctaaatatttctctaaataatctcactcagagaggcaaaaccaccctacctaataggtcagccctttcctcactatctctttatcttgccttttttttttttttttggatggagtcttactctgtcacccaggctggagtgcagtggcgcagtcttggttcactgcaacctccgcccccctgagttcaagcgattctcctgcctcagcctcccaagtagttgggattacaggcacctgacaccacacctggctaatttttgtatttttttagtagagacggggtttcaccatcttggccaggctggtcttcaactcctgatctcatgatccacccacctctgcctcccaaagtgctgggattacaggcatgagcaactgtgcctggcctatcttgctttatttttatattactttttactaaccaatcaacattatatgcttaatgtctttcttccctactaccagattataggctccgtagagtcagagacttattcttgctaacagttatatcttctacatctagaatagtgcctgattcttagtaagtgctaagaaaagtttttgttgaatacatgaatgagtttgtactattcagcaaacagaaagcttaatttttatatacgttcactttttgtggggtagtgtgtgtgtgtttgtttgttttcagagtgggccttactctgttgcccaggctggagtgcagtggcatgatctcagatcactggagcctcgcctcctgggctcaagtgatcctcccatctcagcctaccaaggtgctgggattacaggtgtgagccaatgcatctggccttacagtcactttttgtattattcaatttatgaaaacataattgagcttgaagaatttcaaagagaagcatctaaagtgattgaggaagtggtagaatgttttctaaaattactaaaaattattcagcttataaaaataattattaactttggccatatatggatgcacacatggtcaaagttataaaattataaactgtaataattaggttaaaataggcatgtttctcaaaccctagttttatcgaagcactctttaaaagtttttcagagaagtaaaggaatattatttttatacagtggataataaacatggagctctttcttaaaatttgtatgtatttcaaaagagttcaaagagctgttttgataaaaatcacaattttaaagataatgcaaaatgagaaatatttataacttcggaaagtaacagcatggatttcagctatggtgctttatcctaaaaggagttgcaggtttcattattgcctgttgatattaattccaaaaatgtcaagttccccagttgggacaatgaacagtcagcaaccctgagaacgaaggcatatccaaatgtgaccacaggagtattgggtaggtgtaactggagtctaaccccacatgtttgtggtagacagtcatctggaactctgacctagattacttagaatctgtgggaaatccaggctatgcccataggcctcagtgcctcctagtcttatagtctttaaagaatgctttgttctattcaagtattttccactggaatcccagcacttccttcaagaacaaggtacacatcatgaatattgactgctctcgaaatacgcttcgtcctctcctctctacacgcctccctttagttctcattgtagcttctttccctgaagagatttatttctacctgaagctagaatatggcttatatttttgaccattgtgtctggctttgattctgaagtgtttggcagcatttgtgtgcagtgactgggaagcagtttgttcacaatatgattttattgaggttttttcctttgcttctgtatttccacacttaagactccccccaccccatattcaaggaacaaaggctggcaatgatccagcccttttgtattattgtctctagttcatgattttagtagcatgtttgcaactagagtacacttttatattttctcttttcatctctgcctctatggatttttggcaaacatcaaggtgaataaatcagaccgaccactgcaaacccatctgctttcaggaacatgttagcagaccaatttgtgatgttttatcatccaacatagaactaaaggaggctccctgtggagtaagaatagaaggcaaagtctgaggtcaaagagtttttcagctttgaattatttatctgcctactgattgtgctagggacagtctatactggcatttttaatggcactaacagattggtacggtataatacttataaagttgaaatgattttgtggtagatttaaagtgaaaatacagcttatactttggatttgataatagggattaataaaaaaagatgctgtcacagtttttaaaatgtggcaaatcaaggtacacagtgttcatttgacaggatattacttttacacttcagccgctgctaaggttacatttgaaaacagtcttcctcactaaaatacctttctagttgttgacagcccagaaattggtcataaaaaataataggctgtggtcatacaaagctgtcttcctaatgcttgttgacacttcaatgctgcattcatttctttctcacaatgagcaagtaagtgatgattctctttgaaaaagaattaagagaattgcaaacatgtcagtgtatatacgttatactgggagaacagttcatgtaatactcttgataacaggcactaaattgaacctactttaaattgatcaaaagttaagcaagctgcttatatctcatagagttgattttaagctgatcttcaacaagctaaattgtattctctgctggactatgattttatccagtagagatcaatgtctttttttgagaataagtttagtcttactacctaatggtttggaaattaaagagaacccttgaaaggcagatttagtttctctgtgatgataatgtcaagggcatggggtatgggagatgtaactcagtttttcagactttatgacaaacttctttctactttgtgatctgagtcagcttttgtttatagaccaacctgacagaggcaggagaaaggatactctcaagaactttgcctatgagttacattcttggtggtgatggtccagaaaggaggcatatacttgtgatagtggtttttgtcctttccatacatgacttcaactattttttatctttaaaagctaaattctaaagtaatgatggaaatggtgactgctctggcaaatttagattctactgtaccctgtccttcctatccttcttctggacatatttgtgtacatctttctttattgtgtgggttacatgcaaagctggggccagagtgtgtattagttgataaaagcagtactttatctgaatagttgttcactgttgcttttatgaatggattcatagaaaaaagggtaatttaggacacataaaatacatgattggaaattaaacagagtgtgtgtgcattaatccatcattgtgttgtaaatctctaaaggaattggtttcataatcataatgtaacagaaaacagttgtttatttaggtatacagatacagaaggatgtctaaaatgtatattcaccgaaaattttaaacagttgaataatggttcttatggaaatgggaaaaatatttcttgtcattaattaataattttatttatttaacaagtactcagtttatactaggcaatatgctaagtacttcacatacattctaaataatgttattttaagtaacattatgcatttgatattatcatcccattttacacatgaggaaactgtagtttagcaagattaaataacttgtctgagatcctataggaattaagtgaggaaagtggaaatagaatcaatgagtttatctggcttcaaggccattataatatcgtattggactctgaggtacaaaatgggagatacacctgctgagaagtaagttgtggagcaatttatgcgtctagatattagtgaagtggctgccctaaaggaatgacttgttccctcttctcattctggagaaaactggcaggacttagggagcccgtgcatatatgggaatcttctcagaaaatgaattcatatcagttttggttgtgctataaaatgttttcagccatataaaaataaaatatcataagaaagcccttagctccagatatttagatgatgaattattgagcctctttttgtccttcctctttcttcattatatttcttgtaaaaattgaccactacaatcagaataagtctaaaaagaaaggaattaatattgaggagaaaaattgttttgttttccttttgcagaatgttaggttttgtaactttcttgactcaaatatttgttgaatgagtgagtgagtgaatttggatgattagatgtgcattcctgaaacataaactctttctactctcaactgttatgggtaattggaaggtgggttgacattagcttttgcttcaaaaacacaattattttcttttgattttcacaagttcagtacacaatttcattcctattaggctgtttacgagaatctgttctatctgttgacctttacttatatgagatggatcagtgactaatgtagcaaaataccttatttagtctataaagtgaagttctagaaattattcccttagccaaatgagagcactgtataagaagaaaactctaggaacacatatgtattaaacatttaaaagtaatcctaggaaggggaattttattttaattaattttttttttgagacggagtctcgctctgtcgcccagtggcacgatctcggctcactgcaacctccacttcccaggttcaagcgattctcctgcctcagcctcctgagtagctgggattacaggcatgtgctaccatgccgggctaattttttgtattttttagtagagactgggtttcaccgtgttgccaggctggtctcgaagtcctgagctcaggcaatccgcccgcctcagcctcccaaagtgctgggattacaggcgtgagccatcgcgcctggccaggaaattttattaagtaaggacaaggtgattttattttcatttgattttgtcctttatttcttaaatatggaaggtcaagtgtgcatagaaaaaaattactcagtattgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttcggcatctattgagataatcgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattgattttttgaagggttttttgtgtctctatttccttcagttgtgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattatggaataggtgtggtgtggtgctgaaaaaaatgtatattctgttgaattggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcctgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgccttaacattttttccttcatttcaactttggtgaatctgagaattatgtgtcttggagttgctcttctcgaggagtatctttgtggcattctctgtatttcctgaatctgaatgttggcctgccttgctagattggggaagttctcctggataatatcctgcagagtgttttccaacttggttccattctctgcatcactttgaggtacaccaatcagacgtagatttggtcttttcacatagtcgcatatttcttggaggctttgctcatttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccggctttgttccgttgctggtgaggaactgcgttcctttggaggaggagaggcgctctgcgttttagagtttccagtttttctgttctgttttttccccatctttggaagttctggccagggcagtcaggcaggagaaggaaataaagggtattcaattaggaaaagaggaagtcaaattgtccctgtttgcagatgatatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgagtaggaagaatcaatatcgtgaaaatggccatactgcccaaggtaatttatagattcagtgccatccccatcaagctaccaatgactttcttcacagaattggaaaaaactactttaaagttcatatggaaccaaaaaagagcctgcatcaccaagtcaatcctaagccaaaagaacaaagctggaggcagcacactacctgacttcaaactatactacaaggctacagtaaccaaaacagcatggtagtggtaccaaaacagagatatagatcaatggaacagaacagagccctcagaaataacgctgcatacctacaactatctgatctttgacaaacctgagaaaaacaagcagtggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaacccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccttactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaagcaaacaccgcatattctccctcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtatctaacctgcacaatgtgcacatgtaccctaaaacttaaagtataataaaaaataaaataataataaaataaaaaaataaaaaaagaaaaaaaagaaaaaaattactcagtgttaggcaaatttactctctagatttttttctttttaccaatttttcttttcctgaatcagactattggaaccatttaaacacagcataatgctaaatgcataatcagttcctagggaatacagtccaacgatttctctctcttaatgtcctgaaaagtacaaaaagagttatcctgcgggccaataggcacatatttacccctgaaatatttcagcaatggcagtagtaacatttttattcctcatctttcaggtagtttataagtggaaactattaacttatcggaagagagctcttctgttggagaaaacctggcagtgaaaactttggtttgcctggttaccagatttttgtactcaagactccagacaagataaaagaaatgtttcataatatatcactttatataatacctttatacttaccttattctatacccccaccccaccctgcagttttctttatcattagaaactacatttaccttggcaaatataaattttctctgtatccttttactgaagttatggtgattttttaaggctctattttaattcaggtttagcatttcattcctgtaagccatcagaatttcctctggatcgatttgtaatatgttcaatgtttgctaggaaatttggaagtttttggtttgcttcctctctttctgtatataagatctaattaccacccagcatgaaatagcaactgaaatgaaggcagcaagaaagggtagtggcttaccttagagctaatcaaccacccccttcttgtatacttcgcagctatcaagagaaagaaaaatggcattcattaaaataacatatattaaactttttttctttcttgatttgagactgaagagaaagtttcttcaaatctttatggaaataagacattaagcaattcttttaatttgcaattagtagtctgatgtgaattgtacaaaatattttcaccatcagtgttgctataagtagccccatactattttcttgacatttaaaaagataaacatttctaggaataaaataaaatcaagagaatgtttaatcatttttataaggctagaatttcactcaatttggggttttggtttctaaatttgtcttcaacaaatatctaggcttatctttaaagaagatatcatccttcacacctgtaatcccagcactttgggaggtcgaagtgggtgaatcacgaggtcaggagtttgagaccagcctgttccaacacagtgaaaccccatctctactaaaaatacacacacacaaaaaaaatagctgggcgtggtggcgggcacctgtaatcccagctacttgggaggctgaggcaggagaatcgcttgaacccgggaggcggaggttgcggtgagccaagatcgtgccattgtactccagcccgggcaacagtgtgagactctacttcaaaaaaaaaaaaaaaagagatcatcttaatatagtagcctgtagcttcctgttttgtggaatcagtttgttgggtaattaacctgggaaagattgacagtatttttactttttaaatgaccatggtctgagtttttatcagattgtcagatttaaaaattagataatttgtggtattagacagatgagaaatacatactctactattgtttggagtatgtattggaatgacagttctggagagagagagtacattcatcaaaattggaaatgcatgtaacttttgccttagcaattaaacctcaaggaatttatccttgaacacgtgcataagccatgtataaaatattccttatgatattgtttgttatataaatagaaaaaaatgcaaagaagatggtcattaataggagaatgttcagtaaattatgatatatctatatccagatataccttatttttaaaaagtaaccactcctacagagaataaactatatgtacatgtcttgataaggaacactctatgttatcccattaagtgaaagaaacagtctagtttgcttcaatggagatgtatgtatacaacttccctccatccctgccccttctccccatataaacatacatacacacacaaatatgtatagatagatgggtgaaaagatacaaaggagctgttggtagcacttatcttgggtataggactatgggtctgggatagaagggaagtttttatgtttttctgttgtttacttttcttgctgtttgagttttttaccatgtgtatatattatatttcataactgggaaaaaatttaataaccaggtctattttctttcttttttaggactcagcccaggagagtgttattactcgagatattcatcgtacatttcccgcacatgattactttaaagatactggaggagatggtcaagaatcgctctataagatctgcaaggtaggactctcttcctcactttttctaaattattttacagagctatattttagaaacccatttaaggatttttttactctgtcttcatttcttatttgcactatgccatgttttctgctttgcacacacgctatgagatcctcagtactgatcccagaaggtgacttttcggttgcatgtttcgtgcctcctcatgagggaggaggcgcagcatagcctcagtttggctctcctgctaacaggaaaggaacaaaaggtcctctgaggctatgctataaaagctcaaaagagtcctagatgactctgtccttctgacaagatcatgcagcaattgtctccatttttctgacaacaggcaagtgtaagaatcagtgtgcttattgttgaatactggcaaattattggatgttgttgatatattctgagttacgtcacatcatatatttttgtacggtttttatatcccattttgaaatcttttttctccctcattataagtaggcctggaaaaaacctgtttcctgattttcagtaaatgtgctctgcttggatacagaagattctgtctctgtcagtatagaatagccatcaagttattaattttatcagaaatgcagaatgaagtgtggtgggtatactcacattgttgatatctaacattctaaagagatggttaatgaataatgaactgcacaaaaatttggtaataatatggagaaaaaggcaaacatcatggctaatttgtaagttaggtaatcagttcctgaataatccaatttagcctttgtaatgagtagcaaatattagccagtgtggaattaagaagtatattcacaaatctgtttcattttatatttactgttttttaaaaacagcacttataaaagcactcacttctccagcatttaagaggatgtggagaaataggaacacttttacactgttggtgggactgtaaactagttcaaccattgtggaagtcagtgtggcgattcctcagggatctagaactagaaataccatttgacccagccatcccattacttggtatatacccaaatgactataaatcatgctgctgtaaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaagcaaacaccgcatattctccctcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtatctaacctgcacaatgtgcacatgtaccctaaaacttaaagtgtaataaaaaaaaaaaaaagcactcacctacatattctaaccaagtaggattaatgtttaattctgcaaatggcacgactttcattaaagtccttgcatgttggtggttttggcctcttcacactcctgtctctttttttcttactttttctctctctcatatttttttatctaaccattttggaggattataaatatatgctgattagaaatctatttttatatgaatgtgtcattcagagctagaaatatataacttataatctgagagtatactgatctttagaaagtgatatatcatctactttgaaaagtaccaaagaccattggatgccacaaaaaaaggtatatgttcattatatgcttgtgaaagacaaaagtaattatttaaaacatttttctactactttgaaattctgcaagctgattaacactggcttttgtaaagaggttaggaaaatttatatcatttccaagtttatttaagagggtctggtttatggcatatgcaacatttttttcccctagcatatagtatattttcagccagtcagtgactttcccttcagcttttctctgattgatactagatactttcttcacataactaaaacagatggttctaatgtgcttgcagcttctgacttaacattttgctccattgtagtaaaaatagtatttgccttgttatgtaatatttagaggggaaataatctgaaacattaccaaacacaaaaataaaagttgaacgattggcacttttaaatagttgatacactttgatttggtgttgcaaataataatgcaaccttgaattcatttgaaaatactcatcagtacattcccagagctcatgtggccattttagattatcagtatacattttacaacatgactaaaccattttaaaactctttctgaatgaagaatattgtaaaatgtatatctgagatactttattatcgaaaagtagcttaaatcacactaaattttgtgaagatgtagaaaacaaaattacattagacatagtattaaataaaagcaataaaagtttttaaggattttaatgctgtactgagctgtatatacataaaaataatttcacaacagtctttggtaatggatatgagcagagatgtatacatcctaccctgtagaccgcttggtttgtgattgacccggttccttcccatcttgatttactgttatttagtatctcatgccaggaaaccttaagtttgatgatagctcacaaataggatagcatatctatgagtaatttagtatagcatacttatgagtaatttagaatggaatattattctcaagcttccacatccacttttctttgctttttgtatccaatttgaaccacagtcttttattttatgacccccatcccatattcccaaaagctgcctgtgtgtaacctttaaggcttaaaggtagtctaaccatttaaaggtagtctaaggcttaaaggtagtctaactgtgtagtctaactgttctaacattgtttctagaaacattggttctagaataataactagcattatacctcacactcagccgtccacctctgagtttctattctggacaccccgcgcagaactgaataaacattaataacaccttgatcttatctcagctgctttgctatatgtaaataaggacagttttgcttttcctttaccaatccttattctttttctatttgtctcttgtcttattgcactgaccacacctttagtatagcgttcaaataaagctatcatagcaaacatccttttcttgctcctgatttgaaaggaaatgcatctaatgattaaccactaagaaagctgcatcttcttcacatcagcaacacaattgtaggcctttttttttaaaatagtgttttctatattaaatataatataatatattatatttaattatattaattaaatataattttagattatattaattaaatataattaattaaaataattttacatttgcagagtactttgacatatattacctcatttatttttgacaattcctcatcaatggagcctacactggagatataatatgctgtgctcttaaattgagcagaaattaagagaatttcagtgacaataagtttagaaatcaactctgttttcaaggatacaacaatctgactttgtagttgaaaagttttctgtggctctggtgaaaggagaaatgatttgaactgtcacattagagggaagactgttaaaaactcattgtcatgttttaatggccctgtcaattccagttttgcctcttaatatctttcttcagagtaggaggaaatcgaaatgattcaaagcttcttctgttgtcattaatttgtatgggggaagttgagctgaaagtattagtagaattcataggtttctgcagatgaagaggtttgcaaattaatagatttctgcaaatgaaagtttctgaaaatttggttcttccctctttctctccctgtctttcctattggttaggtcaataacatattttaaaagaatgtccatgagacagggaagaatatactaccaccccaaatatattttgcatttttattatttaacatgagatgtaaaaatctgctataagttgggagacaggttggtatagtttaaagcactgggcatcaggaaatctggttctggttttgattctttcactaagtagatctaagaatgagggaaatttgtaagggtgtggtgtcataagattgttccggttccaatgttctgtgattctcagtgttgttcaaattttttttcctgacatataacacataaatgcagaatttagcagttaaatcctgcgtcagttattagctctggctctcaatactaaagatgtaaaagggtcttctccttaaatctgaagattttacctggccttctgttacagtgttcggtttgttacatcaaatggagtgcattagtagtttagttttagatatacatctctttataagacctaagaccagttagtcatagtaatcaggtaaaatattattcagaacaatatgatttaaagtgatatttgatgtacaatttaatttgtgcatattgctttttctcattttttgtttggtgtaaatgctctctgaaaaaagaggatactgctattaacttaatgggagagattgaatatattatacagagattaatacctttgtttatctggattaataatttgatagcataatggtttataggaggacaaaaataaacttaacccttattttaccaaatatttttatcaaaaagattggatttattataaaaactagagcagttaaagtattgttttgatactaatgatgagttatctgctgcataattttggagaatgcaaataatcactgactcttaaaatgacatgtaatcatacattatttatattgctttctagacatagggggtatttgtgattatgaggatgaattatttttcacttagttgatattattttcaatacaattttctagccatttgactacttttaattcaactctttcttgatgtgtctgaatgagccctagttgaaatgtcagcatttactgaacaaattatagtcctctctcctctcctctccccaccctctcccctcctctcctctcctctcctttctctgtctctctctcttttctttttctctctctctctctcctctccccctctccccctctccccttcttcccctctctccctctccccctctcctctcctcttctctcctcttctcttcggggtcttgttctgttgcccaggctggggtgcagtggtgcaatcttggttcattgcaacttcagcatcccaggctcaagcaatcctcccacctcacccttccaagtagctgggattacaggcacgcaccaccactctgggctaattttggtctttttagtagagacagggtttcactatgtcaatcaggctgctcttgaatccctgaattcggacaattcgcctgcctcggtctctcagagtgttgggattacaggcgtgagccactgtgcccagctgctcagccccatattctttacatagcactgactaagcgctcctcctacttctgtggaactccttccactcatatctttggaatcggatggattccagagtaggagccatttgttgtgtgatgataggtgttcctggatcagatggatccaaaaggatttagtttggagcagtgcttttgaggaatcaggaagcacttggacaatcaagcagatttttctattctctgtgtatctcctatctctcccttgatttcctagtaagctgctttgaattatggcaaccttctaatgcagatccaaatatgggctgccaagaaatcctttgaacccctggggccacctgctttgccagcacattctaatgagcagtgaaataagtgattttaacagacacttagagacagcagcatattctccaagcaaattaacttccttacggaacagtgaattctttcaggtcttataagaaagacttggagaaccatcctactgtggatcaacataatcataacagtaatagtaaaaatttgtaaagccctgtggttttgaaagcattttttgcatgtcgttatttgatccccacagttactccattagaataaagaaggtaccaaatttgcatactgataaatattaatctcttagagtcagagtttgatttagtttttttcctttttaaatcttttcatattattcattttagatgaattgtccaattctgctttattgccaagaacaattatgtttatatctatttagaacactaaatatatgcacacacatataaataaatcttagcaacccaaagttgaaaaacttcacttatataggggtgtgtgtgtgtgtgtgtgtgtgtgtatgtatgtatgtatgtatgtatgtttggggttaatttcatacttaccctttactcacaagatttcaaaatcatttattgtatttgttagtatcattatagtcatacaaaagggttattttgggggtttttttggtcctctttaatatacgtattagtaggatagactttatgagtcacagctcaactgagaagatataatgtgattttaaaatatagatttttcttctgagactgtgaaaggtcagggtttgtgaagctagagtcctggaaagagaatgagtgatttataatactcttcagagtgcctaaagagatttttaaatttcttcatggtcttagtccctaagagctttccttgaaatagctttttagtttctgtgaagcctgtagtctttcaactgaaagcctgattgaagccatcacactcttactaggatacagaagagaaagggtgggattttgaggatgataaaaatggataaacttagaataaagggattggtgtgacgcctaagggtttgattatagtcactctttttaaaaaacactactctttcaggaggaaaaggaaagtaagattactatctaaaatacaaaagaaaaaaaaaactaacctgcaaagatgaaacacagggaaccttcaaataaaatgctctttatggtgcctcctgaattatgattttttttcatatttgagatctatttctatactatattcaaatggcttaaatatcctagacaaaaacttgtagttgttcttgaatggattattttatgttacagaattatgaggatttatctcctggttactaattgttatgcagttgacaatatttttataagtgaagcctcctcttcccgcacctttaaagcctcttctttaatcagaacccttcgtcctttctccctagaaataatgtgaatctgaattgccctactcctccttcccatctgtccaaatcttagttgtccatctcccttataaaggtagtcctacgcactatacccacagtgatttatagattaaaacaaatctggagatcaaatgtataacatgagcactatagttaataaaattgtattgttttagggatttttgttaaataagaagattttagatgctcttgttacacaaacaaaaaaaagtacgtgagatgatagatatgttactctgcttcactgtagtaaccattttactataaatatatatcacataacgttgtgttgtaaaccacaaatatacacaataaaatttatttttaaaatattttataaaatttagattatgtattatatatatcttttcaattatactttaagttctgggatatgtgtgcagagcatgcaggtttgtttcataggtatagatgtgccatggttgtttgtagcacccaatcaacgtgtcatctacattaggtatttctcctaatgctatccctcccctagccccccaccccccaacaggccccagtgtgtgatgttcccctccctgtgcccatatgttctcattgtgcaactcccacttatgaatgagaacatgtggtgtttggtttgcagagaatgatggtttccagcttcatccatgtccctgcaaaggacatgaactcattcttttttatggctgcatagtattccatggtgtatatgtgccacattttctttatccagtctatcattgatgggcatttgggttggtccaagtttttgctattgtgaatagtgctgcaataaacatatgtatgcatgtgtctttatagtagaatgatttataatcctttgggtacatatccagtaatggggtggctgggtcaaatggtatttctagttctagatccttgaggaatcttccacaatggttgaactaatttacactctcaccaacagtgtaaaagtgttcctgtttctccacatcctctccagcatctgttgtttcctgactttttaatgatcgccattctaactggtgtgagatggtatctcattgtggttttgatatgcatttctctagtgaccaattataatgagctttttttcatatgtttgttggccacatacatatcttcctttaagaagtgtctgttcatatcctttgcccactttttgatggggttgtttgtttttttcttgtaaatttgtttaattaagttcattgtagattctggatattagcccttggtcagatggatagattgcaaaaattttctcccattctgtaggttacctgttcactgatgataagtttcttttgctgtgcagaagctctttcatttaattagatcccattcatcaattttagcttttgttgctattgcttttggtgttttagttatgaagtatttgcccatgcctatgtcctgaatggtattgcctaggttttcttctaggatttttatggttttaggtcttatgtttaagtctttaatccatcttgagttaatttttgtataagatttaagtaaggggtctagtttcagttttctgcatatggctagccagttttcccaacaccatttattaaataggaatactttccccattgctagtttttgtcaggtttgtcaaatatcagatgtttgtagatgtgtggtgttatttctgaggcctctgttctgttccattggtctatatatctgttttgataccagtaccatgctgttttcgttactgtagccttgtattatagtttgaaatcaagtagcatgatgcctccagatttgttctatttgcttaggattgtcttggctatacaggctttcttggttccacatgagaaatttaaagtagttttttctaattctgtgaagagtgtcagtggtagcttgatggggatagcattgaatctaaagattgctttgggcagtatgaccatttttgcaatattaattctttctatccatgagcatggaatgtttttccatttgtttgtgtcctctcttatttccttgagcagtggtttgtagttctccttgaaaagggcctccacatcccttgtaaattgtattcctaggtattttattctctttgtagcaattgtgaatgggagtttactcatgatttggctgtttgtctattattggtgtataggaatgcttgtgatttttgcacattgattttgtatcctgagactttgctgaaggtgcttagcagcttaaggagactttgggctgagacagtggggttttctaaatatataatcatgtcatctgcaaacagagaaaatttgacttcctcttttcctatttgaataccctttatttctttctcttgcctgatttccctggccagaacttccaatattgtgttgaataggagtggtgagagagggcatccttgtcttgtgccggttttcaaagggagtgcttccagcttttgcccattcagtatgatattggctgtgggtctgtcataaatagctcttattattttgagatatgctccaccaatacctagtttattgagagtttttagcatgaaggagtgttgaattttatcgaagccctttccgcatctattgagataatcatgtggtttttgtcattggttctgtttatgtgttggattacattgattgatttgcatatgttgaacaagccttgcatcccagggaagaagccgagttgatcttggtggataagctttttcatttgctactgggttcagtttgccaatattttattgaggattttcgcattgatgttcatcgggggtattggcctgaaattttctttttttgttgtgtctctgccaggttttgggatcaggatggtgctggcctcataaaatgagttagggaggagtccctctttttctatttttgaaatagtttcagaaggaatggtactagctcctctttgtacctctggtagaattcaactgtgactccatctggtcctgggctttatttggttggtaggctattaattactgccttagtttcagaacttgttattggtctattcagggactcgacttcttcctggtttagtcttgggagggtgtatgtattcaggaattcatccatttcttctagattttctagtttatttgtgtaaaggtgtttatagtattctctgatagtttgtatttctgtggaatcagtggtgatatcccctttatcattttttattgtgtctatttgattcttctctcttttcttttttattaatctgggtaatgttctatctattttgtaaatcttttcaaaaaaccacctcctggattcattgagttttttttgaagggtttttcatgtctatctccttcagttctgctctgatattagttatttcttgtcttctgctagtttttgaatgtgtttgctcttgcttccctagttcttttaattgtgatgttagggtgtcaattattgatctttctcattttctgatgtgggggtttagtgctataaatttttctctaaacacgctttaactgtgtcccagagattctgatacattgtgtctttgttctcattggtttcaaagaacttatttatttccaccttaattttgttatttacccagtaaacattccacatgaagttattcagtttccatgtagttgtgcaattttgagtgagtttcttaatcctgagttctaatttgatgacagtgtcgtctgacagactgttatgatttccattcttttgcatttgctgaggagtgttttacttccaattttgtggtcaattttagaataagtgcgatgtggtgctcagaaaaatgtatattctgttgatttggggtggagaattctgtagatatctattaggtccgcttggtctagagctgagttcaagtcctgaatatccttgttaattttctgtcttgttgatctgtctgatattgacagtggggtgttaaagtctcccactattattgtatgggagtctaagtctctttgtaggtctctaagaacttgtgttatgaatctgggtgctcctatgttgggtgcatatatatttaggatagttagctcttcttgttgaattgatccctttaccattatgtaatgcccatctttgacttttttgatctttgttggtttaaagtctgttttatcagagactaggattgccacccctgcttttttttgctttccatttgcttggtaaatattcccccatctctttattttgagcctgtctgtgtctttgcacatgagatgggtcttctgaatatagtacactgataggtcttgactctttatccaatttgccagtctgtgtcttttaattcgggcatttagcctgtttacatttaaggttaatattgttacgtgtgaatttgatcctgtcgttatgatgctagctggttcttttgcccattagttaatgcagcattttcatagtgttgatggtctttacaatttggtatgtttttgcagtggctggtaccagtttttcctctccatatttagtgcttccttcaggagctcttttagggcaggtctggtggtgacaaaatccctcggcgatggcttgtctgtaaaggattttatttctcctttgcttataaatcttagtttggctggatatgaaattctggttgaaaattcttttctttaagaatgttgaatattggcccccactctcttctggcttgtagggtttcctcagagagatccgctgttagtctgatgtgcttccctttgtgggtaacccgacctttcactcatgatttggctctctgtttgtctgttattggtgtataagaatgcttgtgatttttgcacattgattttgtatcctgagactttgctgaaggtgcttattagcttaatgagattttgggctgagacaatgggtttttctagatatgcaatgatgtcatctgcaaacggacaatttgacttcctcttttcctaactgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtgtgtcatagatagctcttatcattttgagatacgtcccatcaatacctaatttattgagagtttttagcatgaagtgttgttgaattttgtcaaaggccttttctgcatctattgagataatcatgtggtttttatctttggttctgtttatatgctggattacatttattgatttacgtatattgaaccagccttgcatcccagggatggagcccacttgatcatggtggataagctttttgatgtgccacttgattcggtttgccagtattttattcaggatttttgcatcagtgttcaccaaggatattggtctaaaattctcttttttggttgtgtctctgcccggctttggtatcaggatgatgctggcctcataaaatgagttagggaggattccgtctttttctattgattggaatagtttcagaaggaacggtaccagttcctccttgtacctctggtagaattcagctgtgaatccatctggtcctggactctttttgattggtaagctattgattattgccacaatttcagagcctgttattggtctattcagagattcaacttcttcctggtttagtcttgggagggtgtacgtgtcgaggaatttatccatttcttctagattttctagtttatttgtgtagaggtatttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttgtgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccggagattctggtatgttgtgtctttgttctcgttggtttcaaagaacatctttatttctgccttcatttcgttatgtacccagcagtcattcaggagcaggtttttcagtttccatgtagttgagtgattttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtgaagagttctgttgatgtctattaggtctgcttggtgcagagctcagttcaattcccaggtatccttgttaactttctgtctcgttgatctgtctaatgttgacagtggggtgttaaagtctcccattattattgtgtgggagtctaagtctcttggtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttctgttttgagcctatgtgtgtctctgcaggtgagatgcgtttcttgaatacagcacactgataggtcttgactctttatccaatttgcaagtctgtgtcttttaattggagcatttattccatttacatttaaagttaatattgttatgtgtgaatttgatcctgtcattatgatgttaggtggttattttgctcgttagttgatgcagttttttcctagactcgatggtctttacaatttggcatggttttgcagtggctggtaccggttgttcctttccatgtttagcgcttccttcaggagctcttttaaggcaggcctggtggtgacaaaatctctcagcatttgtttgtctgtaaagtattttatttctccttcacgtatgaagcttagtttggctggatatgaaattctgggttaaaaattcttttctttaagaatgttgaatatcggcccccactctcttctagcttgtagactttctgccgagagatccactgttagtctgttgggcttccctttgtgggtatccctacctttctctctggctgcccttaacattttttccttcatttccactgtggtcattctgacaattatgtgtcttggagctccatccagttttgttcccttgctggcaaggagttgtgatcctttggaggagaagaggtgttctggtttttggaattttcagcctttttccgctggtttttcctcatcttcatggatttatctatctgtggtctttgatgttggtaacctttggatggcgtttttgcgtggatgtcctttttgttgatgttgatgctgttcctttctgtttgttagttttcctctaacaggcccctctgctacaggtctgctggagtttgctggaggtccattccagaccttgtttgcctgcgtatcaccagcataggcttcagaacagcaagattgcttcctgttccttcctctggaggctttgtcctagagaggcactcgccagatgccagccggagctctcctatatgagatgtctgtcgacccctgctgggaggtgtccccagtcaggaggcacaggggtctggaacccacttgaggtggcagtctgtcccttagcagaactcaagcacagtgatgagagatctgctgctctctttacagccggcaggcaggagtgtttaagtctgctgaaggtgtgcccacagcctccccttcccccaggtgctctgtcccagggagatgggagttttatctctaaggtcctgactggggctgctgcctttctttcagagaagccctgcctagagaggaggaatctagagaggctgtctggctacagtatcttttctgagctggggtgggctctgcccagttcgaacttcccagaggctttgtttacactgtgaggggaaaaccgcctactccagcctcagtaatggtggacgcccctcccccaaccaagctggagtaacccagggcaacttcagactgctatgctggcagtgagaatttcaagacagcagatcttagcttgctgggctccatgggggtgggatctgctgagctagaccacttggctccctggcttcagccccctttccaggggagtgtatggttctggcattccaggtgccactggggtattaaaaaaaactcctgcagctagcttggtgtctgctcaaatggccacccagttttgtgcttgaaacccagggccttggtggtgtaggcatccgagggaatgtcctggtctgtgggttgcaaagaccatgggaaaagtgtcatatctgggccagattgcattgttcctcatggcttcccttggctaggggagggagttccctgaccccttcacttcccttgtgaggtgacaccccaccctgcttcaggttgcccccgtacccactgtctaaccagtctcaatgagatgagctggtacctgtgttggaaacgcagaaatcacccgccttctgcgttgatctagctgggagctgcagactggagctgtttctatttgttcatcttgccagccctatgtatcatattttgaacaatatctgattactttcatttaaatgttttctgcattgtgttcagtgtttgagggaagaagctatctcatattttctttgtcctagagagccaagtgtagtactagtaacattgtgtcaatataattagctctgtgaatttgacttgatgaaaatgagtatgttagttcagatcctctgagaagcctgtcaccaagacaggattaagtgtgtaagaaatgtattatgggaaatggttgtaagagaaaatagggaaggagctgggagagtctcggagagccattggatcacaacccaagtctgactccaagggaagaagaaaggaaagttaggtgcaaatattgtagatgtagtttgtttctaaggaacatttgaaaagaccaatggtgagtcgtcagccaaagttactaattaggtcccatttcctcagaagctggcccaccttaatattcctgctgtgctcagtcacagctcctgggaacctcatgggaactatggccttggtacaaacgcaggaatgattttacagcatagcagtcagttgggccctcgttcaattacagcctcttctgttggagacctaatgtgtatttttatggccagaatacagatattttagatgaaaatttaatgcatataaaccctaaaagagcattctatttctatcacttacttcttctgtgaagtacttttattcataaaaacttttcaggctacattccttagggcaaggctatagcttttcttcattttgtatagttcatgagtggtgtcctgtattagaccctatttaaaaatcaaaagtccaagaatgtaaactaaacactctgagtaatttaccatattcagttagtagtttacttgtaatgaggacattacaatttttttaaaaaaaatatggtgttctagttgttttacatttctgtgtctttaaaaaaagtatgtgaattcacttttaaattgttgccaaagggctttttttctttgcaatgttacataaaaggaaacttacatataggaattttgccagctatgttagataagaaaattgctttgtgagtgtatatttgtgagtacatctagttttctacatttattgtctccagtgtttatttcacatcactgaatctatttttagagcttatgttgatactctcctttttccccagcatataggacaaatgtaataaccttttttaaactcattttttatgattagattcaacagagaaaatgatactgttaaatttatatatacatatatttccagatttctgtgtatttttaacaacctcaaactcataaaagctacaagttcagaattttgttttcctaaactgtttgagagtgatttgctaacataatgcctcatcacccctttaggatgtttttcttataaacaagggtattcttctacataatcataatgcaacatccaaatcagtactacctaatctatagacatcattcagtttttactaatcatccaaatgttcttgatagattagaaaaaggatccagttcagaatctcttatttcattaagttgtcatgtctgtaattcccttcaacctggaaccatttcttactctttcattcactttcttgaccttgatgctttcgaagattacaggccatttttttgaatatccctcaatttgggcatgtctaatgttttgtcatggttagattcaggttatacatctttggcaggaacaacacggaaagaataatctgttcttatttcttccactcaggtaatatgtatgcagtttcattttttcccattattggtgatgattagtgtgatcacattaataaggtgtgtctaccaggctactccacgatgaaattactcttttccccattgtaattaataggtattttgtgtagagatacttcataactatttaattgccccatttctcatcagactttcaatttattagtttatttatatgttatatcaatatggactcatgaattctcattttattcaatggattgtatttccttgctatcattatttgttttggtgttcaaattgtccccatattgtccagtgggaagacttcaagctggtttctgtgtccttttaatatattccatcatcctttgagccttgcctttctttatggttcagaaagatgttccaggcttatgtctctgtcccagctctagaattagatctttctccaaagagccttgtttcctttagtcaaaatattaagaaaccaagatctgcttggtaaatatgtttattgttatagagttgtcattgcttacaagtcatctcattgtatagaactaaggaatctatatgtatatacatatatgcatgtgtgtgtgcatacaaacatgtatttatgcccatttttttttattaatacataattcacataacattcacccctttaaagtgtacaattcaggctgggcatagtggcttacgcctgtaatcccagcactttgggaggccacggcgggtggatgacctgaggtcaggagttcgagaccagcctgttccaacatggtgaaactccgtctctactaaaaatacaaaaattatccaggcatagtggtgggtgcctgtaatcccagctatttggaaggctgaggcaggagaatcacttaaacctgggaggcagaggttgcagagagccgagatcatgccactgccctccagcctgggcaacagagtgagactccttctcaataaatagaatagaatagaataaatgtacaattcattgagttttagaatttacagagttgtgcaaccattactactgtttaatttcagaacatttccatcagtccaaaaagaaaccttatacccattagaaatcaatcaccctttattacccctgccctcagcccttggcaatcattaacctatattctgtttttatggatttgtctggtgatattattgtttgttgtggcagttgtttgattggttactgacttttgtgaactaattctgtagagtttgtattctttgtcatgtctgtccactgaaatctctgcttggtggtcagctaatgattgaatagacatgtccttaaatttctggaaccagtaagtctaccagtctttgccaaggagttctgtgtgtgtttgaacatgcgtttgtattactcaaccattcatttgaaaactctgtcttgctttcacctcctgcttgtatagaacttcaaagtcagccaaaggcaagagtgtagagccttctcaggactttcctaatgcacaaagccttgagcatgtacatagccctgcacatgagcattgctctctaagttctcagaaatatatctgagtctttcaaagcctttatggatgtctcattccccagcatttccttttaagctttttgattagtgtatttgccacaattttttattgtgtatagttagggttacatagtggtattttgatacatacaatgtaaaatactcagatcaaggtaattagcatttccatctgaaatatttatcatttctttgtgttgagaatattcaatatcttccttccagctatttgaaactattattgttagctatagtcatcctacagtgctatagaacactagaacttatttctcccatttagctgtaattttgtacactttaacaaatctttctctccacccccttctctctacccttccaagcttctagtatcctctattctacttctttcttctatgagatcaacttttttagcttctgcatatgaatgagaacatgcagtatttaactttctgttcctggcttattttatttaacataatgtcctcctttttcatgttgccataaatgacaggatttcattcttttttgtggcttaaagtattccatttggtatatataccacattttctttatccattcatctgttgttggacacttgggttgatttcttatcttggctattgtaaatgctgcagtgaataaaggagtgcagatatcccttcaacatcttgatttccttttctttggataaattcccagtagtgggattgctggatcatatggtagttctatttgtagtttttttaggaaactccatactgcttgtgtagtcgtttgccccaatttgtatctaccttctcagacagccacaaaattaaacagttgcctgtaactgcttttgacaaatgcccccaggaaaaaggcttttcatattgggtgagtcttgcaagtggagtgttccagggaaccaccattcaggtcaaataatgataattctctgggaataaggctttgcatttcactgtctctgatgtctgccagactgcttgtcattgcaaatgcaagctgttagttttcaaggttatcatggagctggagggtgggagatgggaccaaagcaagttaaaaacgccacaaagctccctgttcttaccaagattcagttatttttctggaataattaccctccaggcagctgcaggtatttggtcaatttctagagttctgaaaaagttgattctgattatttttgtgatatttcctgctattgtggaggagctaatttttggtgattcttgctctgcctttttgctgatgtcactgcccatatttttttctatatataaccatttgtgttgaaaactagggattcatagcagtatttccaattccaatccaacagcagaagattaatctagtgttctcccttcctatatttgtaactaacttctctgacagggagaaatgtagctcccattatccttaatatatttatctttttgagcagtatctctctatatatccaatctctcattactgctgccagttctcttgtgtgcaaataccctccttaccatagtaagctctaacaccctgtgccaggatgtcaccctaggtgaactcctccttatcttgtcatacattgattctccattcttggccacccacatccccacctgggtgggcttgtcattttttttagggtctgacactccacaccaggccacccctgtgtgaatgttctatcttgctctgcctaatggtttcaggaagggaacaggaagcttaattactttttaaagatgaattttattaccctttccgttcttcatgagttttacttatgagagtttgcaaagatatgttagacctaaatcagtatctctggcttcaagaatggaaggaaggtacacaaaactggtaaacaaattgatttttgttttaggcacctgtaaagaaaaactgattattttcaagaaggaagtgaatctaagaatccataagaattttagcaatgagtaagaccctatccaggcagctccatattcattcctgacgataaatcaaatgggttatttgaaagaaagacatagtaattttccttgacatcagccagtcattactgccatttagtcagcacatccctgtgtgctaggcattgtgtttaatccttaagtttgtatggtggtttctatttttacctgtgtgttaccgatgaagatacctgctttactttaccaaaaaaaaaaaaaaaaaatcctcaaaagattgatctatagttgctgttactgattcctctcttcttactttttattaaacccttttcatttaggatttcacctataccacttttctgaaaatggtgtggtcagaacacaaatgtattccatatcataactctaattattaaatctcagtcttcttcctccagacctgtcagcaccatcgtgcactgttgatcactcccttgttcttcaagcactttcttcacttggcttctactactttttttcttgcagtcacttttgctcatgctttctctttttctcaacttcttcatttcagtctttggacatctgttttctatctacatttattgcattggtagcctcattcagtctcatggctttaaataccatgcattcattgataatttccaaatttatatatctgaccccaaccaattccttgtacttcaaacttatatattcaattgcctatttgatttctcctctagagctctaacagatatctcaaatacagcctatgtaaaacagaatgtttgatctttctcacaaaagctgctcacccgtagtttttttttcccatctcagctaacagtaactccattctttcaattcttcagtctacaaacattgaatcatccttgctgctagtttcttcctcttacactacatgttgagtaggtaatacctgttgtctaccaccagaacagcaatcccaggatattaacccacaacacggtttgcaggtattagggttgccaagaaaaacatgactcacagaggcactggatggaacaacactgtactcacatacagaagagacagaacaacagtatcagtaataagtgtcagtggatcttgtctcacagccatggcagggaatgatctgtatacaccccttttgtgctgcaagtgaaggaccttgttcgctctccaccagggacagaaatagcagtggggtaagccaggcgccatatgacacacacttaagcagaacaaagaagtataaatcaaactcagaagagggaaagaaattcctaaacaaggtaataataagcccagcacagactgtgagggctcctgttcttcatgtaagaaactattccaggcccaaggcatattcttttgcaaccatggaatggtcaacaggttgcacacgattcccttgcccagcaccacacaaccagttttttaggaaatcttactgactccaccttcaaaacatagccagaatcttattatttcttgccacttcactgtaactaccctggtctaaactaacatatctcctacctggtcaccttgcttccagtgggtttctttttcatttagtattaaagcctacattcttacggtgatttaccaggctgtaaactccacatatgactattctctctatcatgcattctgtcccagccacactgccagccttgctcacacttcagagcccttgccctggctgttctctctgcctggaacacttatccaagaaatctacatggcttgttttttaacctctctgaatcccttgctcaagtgttactttcttaatatggcctgccttaaccactcttttaaattggaacctcttcttagctcagcattcctcagcccttttctctgctttgtcaccgttgcacttattgccttcaaagatactatatacattatttatttattatggccattgtctatcatcttccactagaaaataagctatatgagagcaattttttgtccattttattcattgcttaccctagtcttccacatgatagataataaatatgtgttgcctcagggaaagaaatgaaagtttagggaagttaagtgattctagtaaatggcagagctggaatttgagatgtttggcattcagaactactattagaaaacttttaagtaaattttttaacaaacagtgattttaaagtactatcaactagttactgttctgggctgtatattaaggggccaattttgtgatctaggctaatctaagaacctcataaccatattgattttataggaaaatacatgctgagtttgaaagaaaaactagtaaagaacttttagaaaatgatctgttcatcactgtggactacttgtactgaatactaaaggagtaagaaaacatgtagttgataatgattctaaacgcttgaggaaaaaagaacatgaggaatattgggtactgaaaaattttaataaaaatatttatttagagtcaattttttaaatgtaaaattgtagtctgggaatatacctacattaatattttactgacttaatttttccaatgcttgtgggccttcctaaaactaataattcattattataatcaatagcaatttcagttttattaattaaaaatattttgttatgatttttataggctaatgcagcaataaactcttttggtttagttttggatatggctgtgtgtgtgtgtctagtaagatataccattatgcatcctgtaacgacatttcagtcaacaatggactgcatttacaatggtggtcccataagattataatggagctgaaaaactcctatcacccagtgacatcatagcatcataacattatagcgcaacacattactcacctatttgtgttgatgctggtataaaacctactgtgctgccaggtgtataaaggtatatagcatatacaattatgtacagtaaataacacttgataaggatagtaaacaactatattactagtttatgtgtttactatactgtgctttttaattattattttaggatgtatttcttctacttataaaataaccataaaacagcctgaggtaggtcgttcaggaggtatccagaagaaggcttttcttttctttttttttttttttttttgagttggagtctggctctgtcgcccaggctgtagtgcaatgtcgcagtctctgctcactgcaacctccgcctcctgggttcatgcaattttcctgcctcaacctcccaagtagctgggattacagatgtgtaccaccacgcccaactaatttttgtatttgtagtagagacggggtttcaccatgttagtcaggctgatcttgaactcctgacctcaagtgatccatccgccttggcctcccaaaatgctgggattacaggcgtgagccaccgcgcctggcctggttgtttgtttgtttgtttgtttgtttttgaaacagagtcgcactctgtcgcccaggctggagtgcagtggcgcaatctcggctcactgcaaaactccacctcccaggctcaagtgattatcttgcctcagcctcccaccaccacacctggctaatttttgtatttttagtagagatggggtttcaccatgttggccaggctggtctcgaactcctgacctcaaatgatctgcctgccttggcctcccaaagtgctgggattacaggcattagccactgtgcccggccaagaaggcatttttaccactggagataacatctccatgcatatttttgtccctgaagaccttcagtgggacaagatgtgaaggtggaagatggtgatattgatgattccgaccctgtataggcctagcctaatgtgggtgtttgtgtcttcattttaaataaaacagcttaaaaagtaaaaacaaataaatgaaaaaattttaagtagaaaaatgttatagaacaaggatataaagaaagaaaatattaaaatatttctgtatagctgtacaatgtagttttaagcaaagtattattacaaaagttaacaggttttaaaaattaaaaataaagttacagtaagctaagattttgtcattgaagaaaaatattttaaaataaatttattgtagcctaagcgtacagtatttataaaggctgcattagtgtacagtaatgttccagaccttcacattcacccacctctcactcactgactcacccagagcaacttccagtcctgccagctgcattctcagtaagtgccctatacaggtgtgccatttttaatctttcataccacatttttactgtaccgtttctatgtttagacactcaaataattatcatactgttgtataaaactatagcacatacatggtttcttgtagcagcccagtaaagaattgcctactattcagtccataagactaaatagtatatactgtaacatgctgtacaagtttgtagctgagaagcaacgagctataccatatagcctacatgtgtaataagctgtatcacctgagtttatgtaagtactctctatgatgtttgcacaacaacaaaattgcctaatgacatgtttcttagaacgtattcctgtcgttaaggaaggggaatgcctgtgcatatatgtatatatactcacatacacacacgtggttgatcctcattatttacagattctgtatttgcaaattcacctacttgcttaaatttatttgtaaccacaaaatcaatattctcaatacttttatggttattcactgatatgtgaatatgcagtgtcaaaaaatttgagtcacctgatgcacacatttcaagttcaggtggaacaagttgatgctctgccttcttatttcatctctcatactgtaaacaagtattctcctgctatatacttattgtcatgtgttttgcatttttgtgcttcttgatgatttttctgtttgaaatgttccctaggtgcagtgctgaaatgctgtctagtgtttctagggactcagaggctgtgatgtgccttgcaaaaaaaatacacattacgtaagcttcattgaggcatgaattacagtaatgttggccatgagttcaatattaatgaaacaacaatatatattaaataaggtatctttaaacagaaatacacttaaaacaactttgtgtattgattagttgctgaaaatgttgtgaccaggggttctcaggagcctagccgtctattatcccctaggtgtagtaattcagtgtttgcttattcagtgttggggcacctttatagaacataagtattaagaatgatgacaattgactatatatatttgtacacagtttgcacaatttgtgtactttgtacaattatccccaagaagaatagttgtcatttgttaactacttcactatttgaatcttacattaacctccaatgaagccttgagatgtgtcttcaatatatttatattctggagaaatcacccaaattgaaatcttaacacaaaccattgaatggatgattactagtgagtaattttcaaaatattttaactaattttttaaattgtgtaatatacattcaaatgaataaaaataatgtattatttgaaaaagtaacagaagtaacatccttgaacctacaacttaggaaatattaccaatattttttaataccttccaggtgctcctcttagatctagtctttccctaccagagtaaaacactctagtgaattttgtgattatggttctttctctctctctctctttctttctttctttctgctttctttttttttttttttttttttgacagagttttcactcttgttgcccaggctggagtgcaatggtgtgatcttggctcaccgcaacctctgcctcccgggttcaagcgtttctcctgcctcagcctcccaagtagctgggattacaggcatgtgccaccacacctggctaattttgtatttttagtagagacagggtttctccatgttggtcaggctggtctcaacctcccgacctcaggtgatccgttcgcctcagcttcccaaagtgctgggattacaggcatgagccactgcccagccgacgatggttatttctctacattctttaaagtcatttttctgattggtttatgaatagtcatgaaatgcagattaaaaagaagaattggcattttatagttaggttttatagtcactcacctgaatgtcatgagatccagagaccaaatagtgacagtggctaagtgcctgggctctggagctggactgccagagtttgaattctagctctgctgcattctaactggaacaaattatttaacctaccttgaataaattatttaattttttagtgccttagtctgcctgcctgcctgcctgccttccttccttccttcttttcctttccttcttccttttcttttcctttcctttctttctttcttttcttttcctttcttgtctgcctcgcctcgccccgccccgccccgccccgcctcgccttgcctctttcctttcctttctttcctcttgctctgttgcccatgctggagtgcagtggcatgatctcagctcaccgtaacctctgcctcctggattcaagcaattctcctgccttagcctcccaagtagctgggattataggcgtgcaccactgtgcccagctaattttgtatttttagtagagacggagttttaccatgttggccatgtttggccaggctggtcttgaactcctgacctcaggtgatccgcctgccttggcctcccaaagtgctgggattactggcgtgagccactgtgcccagccttagcttctttatctataaaattgaggataataagagtacttactcccagaggggtgttacaattattaaataaattaatatatgtaaataaatggaacagtagagtagtagtaactaataaataaatgttagttatttaacaggtagagaaattaatgcaaagaattctttgaaagccacttgtattcttgcgtactatattaagtaatctttctttaaatgtttctgtaatttcttttaaacaactagtatcatgatttttgtcactctgtgacctctttttattcagctaattgtgggactactgaaaattaggctttccttggtatctctttgtgtctcccagcttatgtgagaacagatctcttcttagtttgcaaataaatttattccacatattttttacttggttgttcccctgacatactcatttaagggctactgctgccaaaaatgataatccaaaggctaatttatgtgttttagcctcatgttggtagaagttctttgtaggttatagatgaaacagtttgtctaataaatggcaaattgctattacgtaaatatcaagctcctgtttaagtaaaaaggaggtctgtgttagtgttgtctcttctcagcgttgctattcaatctgtactgaaaaaatcgtgacagttcaatatttacattagaaattggagaaacatgtgtcagagttaaaactgatgaactttgccactgtttatcaatagcaagtaaactggcaaatatgtcagtatgttagcagtaccaagaagctaaatgggaatattttagaagtttgacccattgttgcactctcacatggcagcctctttatcttgttagagaacatcctttgatttcccttttcattctttctgtgagtctgagctttcctttttacctataaatgtgcttatcttatcaaatagtactgcatgttgcccattcctgggacaaaagagaaataccatcctgtatttcttatagcaacccaggtaaggtttgtgtgtgagggagcattttggagaaaagagaattgtaaataaatgggtataatctagttggaaaactaaaaactttctttaataattttaaggtaggtcaagagcagtagtagtcattgtgtatttcaggttaaccaagaaactcctactgccctgtgaaaatttattttcaatgttagcattcctatcaatggataacagttacaaggcaaaaaaaaaaaaaaaaagtcaagtattttccatatttattttattaaggagaacttacattatgtataaatgttagcaccagaaatattaagcctatcaactctctgtgtttcctaagttttatcctgtggtcagcatgataattaatatgttacataatgaaattaaaagtcctcctttctaagcccagaagacagaaaatgaaaaggattaagcctcccttgatcagattgttatttttccttttgaggataggatatcctccatctctattgaaacccaaggcaaatcagaacataggtacccccatctccatggacacaaacacaaatatctaagaagcataattcaacagagagagaatctaagtgatataatgaaggtaataagggtatgggctttatgttggaacagacttgggttcaaatggtgattctaccatttattagctatatgaccttgcccaagttaggtaccttccctaaacctatttgcatctcataggacttgtgagattaaatgagaacatagaaaagaacttagcattccatctggcacataataaatatgtcaagttctttcatgcctttgtacatgcccttttttctgcagcatgcctgaataatttctatagtcttccttcaaaaacaggtggtcaagtttgcagcacttctggtcatgccatcttctatgaaattaagacaacatcaccttgtctgtgatgccttccttgcctttaactctatttcctgtgctatgacctggttatttactctttctctctgagcttccatgtatcttctatatatctctcactgtgcactatttcattgtacatgttgacctcctccacagggctaaatgctggggagcatggactatgtcttttcaactttgtatatgccttactaagcacagtgtttgatatacgataggtgctcagtaaatactcaattgctgagtgaaggtatattactcttgggagcacaggcagaaaagtagtctgtagtccagagcaggaggagggactgggtacaaccaaagatttttttccccaaaactgttattatgaaaattttcaaatatacaaaataattgaaagaattacaaggtaaacatccaaaaacctgccacctagattctagaattagcattttgtgagaatatactatattgccattaattgtaggcatcatgctgtacagtagacctgttagcttattccacctatctaactataattatgtatcctttgaccaacatctcagcactcccttcctcctgaccaccacagcctctggtgaccaccattctactttctaattcaatgaggtcaacttttttttagggtctgcatatgagtaagatcatgtggtatttgtttttctatgcctggcatacttcccttaatgtaatatcttttagtttcatccatgttgttgaaaatgacaggattgtcttttttatggctgagtagtattccattgtatatatatacaccacattttctttatccattgatctgctgttagactcttaggttgattctgtatcttggctattgggaatagtgttataataaacatgggagtgcagctctctctttagtatattgatttaatttcttttgtatatatacccagtagtgggattgttggatcatatggtagttcgaattttaattttttgaggaacattcatactgttttgaatatggttttactaatttacgttcccaccaacaacgtgcaagggtttctttttctccacattcttgccaacagttgttatcttttgtcttttgataatagctattctaacaggagttaggtgatatctcattgtggttttgatttgcatttccaggacaattagtgacacattttttcatattcctgttggccatttgtacgtcttcttttaaggcatgtctattcacatcttttgctcattttaaattgggttgtttgttttcttgctattgatttgagttcctcatataattttcattgttaacccctcatcagatgttttattagttcgttttcacactgctataaagaactgcctgagactgggtaatttataaaggaaagaggtttaattgactcacagttcagcatggtggggaggtgtcaggaaatttacagtcatggtggaaggcaaaggggaagcaaggcaccttcttcacagggcggcaagaaggagaatgaatgcaggaggaactaccaaacacttataaaactatcagttctcatgagaactcactcactatcatgagaaaagcatgggggaaaccgcttccctgattcagttaccttcacctggtctctcccttggcacgtggggattttggggattgcaattcaagatgagattttaggtggggacacagccaaatcatattagatgtatagtttgcaaataatttatcccattttgtaggttgtctcttcactctgttggttgttttctttgctatgcagaagctttttagtttgatgcaatcacatttgtctatttttacttttgttgtctgtgcctttgaagtcatatccaaaaaatcattgcccagaccaatgtccttgagcgttttctctttattttcttctggtagtttcatagtttcaagtcttaacatctttaatccatttagagtttatttttgcaaatggtgagagataagggtctagctttattattctgcatgtggatatgcagtcttctcagaaccatgtattgaagagactgttctttccacattgtatgttcttagtacctttgttgaaaatcagttggctgtaaatgtgtgaatttatttccaggccctctattctgtttcttgggtctagctttctgtttttatgccaatcccatgctgtttgggttactatagctttgtagtgtattttgaagccaagtcatgtgatgcttccagctttgttctttttgctgaagattgttttggctattcaaggtcttttgtggttcaatataaatcttaaagatttatttttctatttttgtaaataatgtcattggtatttttatggggattccattgaatacatgggtcactttggactatatgggcattttaacaatattaattttttcagtccatgaacatgggatatctttccatttatttgtgtcttcaatttatttcatcaatatattacagtttttaatatacagatctttcacttccttggttaaatttattcctaaatgtttttatagctactttattttttattttttatttttaaattttgtgggtacatagtgggtgtatatatttatgggatacatgagatgttttgatgtgggcatgcaatatgaaataatcacatcatggagaatggggtattcatgctcagaagcatttatactttgtgttgtaaacaatccaattacacccttttagttattttaaaatgtacagttaagttattattaactatagtcaccctgttatgctatcaaatagtaggtcttactcattctttcttctttttttccgattaatcatccccaccttttctctgcattctcccaacaactacccttttcagcctctggtaaccatccttctattctgtatgtccatgaattcagttgttttgatttttagatatcacaaataagtgagaaaatgtgatgtttgtctttctgtgcctggcttatttcacttaacataatgatctccagttccatccatgttgttgcaattgataggatattttttaaggctgaatagtactccattgtttatgtgtaccacatattctttttccattcatctgttgatggactctgtgttgcttccaagtcttggctaatatgaacagtgctataacaaacatggtagtgcagatatctcttcaatatactcatttcctttcttttggttatacctagcaatgggattgctggatcatatggtagttccatttttagtgttttgaggagcctccaaacagttctccatagtggttgtactaatttacgttcccaccaacagtgtataaaggtacccttttctccacattcttgccagcatttgttattgcctgtctttcagatataaacctgtagatgttttaaatggaattgttttcatgattcttttttcaaatagttcaccgttagtgcatagaaatgctactaacacacttttataagttgattttgtattctgcaactttactaaattcatttattagttctaagatttttggtacagtctttagggttttccatatataaaatgatgtcaactgcagacagggacaattcggtttcttcctttccaatttggatgccttttatttctttcttttgccaaatttctctggctaagacttccagtactgtgttgaatagaagtgagaatggacatccatatcttgttccagttcagcttttcctcattcagcatgatgttagctatgggtttgtcatatatggccattactgttttgaggtacatttcttttacatctaatttgagagttttaaatcatgaagtgatgtggaattttgtcaaatgattttaatgcatttattgaaatgactttgacttttatcatttcttcttctaatgtgatgtatcacatttattgatttacatatagtgaatcatccttgcatccctgggattaattacttgattgtggttgatgatcttttcgatgtggtgttctatttggcttattagtattttgttgaggatatttgcatgtatgttcatcatagatgttggcctgtagttttctttttttgttgtacctttgtctggttttggtatcagagtaatgctggtctagcagaatgagtttggaagtaattcttcctcttcaattatttggaagagtttgagaagaattggtgttagtgttttaaatatttggtagaattcagctatatttttaaatatttggtagttttttaactatctggctttttgttgataggagactttttattactgattcagtcgtctccttactcatctacatgaagaaatagatgagtaaggagactgaatcagtaatatttcatccttgatcagttgcatatgtacacagatttatccattctaagttatctaattcgttggcatataattgttcataataatttcttatgatcctttaatttctgtagtatcagttgtaatgtctccttttttatctctgattttgagtcttctctcactttttcttagtctaggtgtttattttatgttttcaaatgaacaactcatttcattgattttttttttcctttctttttttttttttttttgatatggagtctccctttgtcacccaggctggagtgcagtggctcaatctctgctcactgcaacctctgcctcccgggttcaagcgattctcctgcctcagcctcctgagtagctgggattacaggtttttgtttgttttgttttgtttttactttccattccatttatttttggtctgatctttattttctttcttctgctaattttgggctgagtttgtctttgtttttctaattctttgagatccaagattaggttttttatttgcaacctgtcttctttgtaggcatttattgctgtaattttccctctcaaactgcttttgctgcatcccataggttttggtatgttgtattttcattttcatttttctcaaaaaaattttaaattttatttataattttttcattgacttattgattgttcaggagcatgctgtttaatttccatgtacatgtgaatttttaaacgttcctcctgttactgatttctagttttatactacggttggagatttacagttttaaggaatcctgcacttagacatctttcatgggaaaggggaagccttgagaatatacttatcattcatgtaacatgctttgtcatgaacaaatctcagagttcctagttcatggaaaaggaacatacaggctactgtattcaggaatattccaaatagggataggattcgaacttttccataatttctttccttttttctttctgtattctctctttatcctacttccaacccctaatacatacacacataagagtgtatgagggttccctttcctccacatccatgagctcacatacacccatagctctagataaaagtacaaattaagcaatcaaatataactatataaattaaataaaattaaataagtaaaaggatactaattgatctttcaagattaggcagaggtctggaaactgatgataatgaagaaaaggtcatttcacattcattagataacgattcccatgatctaatttttctctcatttgaacagagagtgataatatcattagcagaaaaagttaaaggagaacaatggaccataatatgatttttttttagactgagtgattgcctttctatttactaaaagatctgaaagagtttacaaaattaaaacacatgtaaaaatagataaacgcagtgaccaagatgctatcaggtacctgagatgagctattttctacagttgagtaacgaatttgattattaatttctgctaatgaaagcaaaaagaaaatgctaaattacatatttctcttcttaatgcattctttttaaaaaataaggtcacaattttttttatttttcaggcatagaattggaaaaacataaccagagatacatggttatactaggtatgggaatttggagtaatattgtagacagtgacttcattgtgcttttataaaagatgcatatgtggtacctaaatcaaaattcttatatggactggggttctagagttgagcatgctgaagtctgaaaggctgaatatgtaatgtcaaatgctaactcaataaagatagttctgtggaatatggtactttgctacctcattatttagcttcacacagagataatatttaaagaatgtagaagtatttgtcatcaataaatcccatagtatgtcttcctcaaggaaaatgagcaaaggatgacttttactgcatataaattatacctccataaacatgatttgtaataaaataaattgtttttgagtgttcagagtttttttttttcttttttttttctttttttaaaattattattatactttaagttttagggtacatgtgcacaatgtacaggttagttacatatgtatacatgtgccatgctggtgtgctgcacccattaactcgtcatttagcattaggtgtatctcctaatgctatccttcccccctccccccaccccacaacagtccccagagtgtgatgttccccttcctgtgtccatgtgttctcattgttcaattcccatctatgagtggaacatgtggtgtttggttttttgtccttgcgatagtttactgagaatgatgatttccaatttcatccatgtccctacaaagggcatgaactcatcattttttatggctgcatagtattccatggtgtatatgtgccacattttcttaatccagtctatcattattggacatttgggttggttccaagtctttgctattgtgaatagtgccgcaataaacatacgtgtgcacgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctaactttttaatgatcgccattctaactggtttgagatggtatctcattgtggttttgatttgcatttctctgatggccagtgatgatgagcatgttttcatgtgtctgttggctgcataaatgtcttcttttgagaagtgtctgttcatgtccttcacccactttttgatggggttgtttgttttttacttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtctttgcccatgcctatgacctgaatggtaatgcctaggttttcttctagggtttttatggttttaggtctaacatttaagtctttaatccatcttgaattaatttttgtataaggtgtaaggaagggatccagtttcagctttctgcatatggctagccagttttcccagcaccatttattaaatagggaatcctttccccattgcttgtttttctcagatttgtcaaagatcagatagttgtagatatgtggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggtttttaatagctgaaagactgcattgccattacctggttcttagatgtcatggaatctatgtgattcaggccacgtgctgaattataacccaaacatagtggtacttaaaagcccctgtagctctcatgcttctcctaatagaagcttttggctgaaacaagaaacgtttttgaaagaagcatattgtcattatccttttgtgaaattttaatagccagatttgtattcttattcatatgtaacaaaaaccttgctagcacagtggtgataacagaggtacctgcaagtaaaactgagggttttttttttgaagtaaaagaaagaaaaagcagctttgaagcaggtacttacacaaatactaccttgatttaccacatatctgtaatggatggcctgggagtagtgactgcagcctgaaaagtaatttagggcatggggtattaactgatgaccttatccataaaatattttagttatcctgtggaagttctgattttagttgacaaaacagaagcttctatagacctgtatattgttgagactacatatattattctaagaaggcttttgaatagatttgctgagtgtagttgatgaagatggcccttttaaatattagggaattcatactagatttactgtttcagttttttcattacagattttgagaggcttctcctggtagtaaaatgtcagatgaaactgttactgtagaattcactaggttactgattcagtttgtgagtattagaaaatgttcttccatagagattttaaatagtttttgtgacaaagcaaaaacaaagcaaactgaagttttccctggattgaagcagccgatcaaatattttaacgtttggagtttcaacttctaagtgaaaagattcctgattttaaaatataaaaggattatttgagaagcacgtactttgtgtatgaatgaagaaatgtatctattttccaatgaaagtttatattttggtgactgcttctactgaagtgatagcatggtcagtagtattccaacatctttggatactgttagcttcagccatcatatggtttgattaattgaactggtgtaatagattaatagatatggtggtatctatactaatctgattttcttttttatgttacataaaatagaatttttccttccttccttcctctttcctctcataatttgaacagatactggattcaaaaaatttatgatagcttaaaccccagggatatcattttctaaaggagtcatctgtagatggtttatgttaaagttggacaaatggatagaacatcaagattttaatatttgtttccacatttgtcccacttacggcataagtatcagggaagtggccagatggggtggctcatgcgtgtaatccaagcactctggatggctgaggcagaaggaacacttgaattcaggaatttgagaccagtctaggcaacatagtgagaccccatctctaccaaaaaaaaaaaaattatccgtgcatggtggcatgtgcctgtagccccagctatttgggaggctaaggtgggagaatcttttgagcctgggaggtggaggcttcagtgagccgacagagggagacctgtctcaaaacaaacaaacaagaatcagggaagatacatattcatttgcttttagaacttataataaaccattgataacaactcaaggattaattaggcctaacatttgagtgtatgtatagcataacacctctgttacaaattactggaggcatttgtgaattatctagttaatttcatctgaagaaagagacctaaaaaggaagctggggtagacctgcttttgccatgtaccccacttcatttcttatggctaaggttgttccacagtggtcctagtttcgaacctttgccttggtagcataaccccaaatttttctgaggctatagccttggagttggaattgcctagatcttcacagaaactattgtgctgaactctattgggttgacagagagctgggtatataccaccccactcacctatcatatttggggatgatgacagttggcaaggattggcaccattatcagtatctttaaaaggtatcaagaaattactggcaagtttatagctttaaatgcctatattagaaaagaagatagatctaagtttctatcttaacaagctagaaaatgaagagcaaattaaaacctagataaatagatggaaataaataataaagaacagaaataaatgaaatagaaaatgtatttaaaaaagaaaaagataaaaccaaaagccagatctttgaaaagattaataaaattaataaatccttaccaagactaatcaaggaaaagagaaaatataagtttaaacttttatgtatgaaagaggataaatcatatacagatattaaaaagtcaattagggactattatgaacgaatttatgtcagtaaccttaacaatttacatacaaaagagcattttttgaaaaacacaaattatttaaattgaaacaaaaagaaaatgaaaatacggatagctctatttccactaaagaaatttaattcataataaaaacctttccaaggagaatactctaggcccagatggttaaagaagaattaataccagtcttacgcaaaactctttcagaagcagagtgacagagaacactgacacacttgttttataaggccagcataaccctataccaaaatgtgtcaggcattaccaaagaagttacagaccagtattcctcataaaatattctcaaaaaacccccacaaaacaaaacaaaaaaaaaagagtaacaaacttaatacggtaatataaaggataataactcttgacccatatatacaaggttggtccagcatttgaaaatcgatatattttaaccacattaaccgaataaagagaaagtaatatgatcattatgttactggtgggtatttgttcttagagttcccaagatggtggcgggctgcttccaagatggtggcaagcctcttgttctctgacctggggttcttggcctcacggcttccaagaaatggaattttgggccatgtggtgattgttatagctctattcagctccattagaatgaaccccaggcacttagcctgcacaggaacaatggcgagcctctagcccaattgggagcggcagtgggcgccacctcactggatcaggagcacagcagacacctgccctatccggagggatggaagtcagcagtgggtgtgcgacagtggcaaacagcagtggtggatggcaagcgaaagctcagcttgagccctaacaaacacagaccagaagagtgtgcagttgcaagatttaagagagtgaaaacagagctcccatgaagtgggaggggacccaaaggggctttccattgcctgctcaaatgcctgggtttatatcccgatcattgtccctcctcctgttctctcaggcgatagatgattggctatttctttacctcctgtttttgcctaattagcattttagtgagctctctttactacctgattggtcgggtgtgcgggtgtgagctaagctgcaagccccgtgtttaaaggtggatgcagtcaccttcccagctaggcttagggattcttagtcagcctaggaaatccagctagcactgtctctcaattgcaatagacgcatgaaaggcattttataaattcagtacccatagaagataaaacatgctcagcaacgtaagaatagagagaaacttctaaacctaatgaaggatatctatggaaaatctgtagctaacattatacttcatggtgaaagacaatgtttgacttctaagatctggaagaagacaaagatgtccttcctctttgagcacttatattcaccattgtattggaatacagtgtaatatagtactggagtcagtgcagtagggcaagaaaagaaggcatatggccaaaggaagtaaaactaacattcacaaacaacatggttatgcatgtagaaaatcctaagaaataataaatggagagagatatatcaggttcatgactgttagactctatattgtgaagataccattctccaaatttacttatagattcaacacaatcccagtcaaaatcacggtaggcatttctgggaagacagtaaattaattcctaaatttatatggaaatgcaaggaatctagaataaactcttttgcaaaagatctaagttgtagaacatagacttaccaggtttttaaaacttcttatttcaaagtggattacagacctaaatgtaaatgccaaaacaaaaaaacttctaaagaaaacatgggaaaaaatattcatgacacaaaaacagggcatgtacaaacacaaatatgaaccataaaagacaaaaactattaaactgaactttttcaaaattgaaacttgctctttgaaaaacagcattaagaaaatgaaaatgcaagccatagactgggaaaacatatttgtaatatgcatgtctgacagtggacttggcaatggtcccattgtttgtgtcccctcaaaattcatatgttgaaatgctaaccaccaaggtgatactattaagagatggagcctttggtaggtgattgcatcatgagggcggagccctcatgaattggattagtgctttaataaaagaggccggaaggatcttgtttgccccttccactatgtgaggagacaatgaaaaggcacaatttctgtgaaccaggaaaccgaccctcatcagactgaattggttggtgccttgatcttggattttgtagcctccaaaactgtgagaactaaacttcttttgtttataagctaattagtctgtggtattctggttatagcatccagaatggactcagacagagttgtatacagagcatatacagaatgaagaactcgtaggaaccaacaataatgagatgaacaactcaattaaacaattgggcaggctgtaatcccagcactttggaaggctgaggtgggcggatcacttgagcctaggagctccagacctgggcaacatggcaaaaccccatccctactaaaaatagaaaaaaacttagctgggtgtggtggggcagcctgtagtcccagctactcaggaggctgaggtgggtcgatcgcttcagcctgggaggcagaggctgtagtgatcatgccaccgcacaccagcctgggtgtcagagccagaccctgcctccaaaaaaaacaaaaaacaaaaatcagcaacacataattgggcaggaacttgaacaatcacaaaagaatatgtatcaattgtctaaaagtacatgaaaacattttctataccattagccaccagggaaatgaaagtcaaaactacaggaattaattaaaaggaaaaagactgacagtatcaagtattgacaaggaagtgaagcaaggggtgctctcatatgttgctgctaggggtgtaataattgtataaccactttgggaaacaatttggcaatttcttataaagataaacttacatttaacatttgaagtttgaacctccattcctaggtatttattcaaggaaaatgaaaatctgtatccacaaacgctgtgtatatatttacagctctattcatactagctgaaagctggaaacagaggaatgaataaacagatcatggtatattcatacagtatatattcatgctactcagcaatgaaaaggaatgaactaccgatgcacacaacaacatgaaagaatctcaggaacgttatgctgagtaaaagaagctagacacaaaagactacgtattatatgagtacattattgtatgattccatctatatgaaatttttttaaatgaaaaactaatatattgtgataaaattcagatctgtggttgcctggagtggaggtgtttgaccaaagagaggcatgggggaacattctggagtgatggaaatatttataatggcagggctacataaatgccccagctcaaggaactgtacaattaaaatgtatgcctttcactgagtataaaccatacatcaataaagtttatgtttttgagtaaaagggagttccagactctgtgctctgacaactttggcacatggggaatactacacttactctccataggttaagccttcctagttatctttgataagccttgtcctagacagagacaatttttatactgacaaaatcaaaatacattctattaaattaaatggaaatctcctcactaaaatgaagtacaacacatagatggaatacatgggatgagatacatatcctggatttcagtagtattctttgagagtcttttaaaaatatatttggcaggccgggcatggtggattatgtctgtaatcctagcactttgggaggctgaggtgagaggaacacctgaggtcagcagttcaagaccagcctggccaacatggtgaaaccctgtctctactaaaactatgaaaattagctgggtgtggtggtgggcccttgtaattgcagctactcagggggctgaggcaggaaaatagcttgaacctgggaggtggaggttgcagtgagctgagatcgtgccattgcactccagcctgggagacaaagcaaaactctctctctctctctctctctctctatacatacatatatatatatacacacacacacacacacacacatacatcacaacaactaaatttttaaaaaaattctaattcagggttcagtgactggaccatgaagcctatttttgtactgccccaatgtaagaatggttttacattttaaaaagttgtttaaaaaaaaaaaaaaagtcctgtcccttaagaaaaaacaagcaaccagtactataagtgttcctcaaagtctacaatatttactatccaaacttttacagaaaaagctttctaactcctattctttaccctttgatctgcacactctacctactgtaactgattcagcctcaaaaactaacatgttgtctttttgtttgcattagagaatcctagatgtttgaagtactaattagtatacactaagcctatggccttatttcctttgctctgaaaactaagagggaatgttaagttgaatgatatgatagctactttccaaggaatgctgtatttcttacgaattggcctctttggctgtactccagatggcctggttagaatgacgttaaagctgtggaatagccaaagcacttgaaatatcagttatgtatgtagcatgaggctgtcagccattttgcaaaaagcatgggacaatgctaaatatttctggtttgccccagtggtatagattggagaaccatttttactcttcagccttcatggaaaatggcagggtagtttaaaaggtctttgagaagttttggaggttctaaaggggttttttttttttttttttttggcatggggttgtcagaatagcggatttgcacttctgtctcagcaatatcaagatttcccccttttagtgcatttgaacccacacttcaaccttagaatcttcttactctctcccaccctttgcctctgcctcctgtggcctcatacagctgatctcaaaccataatagatcttttaatattaacttaggtcctctgagcatctctttatttcaaaattttaaagatgaacctgggataaagggacatagagctgctttaggaaatacacagcctctttggggatctcactgtgctagtggtatacagattcaagttgaaagaccagtggaattgtggttgacagcccagggacaggaacaagcaggagcctggtatgagctaacatttaagttaaaatctgtgactatttacgatatttctttcttttcatcttttctctaggcctactctgtgtatgatgaagacattgggtactgtcaagggcagtcttttcttgctgctgtattactgctgcatgtaagtaatggtccgtgtgataaatagcacagtgctgccaagtttattttactttctactggctttgttcttccttcttatttcccatttatctgatggagattacatatggcatatcttttttaaaatgtacgttaggtgataaagtaagagatatgatgtcaaaaatacgacagtttctcaatggaattagttttgttggctagaaaaggataaattgcttatttggagttatttttaactagaatcctctggaattaaagaagtcggtataactgcccaaatatcaggacctggaccattaagacccactatactgtgacaaggaagtcctttatcatttctgtgatgtatttttatatatcctctttcctgtcagttaccttcatttgacagatcatttattgagcatcaattttcaggtactgggctaggaagtggggttataaagatgaatcatttataatttgtgttctcaaagacttcatagtccaggatggggcacagataatgtaggcatgaacttataatttttgttctcttttatgtgtctttatttttctgatgacaaaaataatacatactcattaaataacttacagtatgctaagtgaaagtgatacacaggttaagagaatagagaggagaattacccaaccaagctctgccagaactttcagaaaagactttctggaggaggtggcagctttgtcaagacagaaatgagattggagaaggtgagaggggaaagggagggggtaaagaattattgacaaaagtcacaatatgagaaaatgtatggaagtatgatagggcacagcatacaaagggaacaatatgaaatcacagtttactatagcaattgtacacggggagtggtatgacgtaaaaatggtaagatgggaaattgtgaagactttgtaatgtgtcaaaaatgcaggctttattctagagctaatgaggaaccattgatcactttggagcaagggaataatacagtcatatgatcattttagataaatcttttcatacctgtgtaaagggcagaattaaaggaaacagacagcagcagagagaccaggtagaaaacatcaatatggccaggcacagtggctcacacctgtaatcccaacactttgggaggttgaggcaggaggatcacttgagcccaggaatttgaaaccagcctaggcaatataatgagacaccatcactaccacacacacaaaaggtatctgggtgtgttggtgagcacctgtagtggtggtgagctacctgggaggctgaagtgggaggaccacttgagcctgggaggtcaaggctgcagtaagccttgattgcaccactgcagtccagcttgggcaatagaaggagaccctgtctcaaaaaaataataataataaaaaggaaaagaaaatgtcagtttaaatgagagatgttgagaacccagagaaaagcagaattaagaaacattcagggagcaaaattgttaggttttgtggatggattggcaaaggagcagtcaaaggtgacatatctagtttcctggctttggagactggatgaatgttgtattttgagttcagatagcaaatatatctatggagattgaatgaaggaaaaagtttaggagttgatgatgatgagttctttctttctctctttctttctttagagacagagtctcactctgtcgcccaggctggaatgcagtggcacaatctcggctcactgcaagctccgcctcccctgttcactccattctcctgcctcagccttcccagtagctgggactacaggctcctgccaccatgcccggctaactttttgtatattttagtagagatggggtttcaccatgttagccaggatggtcttgatcttctgacctcgtgatccacctgcctcagcctcccaaagtgctgggattacaggcgtgagccaccgcgccggcctttatttatttatttatttatttatttatttagatgaagtctacctctgtctttcaggctggagtgcagtggcatgatctcagctctctgcaacctccacctcctgggttcaagtgattctcctgcctcagcctcccaagtagctgagattacaggcatgcgccaccacaccgggctaatttttgtattttagtagatggggtttcaccatgttagccaggctggtctcaaactcctgacctcaagtgtgccgtctgccttggcctcctaaagtgctgggattgtaggcaggagccgctgtgcccgtctgatgataagttttgtttctaattatttgagttcaggatattcttgggacatctaggtggagatatatgttcagcagccagttgcatactggagattaatgctggaggagaaatgaaagctgaagtcatgagagtacatcagatcatctagaagaatgaatagagtaagaagattaaatcccaggaacagcaaacatttgaagggctgatgcggaagtaaaatccttaaagaagttcggattctcagtagggaggaagcaatgaatagtgtcaaatgtaacgagaggccaaacaagtttaaaaggacagcattgtttttttgaggtttagcattctggaagtgaagagcaattatagtagattcatggtcctaattctgaaaacctgattttaattataatagttctattatgattttcactttgtttcactttgaggttgatggtttttttccctctgttacattattatctgtttatgacagtttctgtcttcttgttatccttctttctttgatttctctacatctcacctttttgggacttcctgtgatgaccagttactttatagtcacaaattctcaggggcccttgttccccttctaaacccactagaatctagaatagtcaggtcccttccctaagaggctggagaccatacccagtgacatggatgttttcttcaaggctcagagccatctttcttctaaaggaagcctttataattacttggatgagaagctgaagttcaagacatgggtggtgaagctttggtttgaacaaagcaatctttttttttttttttttttttttttttgagatggagtctcgctcagttgccaggctggagtgcagtggtgcaatctcagctcaatgaaacctccgcctcctgggttcaagcgattctcctgccccagcctccagagtagtgggactacaggcacacgtatcaccatgcccagctaattttagtttttttttcagtagagacagagtttcaccatgttagccaggctggtcttgatctcctgacctggtgatcctcccaccttagcctcccaaagtgctgggattacaggcgtgagccaccacgcctggccacaaagtgatctttgaacataccgtagtttagcattttttacctgtagccctgtttaacatattataatatatttattaatgttcagtgagaagaatatctctctgagaaatctgttttggatttgacagaagtttgggtcaattataagttcataattatttggaaacaccctccccaccccgtccgcaaagagagaaagagagagattcaaataacgagagctcaaatacccagaattttttttctacattaggtactctactattataagggccacgtagtgagtcagcctttgtgaactccaacaagatagcttccagtgtatgttacaagagagacagaaattcagtctagtctctcacactttctacattaatagaattattcagtgttgtcatggcttttataaaaataacttgaaatatagaaatccttttagaatccttaaggaacaatgaactgatattcagcattctgttaatgaaaaacatattctaatttttaattggcagtatgtttgataattctgttaattagcatattccattaactgaccaacccatccattcaaccaatttgaataacagaagttaactgtaatttattttttactatatttttgtctccctggtttaaacaaatagaagaatacggactggtttaaacaattcatcaaacacactatctcaggttccagggagatacattattagggtcttactgactaatttgttatcagttacataagctattgcttctttttgctgccagacatctttggaagctccatattaatcactgtgagagcctgcttccttttgggttctgtcctttcctcacccatagtcatttatatttcacattcattgcctgagaagaaagtaagaccaaaaatgaaagtatgttcaaaaacagttttgaatttttaggattttttcgtgtctaagtagtctaaataaataattagcctctccttgtacttggaaatttctagatgctttgacaatagctttgtaacatgtagtagtttagacaatggaagaattaaatgtttatcacagtagactcttacatccatttatgaaattacaagaaatttgtcatttacagttggagaatgttatagtacagattgcctgcaaccattataatgttcaactgcctttgtaatgaaatatacaataataatttctaatttcataatcatgatattagtctttatctcttagtcttaataaattatgacctgattatatttcacttactctaaaaattatataaaatattttagataatttgtaacccaataatttttctacaatatttattgttacaagttttaaattttttaattgaacatgtacctttttagacattcagaagtttatgttcatttttaaggttaaattactgtatgtatactaatattggcatttatagaagctttccaactgcaagaaggattatgtttgaataatctagcatgtttaaaactattgaatttttttaaaaaaactatgactaggtacaattcctttcgaaaccaatttggctttgtctgataaagatatgcacacccagaagttttgctcctagacgtaccttagtcaaatttacgcacttgtacatcaaaatacatgtattacttttgtcctaattaatagtgtttataacagtcaaaacactgaagcaactcaaatgtccactactaaaatgtccaatattagaattgtaattagacagtaagatggctaaattatgatattcttagagtatgaatgccatacagcaatggaaatgaatgtttcacactacattgattcatataaatgaatcatataaacataagatttagtttaaaaaaagcaaagtacaacattacatttggtatgattccattctgcataaagttcaataacaagcaaaactaaattctatttttaggatgctagatagatggaaaaaactataaagaacaccaatgaagtggtaactgttaaagttacgaaagtgatttctctagggagaaactgggaatcatgactgaaaagagacagggattttcagggctatcgacagtattctctttcttaacctagatagtggttacatgcatcctttgtaagtttttttagtttataatcaagtattaattaaagtgtacatttaacttttatacatttttctgtttgttgtatttcagagtaaaataaaattaaaaattataaattttaaaatatttctcaccaaaaagacaggtttgggataagatttaaccaatggaagtaaataagaagcagaactacctattacagattccagagtccaaggtgacaagataaaggcttcattttgaagtctctatcgtatatatatatatttataacatatatatatgttaagtatttgtggcattatattattcaagactctttctgctgcatgtgacagaattgactcatataactgggaaatctagggtcagagatgatttttcacatgattggactgcagagttcatattttgtcatcaagaatctgtatctctgcttttcttgaattttattgtcttaattatgttagtagacaaaaaagtggggcaaaatgactgttggctggcctggattcatatgatcaggacaacttcatttaaaagggactattttttgctacctcgtttaaaagggactgtcttttgctatagctcctgcatttatttaaagtgacacacaacaacaccaccaacaactccctctgtttttcttcctgttggactttggcctggttgggtagggcattctaattgtcacagcccaggtctttagtcaagatcagtgaacaccatcagcccctcctaaacaatggaatggtcttcctataggaagaggggttttgatatcagatgatgggacagtaggatgctaaacaggtacatcacatcatcttgagtgatatacttactacaagatttttagtgtatttaaaaagtaagtcctatacttccaaatcacttttccttctagttcaagagaaagaagcattcattttcctattccaagttaattcttatgaagtgcttttgagccattttccaacatctccctgtgtcctaatacacacaaacattttacctatttaaaaaatatttaactactatcttatgtctctctgcctttttgaagctgaactctttcaaaggatactgaaaagtacaactgtgaatttggattgtggtttaatacctttcaagttatatggctttgggcaagtttcttcaactgagctttagtttcttgttatcatccttctaggcttattatgagtattgagtaccttatgatgagtgtaaagagtcttacatattttgtacctagcacaaaaataatgcagttatgagattaaaaccaggctttacttaatagacctatagttactggcaagtcatttaacttctttgaacttcactagtattatatttataatgtaaaaataatgcctaccttgcaggatttttgtgaatatcaaatggggtcatgaatgaatatgtctaataatggtaactgttgctgttattttttaaattaataattatttgcttttacattaataattatttgcccagccagttttcttttggtccctggtccaactaatttgaatggattacacataggagactaatatatcatacagtgatagaattttatggcttatacattgacattcaatttaaatgtattaagctatttgatttaaagggagaatagacaaatgactagaagttttcattctatttgctttttaatatgtaaacaaaaaatgaagacatgataaataaccttgagtttgaaggttcaccagcattcatctttttttttttttttttttttgagacatggtctcgctctatgacccaggctggagtacagtggcaagatgttggctcactgtagcctcttctcctgggttcaaggaatttttctgcttcagcctgccgagtagctgggattacaggcacatgccaccatgcctggctaatttttgtatttttagtagagatgatgtttcaccatgtgggccagcctggtctcgaactcctgacctcaagtgatcacacacagcctcccaaagtgctgggactgcaggcatgagccaccatgccgggcccattcatttttgttgaagaaaattgggaatatcagtagagtgttcatctccttcatagagaaaggtagatcattccaaaaagatgtgaaacacatcatgtgaagcaggaaatttagttttacactaactatggggattactttaaattatcaaaatgtagttttacttcaaaaaataccttgatgtaaatgatttcaggtgcatcttaaagacttgaaatacttagcactgctttgttttatagtttcttgtggagagaagtagtgagggcttggagattgtctccattcagtgatcatcacaattagtacagatggcagatcattatcaacatttattaccaaacggtgattacatcactcaattctcaattatgcatgtgaggcaggtatttttgttttgtatttcataaagccatggatgatattttgatatcttaaattataatattttaatgtttatcccctcttttccttaatgaaataacactggtgataaagtttctgtacacagcaaaaatggacattcagtcttagagacccaccatattccaacaccttaatattttatttaaagatgtgttgttcaattatgtatttttattgtaactttagaccaattgcataaattggataaattggattatcttattctatgaagcattaatcattgtaataagttaaatagtcattttagtgctttttttttaagtaggtaggtaccaccgtactacctcgtggaggaattgcacgtactaaggtgaagtttgacagtacaacctagcattgcatctcacatcttggttgattttctttatgccgattgagggataagctgaatagtcaacacaaaatatagataatataaaagctttttatatttagcatttggaatagaattacaggaaatcaagtgctaatatagttgcatttggctgccccttgcttctagccttcacaccaatactttccttctacatttttgttggcagttaccaacagattgccctacttgtgtggtatgacttcattaaaaaggcagatatatgcagaattttgctagtttatcttaaagaaatatttaacacttgatatttattgaaggttctatgccaagagttgtggagcggggggtacaacattaaagtggtggttagaagtgcacaaataactgtaatggtatacaacaaagagttttgggattcagagaaagcaggggtctcctcacgttaaagagaaataacaaagtgccacttatgatcagttttaaaagatcagtaatattttaaaggcagagctgtgctatagagtatatcccaacccagttattccctctgagcttgtatacaaaaccatgtggagaaccttgaaactgcagtttgtctgagtcataaaaagcatggggaggaggagggggacattcttcctagtgatacacaagaaatgctgtcacttatatgaaaagcagcatatttttgctgcttcatgttatcaacttaaattccagcaaatcattttaacagaaagatcttagagtaaaaattttacctatgcatctgtttattcttttgagtatccttgtataaagcactttggtaattgtcaatgtataagacagagtctctgtctttaaggaaggaaagataagagaaatttacatttagtgattgccaacaatatgtatatgttgtctcttaaatatatttcacttaatacttgtagcatccctatgacataggtattattatttctaattttttagaagtaaaaaaaatcttaggcattaaaagaggttgcctgctcaaaatcacccagcgagtaattaaaaccttacctgaaattacatctattggtataattccaaaatcatgtatttctcctgcagcgccttttgtatattcatgatctgtttctgggcaaagttttgagaggaatgattgaatataggttcttgtagattatacctttatacaaaagaaaagtgatagattcttagtaaaccaaaatatagttgtccctcagtattgggaactaatgaggaattggtagcagctgcgtgaccttactaaaaataaaaatcagatccgctgctgtaaactcttcactgatttcccactgcacttagaatacattcctaactctttatcatggtcatatcagtgctgtgctacagccaggtcataccagcttttgacggccaattgttaaattttcaggaattctgtgaaccagttgttaagcacagccattgttacaaattaaatgataaaaacttacagttaaataactcatgttaaaaacaaaagtaataagtactcaaaattcatcactttctggttatgttaccactttttactgttgtctgtgctcttgaactatttacattgttttatctgtatgataaaaatggtatatgatggtatgctgcagctctactgttatgcatcacttttctttttttttgcaaatgatattttattttatgcaatttgtttatttactcattcattcaattgcttatttaatcattccttaaaatatataagctgagagctgactatatggatggcaccaggcaaatacaatagatacagtagtgaaaaaaataaacatggtgtcttttgttatggagtccaaagctcagtggagcagtgagtgatactaatcaaacaactgcacaaatgcatctataagtaaattattttaaaagtacagttaaaggaaacaagtaggtgctattaagtacatgatataatatcagggttcaagaaaattttcagagcaaatggcaaatgagatacatatattcagtctgcccttcatgtctgcaggttcaaccaatcgtggatgaaaaatatttggaaacattaataacagtgtaacaagtaaaaatataaataaaaatacattgtaatgacgatttacatagcatttacattgtattaagtattataaagagatgatttaaagtagattactaaaatcatctacttcagtaatgttatatgcaaatataacatatatggttacctgcaaatactgtactatgccattttttttctttttttattttttatttattattattatactttaagttttagggtacatgtgcacaatgtgcaggttagttacatatgtatacatgtgccatgctggtgcgctgcacccactaactcgtcatctagcattaggtatatctcccaatgctaaccctcccccctccccccaacccacaacagtccccagagtgtgatgttccccttcctgtgtccatgtgttctcattgttcagttcccacctatgagggagaatatgcggtgtttggttttttgttcttgcgatagtttactgagaatgatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaataatgccgcaataaacatacgtgtgtatgtgtctttatagcagcatgatttatagtcctttgggtatataccgagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatatccttcacccactttttgatggggttgtttgttttttcttgtaaatttgtttgagttcattgtagattctggatattagccctttgtcagatgagtaggttgcgaaaattttctcccattttgtaggtttatgcatcacttttcaactccagtccatttattttctaatattctactctgatctcttcccctacctcctctttacgctcaataattcatggatttgcccttttgaggctattttctagatcttgcaggcatgcctaatgtctttttattctttttgttgttgttgtttctcctctgactatgtattttcatatagcctgtcttcaagctcactgattcttctgcttgatcatctactgttgagagactgatacatttttaagtttgtcagttgaattttttagcttcagaatttctgcttaattattttttattatttcagtctttttgttaactttatctgataggattctgaattttttctctgtattgtcttgaagtcattgagcttcctcaaagtagctattctgaattctcttaaatgtcacatatctctcactccaggattggtccctggtaccttgtttagttcatttgatgaggtcatgttttcctgggtattcttgatgcttgtggatgtttattgatatctgggcattgaaaagttaagtatttattccagtcttcatagtctgaacttatttttacccgtccttcttgagaaggctttccaaagggaattaagtgttgtgatctaagtctttagtcactgaagccatatctgctttaggggatgccccaagccaaataatgctgcaatttttgcagactcgcagagatatagccttggtgggcttgggtaagatctgagagaattcctaaaatctctttttctcttctctcactttcccctgaataaatagtgtttttttctcctcatgctgggcttcctggagttgaggagcagggtgacacaagcactagccaccacagctgggactggctactatggctgcaactgcacttggtcacacctgaagccagcatggtacctgacgactactgcctggctgctgctggtgtttattcaaggccccagggtctttccattcagggtagcaggtttccttctggcccaggatggatctagaaatgcttttcaggagctagggtctggactcaggggattcaggactctgcttcatgttactgtggctgagccggtactcaagttgcaggacaaagtcctctttactgtttcctctcttttccacaagcagaaaaggagtatctcccaagctgccctgcctggagttggggaaggggtgtaagtatagccactcttacttttttgttgttgtttctatttgatcccttggctaccccagctggtgtttcactggattgtatgtaccccaagtccactggcttcaagcccagcacagcaccaggacttgccggaagattgtaatactcgtggcctagactgcttttcaaatttgttcaggacaccagggcactttagtctaccagggggcttcccttctgtctggggccagtctgaatccttccttgttgtgtgcctgctaaattctgccctgtgttgtgttctgctgtgacagggcagcactgagtaccagtgcaaagtcccacaatccctgctctctccctttcccaagtgcatggattctttctctacacagtgctggggggataggataggtgtggtgtagacgatgtaagactgttttttctatcctcttccatgccttcttccttgatatcatgttaaaaccaggtactgtgattgctcacctgattttttgtttttatgaaggtgtttcttgcgtggatagttgttcaatttggtgttcttgagggaggatgattgctgaaggatgattgctatttggccatctagctctgcctcctccaaaattgtctctgatgtttacctttacttccaacacccaacattccctagtctaggacttctgcatccttatgaaactcaagtagagttgcctgtttactcttcccctagggaggcactatacctttatctctgtatccctaaagcctagaacagggcctgcacctcatctgttcagtgactatatgtatgaatgccaaaaggcacataaaccttttatttgccctaatgattttaccacattcaaagaaataaaaacatattccctttataagacatcagatggtaagacatttacttagaaagagagagacttaagtgaattagtatctctaggactggctacagttcagttatcttttttttttctctctctcttttgagatagaatctcaaaactccaggctggagtgcagtggtgcgatctcagctcactgcaacctccacctcccaggtcaagcagttctcctgcctcagcttccccagtatctaggattacatgtacacaccaacatgcccagctattttgtatttttagtagagacggggtttcgtcatgttggccaggctagtctcgaactcctgacctcaggtaatccacccaccttggcatcccaaagtgctgggattacaggcgtgagccaccgcgcccggcctggctacagttatcttacatgcagctattttgtatagccatttgagtagagatctgagaggaagatgaagaggcttacaccttggtaagagaagtattcttggccatatatgttcaagttagtgtcacttgaggctttgatgacaaaggagtaaagaatacagtgtaattgtatcctaaataaccaaacggaagctgaaaaatagttgctaacttgaatagctgaggtcagtggccagaaattttgaaaaggtctcaaacaactcatagataaaaagaaaataagcaaatatttaaagaatcaaaatgaaaacactataatgtatttatttaacttcaggagatgttatttaacaaatttgggtattttgtggtttataattagaaaatagaagtggctgatttgtatgaaatcttgtacaactgcatttctaagtggataaatggaactctacttgattcacttgctgaagtatgaagttagtctaacaaatgtatgaaataccataatcaaccaaatgtaaattttcaaggaagtaatatttaaagtagatgtttgtataatagttacatcctaggacattgaataagtacaactttttctgtatgcttggtgtaatttctagaatattagatatgtccctttccatattctttcacctgttgataccactgtttagaggtttgttcctttgacttcagactttattccctgttcagataaaaatacctctgagaaagctagtatgttagagtttactggccatttccctgaaaactgtattttacagaaagtagcaacatcaagaaaacgcagggaggatagtctcacgctatttaccaaaatttaaaatgcatttattttttcacccagcattcccccttttgggaatgtgctctaccccaccccatttttgcatatgtacaaaatgatacatatgcaaggtttattgaagctttatatgattaaaaaattaggaacatctcaagtatcaataggaaacttgttaaatgagctatagtacttttatataatggaatactatgtaattgcttttaaaaaaataaagagacaactctttatatactgagatagaaagatttccaacatatattgttaaggaaaaaaatcaagatgtataacaatgtatatagaatattatcttttatgtgggatgggacaaaataaaattaaaaatgtaattattttatttgcatagataatcagtggcagaatacaggagaaattatttagagtagatatgaggctatgcaaaagaggttggggggtgtaggtaccggggattagtttatatataatgatagggaggagcgagacttttacctttagatctttttacattgtttttattttattttattttattttttttttagacggggtctcgctctgtcacccatgctgtaatgcagtgacgtgattttgctcactgcaacctccacctcccaggctcaagcgatccttccacctcatcctcccaagtagctggactacacactcatgttgccacactcggctaatttttttattctttgtagagacagggttttgccatgttggtcaggctggtctcgaactcctgggcttaagtgatctggctgccttggcctcccaaagtgtgctttggttttttaatcatgagtgtattgcctgtttttaaaggtagcctaatgaatgaatgacaacatgattaaaattaacaaaagaagataattcatctcaagtaaggaggtcatgtcactctgccaaagactggctctgaaggacttcatttgctccaggccttcagctacttatgcagaggactaataacatgaaggaacttttttgacattctggcaaaatgccacttatttatattgtatatgtatatatttttctgtagatgccagaggaacaagcattctgtgttttggtgaaaatcatgtacgactatggtttgagagacctctacagaaacaacttcgaagatcttcattgcaaattctaccagttggagagactaatgcaggtaaataaaaattaggaacttttatcactcagggatttgttgagtcatagaaaaagcctaatagagttggtaagcaataatgaattatagaagtttaatggaatattatagaaaatgtacatggatttagtttcagaccaatatctacattggtctatcataatatgtttatttagccattttactattttaaaaatatctcacattttaaatgttcaagttaaatatactttgaagtgagaatctaatgagtttaatcattaagagattgccaagtattgtttgtagaggaatggagatatttacagagtaaaaattgaaatacctaagagctttctgcatactaattagcaccacttccttatttgagtccacgtagaacacttggaaaagccagaaagatattcataagagaataaaacatactaaaatactgtagggatacatttaaaaatttttaaatataattcctaatctcaatgttgttgttgtgctttacaatgcgtatttataaatgtgtgtgagaaacatgcatccttttatatataccaaatattacacagtaaaaaagattgtgaccacaggcaaagtgattgaccagagctgacaaaaggaatttttaactagctttggagttctacctgaagttgataatcttaaatttataatgggtttttgtggcatgtttatgtgactttgtttaaaaggggttttgggaatccaagagaaatgtgaaggagatacatggatggattgattccatattggggaagggtaaaatggttgaggaaggaggttcgtggaatgtgagagcagaagatgctagtaggagctcattgatatgaactgccaggggatccgtaggtgtctaaagagggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggtcagtattcctaagggctttgagaatcaagtaaatatacctaataaataacagatgtgtggtactatgaagaacctcaaccacatttttctgttagcagttttttttcagttaactgaatgagcatttggacgttccatttgaagtacctaatgggcacatttggctatttttcaaagagagcatgtagttcaagaaatggcttattttgttttttattcttctttttgtggtctatttaggaaaacaaaatgaaggtggcctttgtctttcagttatggtaatagctatgctaatactttgtaccttgctgttcatgcttttgaaaaccatttgcttgtttaaattgggagaaaaaaataaagttaccataaaggcatttttagaagatatccaattttatatattatacctttgcataatttctttgctttgccatttttaatatgctgaagacagatttctaaatagtttgtcgtggcttagaattttctaagtgttcaaaaaatatactgaaacatcatagaccccagattagatgatttccaaagagaagatacatttcttttctagctagttaagaattgaaccctgggctgggtacagtggctcacacctgtaatcccagcactttgggaggccaagtcgggcagatcacttgaggtcaggagttcgagaccagccaggctaatatggtgaaacactgtctctagtaaaaaatacaaaaaataatcgggcctggtggagggtgcctataatctcagctacttggaaggctgaggcaggaaaatggcttgaacctgggaggcggaggttgcagtgagccaggatcatgccactgtactccagcctggatgacagagcaagactcttatctcaaaaaaaaaaaaaaaaaatttaaccctgaatggggatgctatgacttgaccctggagtcaagatactcattacactacagatgctctggtagaatgagaattttgcaagaatcaagaacagtcaagtgagcaagagatggtctttcttagttgtttataataagtctgtttttattttcctcaattatctgtcatatccctaattctcatctgctgtcatcacttctgtgcagttatacaagacaaccaatactagaatagagttacagcgatcatagaaagctgtttgtaagttgcagttgtggcaggaacttcattgttctgctgcaagcttctcattgctcctaaattttccactttgacttttaggaacagctaccggacctgcatagccatttttctgatctgaacctggaagctcatatgtatgcatcccagtggtttctcactctttttactgccaagttcccactctgcatggtgttccacatcattgacttactgctttgtgaggtagagtgactcccatctttcactaagccaaaatagaaagtagtttctactaaaaatggttacagttttcttccttttgtttttgcctgtgacattaagccataaatactcactgaccaaaaagctgtatttgaattttcagtaaaaactattttaattgtaattttattatttctgaggaatgaaaatgttaaggcatatataattcctacaaagtaaaatgggtgattaaatttgcataattaaattcataataagcctatatctgtataataatgttttaccagtataaaatgcctttaaggttaaataaatgaatttagaattgggtgttttttaatattaatgcagttatactgcaagagtgaatataaatgagatttttataataactaatttctcagttcatcagatatctttctgtttatcatgtttgggactgctgcgaaatgatgagacaaatgataaactaaagctattatgtcatataattatatttttatatagtagaatatttcaaaaattagtttgtaaaatttcttaggtgtttatatttgtgtattttattgtttttagttccttagatggctatatttatttactcttttaaagaaataaacagtattatgcatatatatggcttatattggtcatcaaaatgtttgactatcttagcagtaatagggaatttgctagataagaagtgtatattttcaatggcagtataaatgtatataaaatatagctatcttaaaaagcaggactaatcaaaagtataagcttatctatgtgattataagcttaatatataatctagacagttttgtattactatgcttcttaaggtaaacatcctttaaaaaaaattttttttgtataaatttaaggggtacaagtgatgttttgctacgtggatatattgtgtagtggttaagtctgggcttttagtgtaaccatcacttgaataatgcacattgtacctgttgaataatttcttatcccctacccccctctcactgtcccatgtgagtctccaatgtctattattacaaattctgtgtccatgtatacacattatttggcagtatttgactttctgagttgttttacttaacataatggcctccagttccatccatgttgctgctaatgacatgattttactcttttttttggctgaataatgctacattgtatgtacataccacattttctttatccagtcatccactgatggacacttaacgctgattttgcatctttgctattataaatagtgctgcgataagcatataagtgcacgaatctttttttatacactgatttcttttcctttggataggtacccaatagtgggattgctggattgaatggtagttctatttttaattctttgagaaatttccatactgttttccatagaggttatactaatttacattctcaccagcagtgtggactcttttctctacatcctcactaacatctgttattttttgactttttaataatagccattctgactgtcataagataatatcatgttatgattttaatttgcatttctttgataattagtaatgttgaacattttttcatatgctcattggccatttgtatatcttcttttgaaaaatgtctgtttatgtcctttgcccgctttttaatggggctagttggtttttctgttgtcattgagttgtttaaagatttctctttcttttcgtttccttttctattctcttttctttctctttttgagatgtagtctcactctgtcacctaggctggagtgcagtggcatgatctcagctcactgcaacctccacctgccgggttcaagcaattctcctgcctcggcctcccaggtagctggaactacagacacacaacaccatgcccagctaattttttgtatttttagtagagatggggtttcaccatgctggccaggctggtctcaaactcggtctcccaaagtgctgggattagaggcatgagccactgcttccagccagattcctctttcttaaaaggaaagtctaatgattttaatcacactaggaattagaagtttaaatgtaaaaataagatttaaaagatgcaatgtgtaaactatataaagcataaaaatgttatttctcagcctactaaaacagtaacaattatatatgcaggcaaggctggtcttttgctcttcagtggctttagttagtacttgcctaatacctgaaggtcacagggcatttgtaagcatgtaagagttttaatcatttgtactgtactttgataaagaagggttcagtgacttgccaggcttgcagaataggtttccaaatcctgaatataacagctagagaatctgatttataatatgttaattctccgacttgttttacttacaaattagtttgtaaaatgcctttctaaatgtatcttaaaggaagaattcagaattaggagctaaaactttattcaaagtcaccatgttgtaatcacaatattcacaaagcatatgtggttatttgtaccaaaaactctacctgattatccaaattggtgtagtgaacagttccaactccgctattttatagggcaatactctttgaaagtataaaccaaattcacatcttcaagttctagaatattaaaataagtgaatgctaaaagttttgataaatattcatagacttttatatactgagctgagtttagtatttcatggtatttcataaaaataggaaagtgggggtatgacattttaacagtttttgagttatatatagtatgagcttgcaaatatttgttattgcttcacaatttttgcagaaagagattaatttcatactagattggttctatagtgttcattgtagaaaagggaataaaattaatgtgcttaatcataaccaactaaatgtgatttctcaatcacttttcctagagtggtatctctgcccttcagttcactgggatggtgactttctaaagtgtctgcccgaatgttggcacccgtggcatcggaacattgtccatgggttttctggaacctagattcaaattttatcttgaagatacatgaatttctaatgtcagttaagaaaactagcaacatttgtgctacagaaaagataaataaatttattagccttcccgtcacttgtcaactgtgacttacaatcagtgtttgaaaggtcataatgttcattaatattaataagaacatcatagatattacctttcctccccttaaacctgtactctatagctgtttaaggaagttggaaaacttttcaaaacatagattgtaatcatagcatcatgatgttcggggaagtaaatggtaacatcctttaccattaaaattgcttttcagaataatctattggaaacaatattgtagtgtgcctcaggatatttattctttccactaactcatctttgtcaagaattattttacaaaggaaatttttgaataaacttttacttcctgcatgtctgtgttttctttttgcccctttccttcttgtagttaataaaatatttatatcaaaagctattatttcatatgtgatgacatattctaagaattggtaaacacagtcttaaatagattatccataggtatttgtttttgtcatattctctgtttttaagaaaacaatttaaattttgaggttacgactcaatgtttacttaaaaatggaaggataggaagctctcaggtagaaaagtattgacttttcaaagttttacattctgatttttaacatgtgcaacatgtttactcaaagatcccattgcaaagtgaaaaagaaagacactgagtttgaaactttatgcttagaagacgtatcatgacatgctttcctaagctatattattttaaagatttcttcattcattctgaggttaagccaataaagttaatttagcagaaaagagaagaattttatagaccttgacaatgcagcctgactgaacaactgctaattattaatagttttatttaaagtatttgcttaaatctgaatatatgataacatgggttagttaattccagaatgatggatagcaatgggatttgaaactggagtttaaaaatacattttcttatgttaagatgagtgaaaatctgttttgattgtcttttagtcagtaactgaaatgaaaatcatttttaaaaaaacaaacctatatcttattatctgcctttatctgtttagcaagtctaaatgtattaacatttatagtgtaaatattatgctattaacctatcgataataaaacattgcagtctttaaaataactttttattgaagtataataacagataaaagaaaatttgcaaatattaatgtagaacttaatgatttttcaaaaaatggacataacgaagtaaccagcacccagatttaaaaaagaacaaaaaggaacattatctgcatttcagaaaccctcttccccttcactgcccttttccagtaactacactctgaaaagtaatcactttcctgacttttaatgccatagtttagctttgcttgttttggaactttatgtatgtggaatcatacaatacgaactcttttctgtctaactttttttagtcatcattatgtttgtgagattcatccgtatcattgcatttaggcatagtttagttttccattctcccattctattgttgacggttatttgagttgtttctagtttccagaaggccattatgaatagtgctccgtgtgaatcttttgaactttcttgaacttgtcttttagttaacgtacctatgcacttctgtgagtacacatcaaggagtagaattgttgtgttaggatgcacatacattcagctttaatggatactgccaaacagccttccaaggtagcatgagcattaactttgagttgtttttattcaataaagatctttcttgtgatcaagggcaaggttttgttctgttttgttttgttttgttttgttttgttttgtttttaggtcgcagataatgggtcagataagagtccatgaatacgcaacaaaatgaaactcatttggtgattggaatgattgacctgatctctgaagttgcatacaggcagattgaaagctaagaactggacctaaaagcagagtccctttagtgcttttatgagagaagttactatgatggggaaaatccagcaaagtattttcagtcttacaaagagcaatgtagagacggtatgacatttgagttaggatattggactttttagtcaacctttcctagacagccttgttcaagttacttgacctatgtaaatctcattttctttgtttgtgtaatgagactaacaatacctgtctctcaggtttagtgtaagaattagatgagattatgatatcaagtacttaagtactctgcctactatacagtattcaattaataataacattgccctgcagtctgctccatccatctgtatagcccatttagttgcttcttaatttcttcaattatctaggtttctaatcaccttcccctccatcacccagtggttgagatgcttctttggtaaaagcaaaattttaagtgagtgaccttaatggaagcttaattctatttcctttttcagtagtgattcaaatactgctctaaaagtgttttttgcttctcctccacattctttcagaagacataaggaaaatactggtatttcttttagtcttcacagaataactgacagccggtgtttgaagttgactcttcccagatagttcaatttttagagtaccaaatatgttcagctttatatagtaacttggtattttcatgaaatttaaggaaatcgttgacccttcaaattagaatgtatcttctgcttctcttctcttctcaggatgttgaaaaaatgacagtactacattatttgattaaatatcaccaggtataattctctcaaagcagttttcagaagttgttatctgaagagtagattcattatttattacacaatattctccctccttatccccattctcccccacaaaaaactcatcagaatgagcttaatacaagcaagattaagactctgacataggggagctggcaagatggccaaataggaagagctctggtctgcagctcccaatgagaccaatgcagagggtgggtgatttctgcattttcaactgaggtacccggttcatctcactgggactggttagacagtgggtgcagcccatgaaggattaacagaagcagggtggggcatcacctcacctgggaagcacaaggggtcaaggaactccctcccctagctgagggaagctgtaaagtactctgccatgagggacagtgctatccagcccagatactacacttttcccatggtcttcgcaacctacagaccaggagattccctcgggtgcctgcaccaccagggccctgagtttcaagcataaaactgggcagtcgtttgggcagacaccaagctagctgcaggagtttttgtttgtttgttttgttttgttttgttttgtttttaccccagtggtgcctggaatgccagtgagacagaactgttcactcccctggaaagggggctgaagccagggagttgagtggtctgtctcagcagaacctacccccatggcatccaacaagctaagattcactggcttgaaattctcactgccagcacagcattctgaagtcaagctgggatgcttgagcttggtgtggggagaggtgctgccattactgaggcttgagtacgcagttttcccctcacagtgtaaacaaagcctccaggaaattcgaactagttgtggaacccaccgcagtgcagcaaagctgctgtagccatagcacctctctagattcatgctctctgggcagggcatctctgaaagaaaggcagcagccccagtcagaggcttatagataaaactcccatctccctgggacagagcacctgggggaaggggtggctgtgggcgcagcttcagcagacttaaacattccagcctgccagctctgaagagaacagtggatctcccagtacagtgctcgagctctgctaagggacagacagcctcctcaagtggatccctgatacctatgccacctgactgggagacacctctgaagaggggttgacagataactcatacagaagagctctggctggcatctggcaggtgcccctctctgatgaagcttccagaggaaggaacagacagcgatctttgctgttttgaagcctctgctggtgatatacccaggcaaacaggttctgcagtggacctccagcaaactccagcagacctgcaaaaagggccctgactattagaaggaaaactagcaaacagaaagcaatagtatcaacatcaacaaaaaggacacccatgcaaaaatcccatctgaaggtcaccaacatcaaagaccaaagatagataaatccatgaagatgaggaaaagccagcgcaaaaaggctgaaaattccaaaaaccagaatgcctcttctccaaaggatcacagctccttgccagcaagagaatagaactggatggagaatgagtttgtcgaattgacataagtaggcttcagaagattggtaataacaaactcctctgagctaaagacacagtgcaagggagccaaaaaccttgataaaaggttacagaaactgctaactagaataactagtttagagaagaacataaatgacctgatggagctgaaaaacacagcacgagaacttcgtgaagcatacacaagtatcaatagccaaattgatcaagtggaagaaaggatatcagcgattgaagatcaacttaatgaaataaaacaggaagacaagattagagaacaaagaatgaaaaggaagaaacaaagcctccaagaaatatgggactgggaaaagaccaaacctacgtttgactggtgtacctgaaagtgatggggagaatggaaccaagttggaaaacacacttcaggatattatccaggagaacttctccaacctagcaagacaggccaatattcaaattcaggaaatacagagaacaccacagagatactattcctttgtggaaccccacaaagaacaaccacaagacagataatcatcagattcaccaatgttgaaatgaaggaaaaaatgttaagggaagccagagagaaaggtcgggttactcacaaagggaagcccatcagactaacagtggatctctctgcagaaaccctgcaagctagaagagagtgggggccaatttttaacattcttaaagaaaataattttcaaccagaatttcatatccagccaaactaagcttcataagtgaaggagaaataaaatcctttacagacaagcaaatgctgagggattttgtcaccaccaggcctgccttacaagagctcttgaaggaagcactaaatatggaaagaccagtaccagccactgcaaaaacaaaacaaattgtaaagaccatcaacactatgaagatactgcatcaactaatggacaaaataaccagctagcatcatatgacagtatcaaattcacacataacaaaattaaccttaaatgtaaataggctaaataccccaattaaaagacagactggcaaattggataaagagtcaagacccattggtgtgctgtggagcagggggcggtgctcatcggggaggctcaggctgcgcaggagcccacggtggcggggaggctcaggcatggcgggctgcaggtcccaagccctgccccacagggaggcagctaaagcccggcgagaagtcgagcacagcagctgctggcccaaacacagcttagcagtgctaagcccctcactgtctggggccggcagggccagctggccgctgtgagtgcggggcctgccgagcccacgcccacccggaactcacgctggcccgcaagtgccatgtacagccccggttcccacctgcgcctctccctccacacctccctgcaagctgagggagccagctccagccttggccagcccaggaaggggctcccacagtgcagcggtgggctgaagggctcctcaagtgccgccaaagtgggagcccaggcagaggaggcactgagagtgagtgagggctgccggcacgctgtcacctctcagagggagaggcgtgggtgggaaccgaggctgcgcacagtgcttgcgggccagaacgagttccaggtgggcgcgggcttggcggaccccgcactcggagcggctggcctgcgctgctggccctgggcagtgaggtgcttcgcacccgggccagcagctgtggagggtgcaccagtcccccagcactgctggcccacccgcaccacgctcgaattctcgccaggccttagctgcctccccatagggcagggttcgggacctgcagcctgccgtgcccgagtgccccctggcactcctgccctccacgggctcccgcacgcccgagcctccctgactggcactgccccctactccgggggcctggtcacaccaaccgcccaagggctgaggagtgtgggcacatggcatgggactggtgggtacctccacccatggccctggcacaggatccactaggcgaagccagctgagcttctgagtcgggtgggaacttggagaacttttatgtttagctagaggattgtaaatgcaccagtcagcactgtgtctagctcaaggtttgtaaacacaccaatcagtgctctgtgtctagataatctagtggggacttggagaacttttgtgtctagctaaaggattgtatatgcaccagtcagcactttgtgtctagctcaaggtttgtaaacacgccagtcagcaccctgtcaaaacggaccaatcggctctctgtaaaatggaccaatcagctgtctgtaaaacggaccaatcagctctctgtaaaacagaccaatcagcaggatgtgggtggggccagataagagaataaaagcaggctgcccgagcagtcaccttccggactgtggaagctttgttcttttgctctttgcagtaaattttgttgctgctcagtctttgggtccgcactgcctttatgagctgtaagactcactgcgaaggtctgcagcttcactcctgaagctagtgagaccacgaacccactgggagggacgaacaactccagacgcgccacctttaagaactgtaacactcaccgcgaaggtctgcagcttcacttctgaagccagcgagaccacgaacccaccataaggaagaaactccagacacatctgaacatctgaaggagcaaactgtggacacaccatctttaagaactgtaacactcactgtgagagtctgcggcttcattcttgaagtcagcgagaccaagaacccaccaattccggacacagtggttttcccctgcagtcaggctgcccagcagtagctactttctctaagaagttttccctgatcacccgttcttaaatggatatatccttttcctttctctcttagcaccccgtggttggtgtttatttattgacttacttacttactcctccaacctccccagccaaactttgcgtcattccatcagtcagtggcctgctggtgtctgccagtgcttgctggtgtgctcttctgctggtgtgtgttcctcccaacgtccagccgcttgtgtctgtgcccccagggtcttggggattttatagacacaagatgggggcatggcggaccagggtggtcttgggaaatgcaatatttggggacgaaaacagaaatgcctctcctgatttaggtccaatggcacaggcccagaggtggagccctcaccaggagccccacccttctgctcccagcacttccttgcccccatactatatcattaagacatacattgaagtgctatgtatctcacttctagaagtaaaacaatgtcaatgagattagaagctttatatatacctcttcctgactacatcttctttggtcttcctcaggagaaccattatgaagaatttagtgttaatcattcccatgcatgtctgttttttttactacatatgtatgtatctctggacaatttataattgagaatatttgaaaaatattattgcagtctgatatggttttgatatttgtcccttccagatctcatgttgaagtgtaatctccattgctggaggtgaggccttgtgggaggtattggatgatgggggcagatctttcatgaatggtttagcaccatccccttggcaatgagtgagttcttattctgagttcatgggagatatggttgtttagaagactgtggcacctttccctcaaaccctgctctcgtttactctctcactgtatgatgtgctggctcgcccttgtccttccactgtgatagtaagcttcctgaggccctcaccagcagcagatgctggcactatgctttgtgtacagcctgaagaactgtaagccaaaataaaacctcttttgtttataaattacccagcttcaggtgttcctttatagcaaagcatgaaccagactaacacacactcactagtttatcaagtctacctccaaaataggtcttgaacctttattctttctccaagtcagcattatctcctattcagtaacttcctatctgttcttcccacttgtcttcctgtcatttttttcccattattctccatagcatccagagaggattttgtaaaacacataaccgattacactcctctactgaaaacccttctgtggtttcccactaaataaaactcacattgtttcatttggcctgcagttattcccttccttcctccccagtggtatccaaaggtcagcctttttcctgctctttgtagtggaacactggtcttcttttagtttctggaacattgaaaacatttgtatattttttaggacagcagggatgttaatttaaaaaaaaaaagaaaaacattttttcctctttgtgcttggaatgaactactcactctaccttgctagctacttcctctaagaaattttccctgatcacccattcttaaatggatacatccttttcctttctctcttagcaccctgtggttggtgttttatttattgacttactttgtattgcttttaaaatgcctatttcccccaccagattataaatttctgaaaggaagagctatgtcttttttgtgtgcagctgaatacctagtatctaactttacatatggtagacatactcaaagtatctgttgaaggaaaataggaatgaagaagtaacggacataattatttttatcatcttcatttaaattctacaggctgaaaaataactttgctcttgagttttaagaggaaaaaataagttgttttagtttagatattttaagaaacagaaacctagacatagtagctccagtacagtgggggtttattgtaaagatagaggaaatccaggagaagttgagcaagtagacttcaggaaggacaggcaccaaagttaacctagacactcgtctgtattattctctatcaatctctatgaatcagattttctcccctctttcctgacctacctctttgtagctttgttttttttacagggcctaaaagatctctaagtatttctagtgtgtgtgtaatttaagactaaaattcttaatgttgactgcattgaaagtagacatttgataaatgtaatattaagtaaaattctgatgcatctcaagacaagctatatattagcttggcataggaatttaattagagtggagcatagcatagttttaatatagggcgtaatctttaaaattataatttggtcctcagggttgaagtggtagctggatccaaatcattttcatagtatacatttgcaggtgaggttataagtaaaagcagtgtgcaattttgacccatataaataattttaatgattattggcaaaagtatatgaaatatttgaatgcttcccattgtctagaaactgtattgggaaagcatcttctaagtaataagtgttgaaagacctccattgtaattattagtaacaacattctttcaatttataaattatctatattgtacaaaagagaaggaactcatgcagtatcagtggaagtggattaaaaatgagacctttcattgaagagtagttatttccctttaccaccttgtttcataaatatccaattttagctgataaactttcagacttactgtttaagtctcaaatatttgaggacagaatactggcaggctttactggagagtatttctgggccacacactgtactaaaagatttacataccttgtcacactattcttaccttctccaaacagactgcagcccttcacacccctcatacagttgcccaatttagaaataggtttttcaacttttttcaattcacatgggcagacgctgtgattatccttgtccttcatgtcccttagtaaataacagatggtctttgtctcttttaagaaatcctcattacctactctcattttaagacagaaatagtaatcaattcccaatatcattttgggtctttcagtccaagacttgactctgttgatctcatatcccaggtcctcctatggtctggcaagacttctccatgttaaattccttcacctgatgctcctggtattcttttccagctgcacttttcaggcacagttttccattggtatccacagggtttaaagttcccctcatcccccacagataccaaaatctgaggatgctcaagttccctgtataaaatggcataatatttgcatataacctaacacatccttccatatgctttacatcatctctagataacttataatacataatacattgtaaatggtatgtgaatagttgttatttgtttttaagtttacgttatttttattgttattatttttattttaaagatttttccatctgcagttttccatctgttgtttgaatccacatatgcagaatccaccgatagggagggcaactgaacttaattatctgcatccattgtttggcatttagtagtagtagtatttttagagacagggtcttgttgtgttgccgagagtagagtgcagtggctattcacagacattatcatcatagtggcgcactacagccttgaaatcctgggctcaggtgagcctcctacctcagtctcccaagtagctgggactgcaggtatgcgccactgtacccagctgtttggcatttttaaccaaagagtagtttaacctttttcttatttatccagggcttcttaaccatatctaaacatacaatatttagctaccagtactagaactgttgtttgcatttgttaaaaaagaggcataataggaccttctggtctcctactttttgggttgtctcaccgggactttcagaggctcttattttttatttttttctttcgatacctttggtatgaaagctgttattttttagaagtccacttgacattttgcttcttgtcctcatcctagtagtatagcccattttgctcttcttaggaatatgccagaaaatttttcataattgaataaaacaatttcctgctggtcctctggctcattgacctattggatttcagcttggaccacatcatgtctggtaattatttcttaaggcacttaaagcacctggtagtttgtttacttacttacttcgtgtagttgttctcctaacatcccaatgaagtaggtacaccctactttgtagactctaaagattcttggttatgctcattggcaggcaagaatccattttatccataagaatccttaatacagagaagaattagtgcattcttagtgtttatcatctctgttaccttgcaaatatacataaaagatccctcgttaatattaacatatgaattttaggccaggtgcagtggctcaggcctgtaattccagcattttgggaggctgaggtgggatgatcatttgaaatcaggaggctgagaccagcctgatcaacgtggcgagaccctgtgtctatcaaaagttaaaaaatttaggtaggcatgctgggcacaactgtactcccagttactcaggaggctgaggcagaggatcgcttgagcccaggagtttgaggctacagtgagctatgatagcgccactgtactccagcctgggcaacagaacgagattcctgtctcaaaaacaaacaaatgtatgactgtaaaagaatgaaagataaatatccaatagtactgattaaacctctcgtttaagtgcccttttttgttcccgttaaatagaatcaaagcacattttatctaataatgtataagctttcagcctgaaaaacagcttaaaataagtgactaaggttgaagctaatatgagtcaaccttaaaacatgcaaaatttttacaaaaaacaggtcacctttagatgccaggtattactttgcctattcaccaatctagatgtattatctaattcttgtcttagaccttacatttttttccaaaatcagtatagttgctttctgtttgtctggtggtgaaccgcatgataactttacaagtactgctggttctatgagagtctttttcttactatcagaagagcatggtaacagtccaatactaaaagaaaaaggaagtacgttagttgattataccagtgaatcttgaagaacatatcaagtaattcttttctccaaacttcaaactgttatagttcacacggaactaatcttgggtagggaggcagatggggtgggcttcctctgtctgctgcttcctgtcccagttgctcctcaacagtaacacctgagtcttcttagccacctttctcagtacctcaggaaacctctgtgaagctttctttctccttacttattcctccagactctgttgtcttcttctttcattcttctgttgtcttcttattttattcttttgccctgtggtcttccttccttttaggtttttggtttgagttttggttattcaatctcacctaatttcacctgggaaaatttttgagatccaatcaggttgaagaagaaagggaaagaaaaccacttagcactagtccctcaggatctaccgtatataagccaaacagacattctcctctgccagaatgctcatctgttggcataactttgttcctaagaatctctacctcacttctctgcttagagttgtattataaaagacccccttctattatcctgggtcaataagtgcacaagctcaaaaggaaaagaagggatgtgctgtgccccaagaaaggatgatagaggaagaaaaatcctgtcctggctcgtctgatgtctcagttggatattacccaattcttaatgtttaataagcccatttatttttgaggcccttggcatcatttgtcatcgtgtactattttaatggcaataaaacgttcctccagctgtatcaggctgagtgtaaggatggtggagacccaaagcagtttacatgaaaccctccatgggaaggagaggagagaaattcaggatgaaactacagccacagccagaatggtggactgaagtaccagtgttccctcagatgggggaactcctttatagtgtggtaggttttcttttcttttcctttttttttttttttttttgagacagagtttcgctcttgttgcccaggctggagtgcaatggtgccatctcggctcaccacaacctctgcttcccagcttcaagctattctccttcctcagcctcccgagtagctgggattacaggcatgtgctactatgcctggatatttctgtatttttagtagagatggggtttctccatgttggtcaggctggtctcaaacttctaacctcaggttatcctcccgcctcagcttcccaaagtgctgggattacaggcgtgagccaccgcacccggcctatagtatggtaggttttctgaggccttctttataccagtattaaaaatgaatttttaaaattgtgccagaattaagattttttatctatttttctccaagaattattagccactttaaaagatatctttaataattaaagataaaattggattttatttgaaaagtactgataaacctgaattacatgttacgtaatatattaactgtcttcctatcttcaaccttcaaatctataatagactcgatatcaaatagtactttgaacccagtagagtttcacaacctttcaagtgtagaaccaatcagtcaacaagcatctattaaatctctctaagttcaagaaaagatcctttaatttaatctagcatttggataaaacccttgaaaaaattggttgttggttacactttttctacttttccttaatggggctacttaaagatttatttaggtcagatatggccaactcaaatgcacaaaaatgagtgaaatgtgctaggtataagacaagatggagtattgaggactgggatgaactgcagagtacatattcacgtaaaggaactcaaattcaatttttataaaaagctgaggccaaatagagtgtatcatcagtccaaattcagccaaaggctgcagtttgtgacctctgatttagatagcaagatgaaatattatttggttgggatttttggaggtggtaggagtgactccaaatcataataaattaatatatatgtactttagaagcccatattgcaagacttgtatttatgatggctataatatatattgataaaagagtaagtataattatgcctagaagcataagacagtatttctcaaagtgtagttcatagcaactttcactagaataatttgggaggggtgggagagggactatttcaaaacttactacaaagctatagtaatcaaaactgcatggtaatggcataggtgtaaatctatagattaacagaatggaaatacactcacgtatttgtgggcatttgattttcaacaaggatgccaagacaatttagtaaggaatgaatggccttttcaacaaatgttgctgaggtaactggagatagctagctagctagatgtagatagatagatagatagatagatagatagatagatagatagacagacagatagttggtttttttttttttgagacagggtctggctctgttgcccaggctggagtgcagtggcacgatctcagctcactgcaacctctgcctacctctgcctccagagctcaagcactcctcccacctcagcttcctgagtggctgggactacaggtgcatgccactatgggcctggctaattttttaattttttgtagagacagggttttgccatgttgcccaggctggtctcaaactcctgagctcaagtaatccgcccacctcagcctcccagagtactaggattacaggcttgagccaccggtcccggctggtaactggatattgacttataaaagaatgaagttgcacccctacttcacacccctctctccatataaaagaatgaagttgtacccctacctctatggcaaatccatagagatagaaagtagattagtttcctagagttgaagagaggagggattgacgagtgagtgcttacaggaaaaagttttcttttggagatgatgcaatgttcaggaattaggtagtgatgatggttgtacagccttgcaaatatactaaaaaccaactgaactgtacatttttgaagaacaaattttatggtgtttgaattacatctcaatgtaacaaaataacttgaagcaggagagattgctcattaaagataaaaattctagaggtcatcttagactcaagcttctttgagaatatggctctagaaatctacaagtttaacaaatatactcaggtttatttcctaatgactaggaaatactgatttaacagttgtgtatacttgtacattgaaatgtgtttaggctaaaggacatgtgctttttgatcattttaatcatcagcagcaaagagttatgtggtattactttctgtcccatatgagagttatcagatgataaaggtgtgatgctttctctggaggaacaagaagacggccatacatagaagcatgaaatggtgtactttttcatttctttgaatttgttactttggcaaattctgggaagaaagataataattcaacgtaatgaattcagagaagcacaaaacttaagggaaatatccagcaatatttctgtggttgctttgtttttagtgtttattttggggatgaaaaccttggtgtgttgatttttctcaaggctttcttggtcatgtgttactgtgggcctttcaacaaagccaagttgacagagaacagatgcatattttaataactaaacttcctcagcaatagtatctggatcagattggtttcacagcagtgttgcagcaggataaattataattaaaaataggcaggtattttatttcatgaagatttaggggaagaacaagatggaactttttagagttagcagttaccaaataggggaatgaaggtagatctgcaatttcccagtacaaagtatttgggggcttattcagagttttacttgcactgagttgataaatggtatatgatcatcagtagtatcctataaatattaaactgtaagtctcttttgaaaatctaaaattactcctttttctaaattatcaaaggttttaaaacatcaaattcacaaataccttttttatttaaagagaaagtaggatttgatactcaatttttttgttgttgttgagacggagtcttgctctgtgtccaggctggagtgcaatggcgccatctcagcccactgcaccctctgaatccctggttcaagcgattcttctgccacagcctccctagtagttgggattacaggcatgcgccaccatgcccagctaatttttgtatttttagtagagatggggtttcaccatgttggccaggatggtccccatctcctgaccttatgatccacccgccccacccacaaagtgctgtgattataggtgtgagccaccgcgcctggccgatactcaatttttttatggttgatgccagtcacacttactttggctaatcctgtttctttaacgataaaaatagatgatgaagcttaaaagattctacacttacacgaatggtatattatattgttttgttatatgtaagatgtacgaaaagtactttgtttaattagggtctcggaacatgaatatgactagcttttcccatttttccttttttatcgcaagcttctttttttttttgagacggagtttcactcttgttgcccaggctggagtgcagtggtgcaatctcggctcactgcaacctctgtctcctgggttcaagcgattcccctgcctcagcctcccaagtggctgggattacaggcgcccaccaccacgtctggctaattttttatatttttagtagagatggggtttcatcatgttgtccaggctggtcgtgagctcctgacctcaggtgatctacctgcctcagcctcccaaagtactgggattacaggtgtgagccactgcacctggcctttatctcaagcttctaccagtagtgataaatggctagcaagaatcttctatgccttagcctgaaggagatgggttccattaccaatcttctttcttccaaaatatagaacttcaggtatttgcccgaggctgcaccctcagccaatattttggctctattttggcctcagccaatatgttgtgctctatattaggcaagtcacagtacatgatggagacacagaactgatgaacattttcaaaaggaggcatgctggagtgattcaatacaaataagatagacagactcttgcattatgttgacccataggaatttgctgggtttttttgtttgtttttgagaaggagttttcgctcttgttgcccaggctggagtgcaatggtgcaatctcagcccactgcaatctccacctcctgggttccagtgattctcctgcctcagcctcccaagtagctgggattacaggtgtccaccaccacgcctggctcatttttgtatttttagtagaaacagggtttcaccatgttggccaggctggtctcgaactcctgacttcaggtgatccacccacctcagcctcccaaagtgctgggattacaggcatgagccactgtgcccgtccaaaatttttgtaagtcaaaattttttgaatattggcagtttcctgtggtgcatcctaatattatactgagagtagtgatatgttggagataaggtcgtaagaacaggtaatacctaatctaaactgggagaataactactgttcaatcccactattgggccatagtagtcactgtttatataataaatgagtgaagtcttctgtgatgtcttttcgacacatgtattcagtgtgtattatgtatctagtagtctcccaatctcaaagcttctttgaagttgcatatcatatatttaaaatacatgtaaaatttgcagtttgctgcacaatagagccatagttgtcttagtacaaatatttttttcacatgtttaagtaaaacttgtccaaagagatatagcatatttgccttgtttttcccttttcttacacacagctctttgtacctcaggggtttgtcataccataatttgggatgcattgttatataaataggaggccactgaaagtttaaatcaaggtaatgccatggtgaaattgatgtttgagaaaagtaattctgagagagtcaaaatagttgtgttgtgatagcaactggcatatgtgcattaaaaattgaacattaagaataaatgctgacattgtggattatttgttgctttcataagtttgtcctctagcacttgtgctttttatcttttgtattaagtatgcattttaagagtaaatggtataccaccaaattgtctaacagtgctacatttttgtggaatcttgggggagggatcatatatagttaaaattttatattagattttcttttatagccatttacatgatgtggctttttatatttggaggacaaaagaattcatagaatacattaatgtgttacatgatgtcagcagataactagatttctaaaggttaagttattaaaggcttatatggaaatctaaaaagactcatgagtaattacttttaaaggcattgaaaggagtgaaaaagtgggtgactatctaattccagacatgaatatgagacagactagtacttatagcagtttggaggatgccagagaagccaaaaagggagcagcatatgcttccaaattgttttgaagtgaggctttgtcttttctctagaaaaatagataatatctcatcaacttaacatctagaggaccagagatattcactgaaaggaatgctttttattcattcaattattcattcatttattaaatattgaacactttaatgtgctgacactgaaatagtcctaacataacatatggttaatagaacagacgttgtctttgcatctatagtgctaatacactaatgggcagataataaatacaaaaaatatatatgactatatattataataaatgttatgaagggaaactacaagttacttcaagatttggtaacaaggaaatctattttagattagggtttcaagaatggtctctctgagtaagtgacatttaaagctgagatctaagagacgagtaggagaaatcacggtgatgagtaggggaagtgcatgcttgaggctcttgggtggcaggttctaaaagaaagccagactttctagaacacaagagcagttggccaagaggtaggtaggacccaaattataccagagcttggtggccatattgaggaggacatgggatttcattctaactgcaggaaaaagccattgaagatctttaagcatggaattggatggagtgacttaagtgtttcagagatgactatggctgttgtgaatgcattgaaggggataaggagaccagggaaaccagttaggagctactgctcgggtaagagttgatggtggttagttgaatgtatcagcaatgaacttgcaattgaaggtcaaagctaactttaaattaaactcttaagaatattattggtggtgtgtctcccaagaaaaatacctgtctaagaaaataggaaacatcatccccaaaagactaaatacgtagtgtgaaggttgagaaagaggaatatattgcagggaaacttttggtgaggtttatttgttgttgttgtttacttccaaaatatggtttccatttttctcccccataagttttctatttgggaaaagagatttagtggaattataaactgaaagaattcatgtataacttttgcctcactttactttttattttcatttttaatctttcatttttttccttctataactttcttgtctttgaaaaaaagagtgcaggtgccttatgtgtccaagaatgaaatagcctctgaagtactatctgtttgcttgctagcttgctggcttgctgggtcaaagaaaaggaagggctcgtttatactgtaacagtgtttttatttagcatgcctctgaggtttttattgtgttctgggacagtgtttatgacattggaagttaaagaaaagaattgcaatgagttggggggatgggggagggatagcactgggagatatacctaatgctaaatgacgagttaatgggtgcaacacaccaacatggcacatgtatacatatgtaacaaacctgcacattgtgcgcatgtaccctgaaacttaaagtataataataataaaattaaaaataaatatatttaaaacaaacaaacaaaagaattgcagtgagtttgagtgacacaaaaataaaattcccatgataattcaataccatgaattatctttattgagtgaaataaattctgagggtatagtaattattttatggtccttttgtattagatttgtgtttgcttaataatttagcactttgaattttctctttgaatttttattcttccagaaatctttgcggggttggagttttcatattgtgacttttgggctaacatctctctagctcttcttattagttaattttcagcagattttttttttctatattgcccagtccagtctcaaagtcctgggtttatgcaatcctctctccacagcctcccaagtgactcactgggattacaggtgtatgccaccatgcccagccttggaagactttttataaattagggtacatcttttttttttatttttcacataattttgtttttgttatcagcaaggttgaatcaaaagtaacttcctttcctggtggtctaattgctaggataaagagagggaaaaaaataacttcatcattactgaattatcaaaatgaggtcttttaatttatctattactattataaggctagttagaaaatttaagtcattttctaagagatagaaattttgttagcttgatttttctgactttttgtcattccttctcttatgtatggtgccatctgctgtttgtgggaagtattttatattttgaagcactacacataatagaaatacagtgtctaaaagaaaaatgtcaaaatacatgaaatgaaaaaagcagtagtgtggcccgtttgaaactttgtggcctgtggcttgtttctttttatgtaaaaattatttttatatctgattatttttagtacttacatgaatcacaagattttggtactcatcgtgttctgtcttaattttgtttttgctcagaatagaagtaatcggtaaacatttgttagttgactcatttggtttgttttttgtgactcctcaggcacctttcttgtaagcttctgcttacagtctatgcaaccttaggcaaataatttcagcccttagcacctctgtttccttctccataagaagaagataataatatcaatttcttaaggtttttctgaggattaaatgagataacacttgtcatatgcatagcacaatcctttcctttcgctaaaatgttgtttccaggttcagtgagtttcccttttaccttatttcaaagacacctttgttaagaatcagatttcattgctataggatcataaactctttgagccagaaggaacttcagtaagtgggcctcaaaatgttagcatgcatttgaatcatatggtgatcctatttaaatgctgattcggattttattggtggttataggatatggaacctcatagtctgcacatctaacttttacttaagcattgctgatactgcccccacagaatgccttttctgtagcaaagctttggaaaacaacaaacagaaaaacaactagtaaagatggagatggatgggaagaggatgactgaaaggtataaaattacaattagaaagaaagaacaagttctggtattctattgcatggtagggtgactatagtcaacaataagttattgtatatcttaaaatgacaagaataaaaggttctgtgtcttcacaccacaaaaaaatgacaaatgtttcaggtgatggatatgctgattagcctgattttaacattacacaatgtatatgttttgaaacatcacattgtaagcaataatatgcacaattattatgtgttacttaaaataaatttttttaaaaaacaaaagaaaaataatccaccaaaatctgattttcttttttgggtaatctcatgtgccagtcatcagaactgtatttctttgtagaagaggaaaggaatccagagtctgtctccagaagacattccagactaatttcttattctttactctcagcactaaattttattagtcagcagttacattttgtcatttctaccaatgttatacagcagtaacattgctgagagaaattattaaagagaattatattcaaaacccagttatttattgtccaagcattatgacctacaaatatttaattggtatccatttaaaattcaactacaacttttatttctatttgtaacttgttgccttgttctttactctttaaattgctttaaatttttacagcattaaaaaatgaaaagctaaacaaattagcaacttcagtaacgtttcaggttacaaaatcaatgtacaataatcagtaacatttgtatacaccagtaatgttcaagctcggagccaaataaagaatgcagtcccctttacaatagccacacacacaaaatgcctaggaatacatctaaccaaggaagtgaaagatctctacaaggagaaccacaaaatgctgctaaaagaaatcacagatgacacaaacaaatgaaaaaacatttcttgttcatggattggaagaatcggtatcattaatatggccatactgtgcaaagtaacctacagatacaatgctattcctatcaaactaccagtgtctttttttttttttttttttttgagatggagtctcactgtgttgcccaggctggagtgcggtggtgtgatctcagcttactgcaccctcccaggctggagtgcagtggtacgatctcggctcactgcaacctctgcctcccaggttcaagagattctcctgactcagcttcctgagtagctgggactacaggcgcaagccaccatgcccagttgattttttatttttagtagagacagggtttcaccacattggccaggttggtctcgagctcctgacctcaggtgatccaccctcctcagcctcccaaaatactgggattacaggagtgagccaccgtgcctggccaccagtgtcatttttgacagaactaaataaaactattcaaaaaattcgtatggacccaaaagagcccaaatagccaaagcaatccaaagcaaaaagaacaaagctggaggcgtcacattacctgtcttcaaatatactgtaaggctatatagtaatcaaaacaacgtggtactggtacaaaaatagacacatagaccaaaggaacagaatagagaacccagaaataaagatgcacacttacaactatctgatctttgacaaagtcgacaaaattcagcaatggagaaaggactccctattcaataaatgatgctgggatagttggcgagccatatgcaaaagaatgaaactggacccctacctgtcaccatatacaaaaattaactcaagaaggattaaagatttaaatgtgacatcacaaactataagaatcctagaagaaaatctaggaaacaccattctggacatcagccttgggaaagaatttatgactaagtcctcaaaagcaattgcaacaaaaacaaaaaattgacaagtggaacctaattaaagagcctctgcacagcaaaagaaattatcaacagagcagacaacctacagaatgggagatgatatttgcaaagcatgcatctgacaaaagtctaatacatagaatctataaggaacttaaacagttgaacaagcaaaaaacaaataaccccatttaaaaaatggacaaaggacacgaacagacacttctcaaaagaagacatacaagcagccaaaagacatgaaaaaatgctccatatcactaatcatcagagaaattcaaatcaaaaccacaatgagaccatctcacacccatcaacatggctattattaaaaagtaaaaataaataacagatgctggtgatgctgtggagaaaaggaaacacttatacactgttggtgggaatgtaaattcagttcagccactatggaaagagcttggcgatttctcaaagaacttaaaacagaactaccatttgacccagcaatcccattactggatgtatatttaaaagaaaacaaataaaaagacatacacttacatgttaattgcagcactatttgcaaaaacatggaatcaatccaggtgcctatcagtggtgaattggataaagaaaatatggtacacatataccacaggatactttgcagccacaaaaaagaacaaaatcatgtcgcttaaagcaacatggatgcagctggaggccattatcctaagtgaattaatacgagaacagaaagcccaatgcctcatatttgcacttgtaagtgggtgctaaacattgactactcagggacataaagatagcaacaatagacactggaacaactctagactaatagaggaggggaggaaaagggtgggaacaagggttgacaagctaactgttggatactatgctcagtacctgggtgatgggatcattcataccccaaacttcagcattatgcaatatagccatgtaaccgacctgcatatgtatcccctgaatctaaaataaaagtcggaaaaaaccccaaacaaattagccccaataactctctgtaaattctagagtaattacttgactccaataagacctttttttggtgagttggatatacaatgctattctcttgatgtttggattttccccgaaactggttaattatgtttaaaactgaatacccttaagtccagtgccccagtgtgggttcaacaggataaagtgtctatccacagtattctctgagaaggaatcctttagttttagccagagagtcatagagttgttcacacctgaggaatcatccagcttagttacacaagttcaaggtcctaaaggaaattaaaagaggcataaaatgacttctcagaaatgtatagattgactaaaaagtaaaaattgtggcctagaaaaaaaacttaatgagtagaaagttttttccaaatgaaatcttatgtataaggacaatactaccctttcttcctacctcccctgaagtgatggtaaggagtatcttgctattttatttttattttttgaaagagcatctcgctctgttgcccaggctggagtacagtggtgtgatctctgctcactgcaacctctgcctcctgggttcaagctattctcctgcctcagcttccccagtagctggtattacaggtacacaccagcatgcccacctgttttgtatttttattagagaaggggtttcaccatgttggccaggctggtctcgaactctgacctcaagagatctacccgcctcggcctcccaaagtgctgggaatacaagcgtgagccaccgcacccagccagtatcttgattttatctggtgtagcccagtgcattcacaagcattgctgtaagactacacaaatgtcatgaaagctactaggatttgtatggacaggttgcactatcatcctgtctggatacttgtcatgtttaagatttctagaaaaggaacttacccagtgtactttgataactttttcttgatttttaattcttttgcttttacatctgtgaaaaatagatcattataatacttttgaggtattttttttctagtggataatctgaatgcaaaatcaaccaacaaaagaaacaaacaaaaaaaccctgttataccctggaactccaacttgagaattttcttttccttgccattcctggcttccatcttcacagtcattcgtagactcaccctctctttaactttgcaagatctctggcaattattccagtcctaaaaggctagattctataggcatattctgtaaatgcttcttggttttcagactgtgtcatggtaatgctgttgccttccttgctacatcttctgagaactagaacttaaggacttccatgtctctgtacacttattcaatctgttcttattttaaaatcagaaaaaacaagggactatgtttctactatattcaaatcataaagaattatgggctgggcgtggtggttcacacctgtaatcccagcactttgggaggccaaggcagatggatcacaaggtcaagagattgagaccatcctggccaacatggtgaaaccctgtgtctattaaaagtacaaaaaattagctgggtgttgtggcgcgtgcctgtagtcccagcttgggaggctgaggcaggagaatcacttggacctggaaggtggaggttgcagtgagccgagattgcgccactgcattccagcctggcgacagagtgagaccccatcccccccaaaaaaaaaaaacatggattgttagacttgaaagtaactctacaggtagtttaagccaataccccttatttaaaagaagagaacttaagtatgacagtaaaagttgtaagaaccatgactgatctcaagcttaaagccggagcagatagtttagcttagcattagggcttaaagttaatactctaagtagattaggtaattctttaatagtagactgtggtatttggacctatgctacagaattctgtctagttttattttttagatgatttataagagtcttgaagatagtttataggtgaacaaacgaatttaaaattagtacgcatgagaacacatcaaaggaattaagaatatttccttaaaaaggataccttcaaaggcatcttcagtaacatgaaaaattcaaccaagtgttctctactctatttttttttaggatagtacaaaggaagtaaaggcataatatagtaaaaagaacagcagcagttaggtgtgaggcaaatccacacaatgaagctggtgaacactagaacaggagggatatttgccttcctggttattttcctcaaattctctgcttattatcaatatctgtttactgtggttgggatttagcatccaaaggcacgaatggatgcacttcccaagactctgtcctgtttagtgatatttcatggtctatttaataaactgtttgggggactttaacatgataattgtcagggcatatagtgcttaactgtgtgtcagacacttttctaagtgtttttttatatagtaactcatttaattctgaaaaaaaaaccctctgaggtatctataaggaaatcgaggtagagagagttaaaataactctaagtcatatagttaggaggagatgcaaagttgattcagacctaggaaggctggctccgagtctgtctcataaccaccatgctttattgcctctccaaaaaagaataaaaggaggaagcggtcagacttcaagggaaataaaatttcttttattttacctagatatctctagatccgataacagctgggaccaagatatggcaggctgcaggggtcaaggagagccagcaagcagtgaaacatctgcctccctctccagcttcatccctcacatgcactttcgtggtcccatccctcccagatcacaggcagttctgcctgcttcgtttctctctgcctttacagatgctatgcttttggtttgcactgctttcctcccaatactttaacttgaccaatttgtatttatttctctacctctttcaggcaaaactgctttgtaagcatctactgcattgtgaaacatttccaagtttacccaagaagtactgatctttctacctttgggctccccctgtcccctaaatatccctcctttttttgtactttcatcactcatttgacaactatttatttagcattactatgtgccaagcactattctggacactgaggaaatcagtcagtccaaatttctgacctaataaaacataatatctaagtggggaagaaaagcaagatttggaagagaaatgataggatttgatgtctcccttaaagggatcactccggctactgtcactctagagaaaaggagtcactctggagaataggctgtggggggtcaagagcaggagtgaggagaccaggaaactgttgtgttaatccagatcaggaggtgatgatggcttaggtaagggtgggagcagtgggaatggtaggaagtagttgaatttgggatatgtttaccaagtagatccaaaaagatttgctgatggtttaactgttcgttgtgagagaaagaaaggataattctatgattttttgcttatgcaactagaggaatgcacttaccattgaagaagagattggaggaagaacaggtttatggggaaaataaggaattcagatttttacatgtttttgattcctattaggacatccaagtagagatcttaagatagttgaatatatgattctggagttcagaggagatagtgaggctaaaacgttgatttgggagttattagtgtatgctatgtatttaaagccacaagacttgatggggtcacctagaaagctagctgacgaccaggtatgaccatagggaactcgggagatggtagtattcagagcaaaaggtagttcagtaaagctttcaaagccccagccaaagggatagaatttagagtcaggacctcattaaaaaaataaaaataaaaaggaactgaaaagagtgaaatgagatgcctgttctaaacaggcctggagatttgagcaagttctcaggacagcaactagaagaaggtaagaatccagaaccagaactcaattaggagacagaaacttggtcttaggagaaagtcagatgccatttattataaatgaggcacaagatcagagataggatctaatcaaacatatattgatgttcagcaccttgaatgttggattgtagaactctttacttttccactgggaccatgtgccagatcattctttatgccatgagtcaaccagagctggaggcatatcatgggttgaccttcgttcatcatgtccaatagaaatagaattatttaaaatacaaataatttttgcttatttatatgcctaaaattcttgcacctttcctactaattcttcagattgcattgagtcacacttatgcttatttagtcttttttttaagtgggaagtatgctcatttaatttgggaaattaggatctctctcttttttttttttttttttttttttaagatatggggtctcactttgttgcccaggctggagtacagtggcacaatcatagcttactgccgcctcaaattcctgggctccagcaatcctcctgcctcagcctctcaagtagctaggactataggcatgcaccaccacaccaaactaattttaaaaacatgtttgtttgttttttggtagagacagggtcttgccatcttgcccagactggtctcgaaatctgagttcaatcagtccttctgcctcagcctcccaaagtgctgggattacaggcgtgagccaccatgcccagccatcttatttttttataatccttctcattccttaagaaactgaaaggctggaagcttctcccttgaatagaaagcttcccagtttccagtcacctagataatagggtcaactcaattaaattaattcttaaagatgtataaacaggaaatcgtggtctttgcattgctgtaaagaaatacctgagaccggggctgggcgtggtggctcacacctgtaatcccagcacttttggagcccaaggcaggagaatcacttgaacctgggaggcagaggttgcagtgagctgagatcacgccattgcactccggcctgggcaacaagagcaaaactccatctcaaaaaaaaaaaaaaaaaaaaaaaaaaaaagaaatacctgagactggataatttataaagaaaagagttttgattggcttgtgattctacaggctgtacaagcatgactccagcatctgcttctggtgagggccacaggaaagtttcaatcatagtggaaggtgaagaggagcagcatattatatggcaagggaatggggagataccacactcttttaagcaacaagatctcatgtgaaccaccagagccagaattcactcatcaccaaggggatggagctaagcccattcatgagggatacacctccatgatccaaacaccttccaccaggcttcacctccaacattggggattacacttcaacatgagatttggcgaggatgaatatccagcccatgtcattctacccctggcctctcaaaccctcaaatctcatgtccttctcacactgtaaaatccaaccggcccttctcaatagttgcctcaagtcttattccaacattaactcaaaagtcccaagtccaaagcctcatctggagatgagatccttctacctgtaagtctatgaggttaaatacaagttaaccattcccagttacaatggtggtacaggcactgggtaaacattcccattccaaaaggaagaaattggccaaaagaaaagggtaacaggccccatgcagttctgaaacccagcagggcagacattaaaccttaaagctcctaaataatccttgtttccatgtcccacaccctgggcacactggtgcaagtggtaggctcccaaggccttgggcagctctgcccctgtggctttgcagggtacagcccacatgactgctctcactagatggaatgcctgtggcttttccaggctgaggattcaagctgcccatggcgctaccatactgtggtctgaagggaaacagcctctttcctgcagcttcactaggcagtgccctggtggaggactctgtgtgggggctccagccccacatttttcctccacactgccctagtagaggttctctgtgcaggcgctgcccctgtggcagtcttctgcctgggcactgaggctttttcatacatgtcctgaaatctaggggaaatctgccaagcatccttcatgcttgcattctgtgtacctgcagacttaacatgacatggaagctgccaaggcttatggcttgcaccctctggagcagcagcctgaactgtacctgggcactttgagccatgactggagccagaacagctgggatgtgggaagcaatgttctgagactgaccaggacaatggggccccgggcctggcccctgaagccattctttcttcctaggcctctcttcctatgatgggaggggctgtctccaagatctctgaaataccttcaaggccttttgcccattgtcgtggatattagcacttggctcccttttagttatgctactctctttagcaagtagttgctccatagcctgcttgaattcctctcctgtaaatgctttttcatgctctgccacatgattagactgcaaactttccaaacttctttgttctgcttcccttttaaatataggttccagttttaagtcatttccttactcccatatttgattgtaggttgttagaagcagccatactacctctagaacactttgctgcttagaaaatttttccaccagataccctgttatcattaagttcaaacttccacaaatccctaggactcagacacgatgcagccaagttatttggtagggaataacaagggtgacctttgctccagttcctaataaattcctcattttcatctgagacatcctcagcctggccttcactgtccatatttctatcagcattgtggccacaatcacctaacaagtctctaagaagttccaaactttcccacatcttcctttctttctctgagccctccaaactcttccaacctctacctgttacccaattccaaagctgcttcccacatcttcaggtattaatagcaacccctcactccttggtaccaatttttatgttacaccatttttgcacatctgtaaagaaacacctgagactttgtgtaattttcaaagaaaggggtttaatttggcccatgtttctgcaagctgtacaggcatggcaccaacatctgttcaactcctggtgagaacctcaggaagcttacaatcatggcagaaggtgaaggagaaccagcatatcacatggaaagagcgggaccaagagagagatgggggatgtgccacacacttttaaacaaccagatcttgtgtgaactaccagagccagaattcactcatcaccaaggggaaggtgctaaggcattcatgagggaaccacctccatgatccagacacctcccaccaggtccccccttcaatgttggggataacattttgacataagatttggaagggacagaaatccccaccatgtttggtggcatcatgggctgacattaatacatctctttaatgggattggaagttaggagatgtttcaaggaggagattaccttgaactgagctgtcctggtcagttggccatctgagagaaagaaatggggtccctgccacaaggcgcctgggaaattaaatcccagttagagaaataggaagacactcaggaagtaatcagaaagacacttcactggttatttccccccagcagttttgctgcgatgaatttcaggggtagaagcaggaatggtggaataaggaattggaattcaggcctacttgtataaggccctcctcagttgacctataccagtatttctacatttttcttatttgacttctcttaccttgtaaaatatatagaaatcagtggtttctagggtctgcagagtggggtgggtggcactaaaatacagtagatgttaatacccgtcttagacttaatgaatcagaattatccagggtgggatccaggaatctgaacttttaacaaatctcttttgttattcttaactggtactcctcaatttactgtttaggaatcttacacatgggggaggttgagacacttaactaagctagttggtggcagaaatgaaactgtgatatggatcttctaactcctgctctaaagcttttgatttatagtatagtattaatgaacttctattgtgaacttgcagaccgtttaatattaggttcaatatactatgtttaaatgggaatgaatttcacagggcttatagagcctttccccataattgtaaaatttttgcagcaaccgctatattactgttgctacaattttctttgctaattaggtctctttgccttgtagctctcacttttaaattgtttttgttttgtcatttagtagatctcagagcaattaactaaactaattcttccatctttttttaaatggagacatctcctcctcactatggcaggaagatctgtgatttctagtataactgcttgatgtgaggacagggttacttgggaaagaactttcagcatgagtgatttaattatctgcctccattagataggtacctttctcttgcttggctcctaataaaggaacaagcactctcatccattttacggtttaaataaattttacagttaaatatgactagatatacttttagtacccaaagttgtggatattttgttccataaaagctaattactaatagaaaatggtttgctagataaattacttaactgaaaatatactagaagcttatttgtgctttctaaaaaagttgataattatgattcactggttagaagttgtagattttacatatccctgatgtatagatggataagtgcaaataggaaaactatgctcttaaattatcatgattgcttgaaaacttggtaatgctcagttctcagtctggtttcatactagaaactcctggaagttcttaaaaatacaagtgaccacattctactcctgagaaatttctatttatttgacctaagatggatctcctgcctctgtgtgttatgaaagctccccaggtgattttaataagcagccatggttgagagccaatggtctaatggaaagagaactgaattataatcaggaaacttgtcattccagtcttaattctgtgaactcaggtaaatcatctaacatatttaagcttgcattgtaaaatggaggtaattaataatggcctatatgccggattaatatttttacagttgaatgaaactatatactcaaaagtgctttgcagtaaagtgttatacagatggtggcatagcaattaagatttactacgcaatatactactgtgaagtggtatgtttagtcttttgtacttcttggcagaaagatgctagatcccctgtggcagaaagaaacttaggctccttagcgatcctcagggtatattattatgattcttaaagttcactctgtatttttatgtgtaccaggctgctagtgtctctaggtgatagggggaaaaggtagaggaaagggtggagttgctcctgctggtgattttttaaaattgtgagttcctataattagtaacatccttcttacatcttcatagagacatggttggtagcagtggagtcgtttatataactttacaaaccctctcttgtgtactctttttcaatgttattctcttaaatcacttctgtctctgctttccctagtgtttaagcttcactaacatttacctatatataaatggatgaggacagaagagaaagggtccccaaagatgaatacactcattactggtttcccaacatgatataaacctaggacttcaccccttggagggatgaaagtttactatgcatagcatttcctggtgtgtcagtctcggtacagcctcttgctcaattcatcagctgtttccaggcaaaattacataccacttcttgagtgttttaaagcctcctaactgtatatatgtgagttctttgatatattgacttctttttctttgagtcgattcccagtagtggcattgctggatcaaatggtaattatatttttatttttttgagaaatctccatactgttttccatagtggctgtactagtttacattcccaccaacagtgtatatgagttcccttttctccactttcttgtcaacatctgtcttttttaataatagggattctggctgaggtatgctatctcattgtggttttgatttgcatttctctgatgattcatgaggttgaacattttttcatatacctgttggctgtttgtatttatttttttgagaaatggctattcatatactttgcccaagtatgaatgggattatttgtttttttcctgttgagttgagttccttatctgttctatatattagttcctgttggataaataatttgcaaatattttatcccattctgcaggttgtctcttcactctgttgatttttttgttttgtttttttttttttgtgtgtgggagctttttagtttaattaattcccaatcacttatttttggttttgttgcctgatcttttgaggcctttgtaacaaattctttgcctaaaccaacaaccaggagagggttccctagattttttcttctaatatttctatagtatcaggttttacttttaagtctttaatctactttgagttcatttttgtatatggtgagataatggtccagttacattcttctgcatggctatacaattttcccagcaccgtttattgaagagattgtcctttccccagtgtaagtttttgttgtttgtttttgtgtttttttgagacagagtcttgccttgtcacccaggctggagtgcagtggcatgatcactgctcactgtggcctcaacctcatgggcccagatgatccccctgcctcaccctcccaagtagctcagactacaggcatttgctgccacacctgactggtgttttattttttgtagagatggggtctcactctgttgcctaggctggttttgaactcctgggttcaagcaatcctcctgcctcagccttccaaagtgttgggattacaggtgtgagccactgtacccggcccccagtataaattcttgttggctttgttgaagatcagttggctgtaactatgtgtctttatttctgagttctctgttttgttctactggtctatgtggctacttttataccatgttgtggcatttttaaggattttttttttaagtggggagtttgagaccagcctgggcaacatggcaaaagcctatttctacaaaaaaaaaaaaaaaaaaaaaaaaagtagaaaaattagccaggcatggtggcatgcgcctatagacccagctacttgggaggctgaggtgggaggattgcttgagcctggaaggttgaggctgtggtgagccatgatagcactactatgctccagcctgggtgacagagcaagaccctgtctcaaaaaaaaaagaagaagaagaagaggaagaggagggggaggggggaggaggaggaaagaagaagaagaggaggagggggagggggaggaggaagaaagaagaagaggaagaggagagggagggggaggaggaggaaagaagaagaagaggaggagggggagggggaggaggaggaaagaagaagaagaaagaaaagggggccagatgcggtggctcagcttgtaatcccagcactttaggaggccaaggcaggtggatcacttgaggtcaggagttcgagaccagcctaactaatgtggtgaaacccatctctactaaaaatacaaaaattagttgagtgtagtggcgcacacctgtaatcccagctactcgggaggctgaggcaggagatttgcttaagcccaggaggcggaggttgcagtgagctgagatcgcgccactgcactccagcctaagcgacagagcaagacttcatttcaaagaaaaaggaagaaagaaaagtggtatgagcacaagaactctaacaaaagatttctggatggattgggttaatggaaaactggcagaagcctggaggaaggagaaggtcaagatcagctaatagtagctgataagaagtcctgtatcattatgaagagtatcaaaagcacccctgcagcctgggatggttgactgataactataactgtaaaacaatataatccgatgtgtatcatgacttaagagaatttgagaagaacagaaaggtgaatgccagtattcaatggccaatggaacatgtgtttagggactttatagcaatacttcagtgctctaatgttcaggtcatacctccctatcattccctaggtggtgtgttatctgtttatatttttatctgctatcctaatctgggagtcctctgagtgtagggatgacttatccatctttgtaaatgtcctcaaaatgcttgacatatgatgaatatgttaccacaacaccaggggttcagtctaggtcctgctgctcacagcacagaaagccaatgactaagatgatgattattgccaaggaagaaggctttaattgggggctgcagcagacgagatgagatgggagctcagtctcaaatccatctccctgacaaactgaaactagggacttatatagcagggaagagatatagcaatatgtaagaaacaggaactagagaggggtaaggaagcaattatggtgaatgaggggccctcatctcattatctggatatggtgatctggtgagttccagttcttccatacttttttttgagagacctgaaggtcctttgttgagtaaggaatccgataaaacaaatgttaaggttcaagcttcaagaccaaaaacgtcaatttctatgtttatccaaaaaactatctattgaactattgggtcagtttgaaacacatgttaaaacctctaatttgatttccttatctcattttgcctgccttgtttctgaaagttttatctaattcagatgtcacaaacctctaaaaatttctttccttgttcaacaaaccccctatgtcacaagtttacctgcataacaaacctgaacatatacctttgaacctaaaataaaagtttaaaataaatgaataaataaataaataatagcaaaactatgtttttttaaaaaaaattcttctcagagtcacctatgataaagacttctagattttgtagatattttactacttaatctgtacaaacaagtgtaaaccaagaaaatattttaaaattactcatgactaaacagatgcattcatgttaaacttatctctcatccctacccattcttgaactctttctcattcactagtcatttatgaaaaaactgtataacaaataactataataaaatggaaaatatataattaagctagaggaaaggaagggtgggagtcatcctttttttttggtatatgttagtaaattaatagtaaaaataagggaggacttagccataagggttttaaaacagcatgtctcaatttgtatacaaggctactatgttggtctgtgaaatacgtaaaaaaaaaaaaaaaaaaaaaaaaaaagcgattgattttcagtgctgcaatcctgacctctagtggacattcagaacaaaacccaaacatcacattcttttatttagttactccatcaagcaccattagccaacctaaaatattaaactttcaaagagattaaaacatgagaagcagaataaagtaaaagaatttttggctaatattctaaatattcttgctgtagaacctgtatttaagagcagctagtattaacttatttctttttgcgtgttaattatctgtcactttcactactttctttgaaacaatgcattgctttatagatcatagcagcaagaaatttatcagagaagccaaatggattttcttttgattacctgtaatatataacaagctatacgaaaactgagtggctttaaaaggacaatgatttttatagtgagacatatagtgatgttatgtaacctcctgatagaatgcactgagaagggcacagcatcacttctgtggtatttgtgcccaaaatacatattctgaatttaatcataaggaaccagtagacatatcgagttgagggacattttataaaataactggccaatactcttccaaagcatcaaggtcatgaaaaataaacactgaaaacggtcccatatgaaaggagactaaggagacatgacaaccaaattcaatatataatccagaattgcatcctggaccagaaaaagggcattagtggagcatttgataaaaataatagtttcttggttttgatcattatactatggttatgtaagatgttaatgtttgggtaaaactgagtgaaggatatgtaggacttcttggtactgtttttgcaaagtttttctaaatccgaaattatttccaagtgaaaaaaagtaattaaaaccaatcatttattttcttacaatctcatgagtcagaaattttggaattcaactgtgtggttcatctctgatccacttggcatcagctggaccacctgattcacttccagatgacttctttactcacatatctaccactttggtgattcttggtctttcttctttactgatgaaatctggttctccaggccttcttttgattgcttggttccttagagagcatgggagtataagtataattgcacttcttatatggtagctggcttcgaaaagtgagtgctccaagggactgaacatgaaagctgtcaatatctgaaggcctgggcacataaactagcatggcatcacttccaccatattctactggtaaaagcagtaccatagtctgcccaggttgaaatgagagaacagagaccttaactctcaatggagaagcatcaaataattgtgactctttaatccatcacagatatctaacaaaagtctcactgagttggcactcaagatggaattagtggaaaaaagcctggatttgctttagtctgatagacctgagttatagcctggctttaccatttactaacagtgttctgtctctgagcttcagtttagccatctctaaaatggtggcaataatacatatgccatagagctgttgagaggattaagtgaaaaatataaaatactggatataatgggcaataaatacatgaacctaataataataattgctagtgtttatcgaatatttaccaaatactcagttcacttgatgtatgctatctcatttagtcattatctcttcctagggtggtatgttttcttttgtatgggtcagaaaggacagaaccccatttcctctagctttgtctgtgaacctgctccatttactttggccatttttggtttgataatttggtaatttggtttattgacttgttgttaggatttccattatttcccttttattttgattcctaagaacccaggtgctgatgcacacttggtactttttgacactaccttttcagcatttgttctcagtgctgtcagcttaagtttttgacagcttctcacacaatctgtcagctctctctgaacccacgattgcctgcttatcagagccagaatgttcagtgtctttgtttcagtgagtgctctactgtcagctgttattttatgcaagattgtgggtgcttaatccttggcctacccaagaacatcatgatctgcactttggagcaattattcaatttggggcaattacttgtaggtgttctttaaagcaaagatgatgccagaatgtaattgaattttgaaatagcagtatccaaatcagttaaaaagctacttcgtcatgcatgcaaggctgatctcaatctgttgtcattagaggaaggtggtgaccctttcttcccacagcaagttgggtttttgttgcctcatatactgcaagcagtcagctactttttttgagtgttttcaatatggaaacaaataatagaatttagttctggtagaagtcacttatttgttatctttttactctctgctctcaaaatttacttgcctttaaatggaaagaatcactttaatcctttaggaagtagaggacacattaaataatatccaaataagagatttattcattcattcacatattcattgaatcatcttctctaacttaattgtttagagtatcacttttggaattaggttaaaatcctagatctgcacttattagctattggacttaggaaagttactttgatttctctaaatcttgatttccttgtgtataaaatggaattttaggtggttgtgggatgaaatagggacatgcctttaatgtaattaattcatatcttggcacatacaaaatactcagtagatgttggttattattttgcatttggagttagaccttgtactataaatgataagtggccataatatgtttacttattttttactcttaataattctccaaacctttgactcctactacgtacatgttttccccttaagaacaaacaaattgctggggattacatattcctaaaaatgggaggcatcttgaaaatgtatgagatattttgcttttaaaaatacatttcaaggctgagtgtattgtctcatgcctgtaatcccagcatgttgtgaggccaaggcagaaggatcacttgagcccaggaattggagaccagcttgggcaacatagggatacctcatctctacgaaaaaattaaaaattagccagatatggtggcacacacatgtagtcccagctacttggaagctgagttgagaggattgcttgagcctgggaggttgaggctgcagtgagtggtgatcacaccactgcactccagcttgtgtgacagagtgaaattctatctctaaaaaaaaaaaaaaaaaaaaaaaacctgatagaataacaagttcttttctgaattccatcaactcaaatgtcttaaagtgtatttgtttgcatcgtctagccactctgttctactttagttcaaggcttatgaagtctttatttttatgggtaatgtctagagcttcatataagcagatatagtaataccttatttttctgaacttgtttaaagaatttacatacataaatttttctggtaactgaaagtttcctctttagcttcccaaacttcaaaacatcattatctactttttatttaaaacacacactcacctcccttcttaagcacagtattataacatgatataagcattcatcaatcctgctggattatcattattaataatgacaattaacagtagttaataattaactattgaagattattggctcccccaagtggacccagagagctatgcattttatctttttttttttttaatatatgtcttcatttctgtgagatctaatattttaattctgacaactgtctctataagctatctatccctgaccccatctggcacatactttatcttgtagtttgctacttgtaatatctataagcttcaaaatcatatcaccaaactaactggaagtatgtatagaataaaaagtttagcaaagtttcctcttggtgtttgtgagagctattttggctatttagagatctttatttacttaatttttacttgtaagttctttgtgtcttggacagcttggttgtctaattgtttgattttgagataattgaagaaaggggttcttactgtaatttgatgataattctgtaaattggtctagttgggtccacagggaaataatcaacccccgaaaatttgggaaagctagtgtagtttaatcattcagtcttcaaataagcatttactatgcacattataccagcactgtgtgagaatatctcacacaggaggcttgagggggtgattctagcctgttactaaacacatatgtaaaccaaaaacatctgagatgggtttcaatcaatttagaggtttattttgccaagttacagaccatgatccatgacacagcctcaggaggtcctgagaacatgtgcccaaggtgattgggtttcagattggttttatatgttttagggaaacataagacattaatccatggccgagcacagtggctcatgcccttaatcttagcactttgggaggctgaggcaggagggttgcttgaggccaggagttcaagaatagcttgggcaatatagtgaaaccctctctaccaaaaaaaaagaaaaaaaaattatctgggcgtggtggcatatgcctgtagttccagctacttgggaggctgatgtggaaagattgcttgagttcaaaaggtcaaggctgcagtgagctctgatggtgccactgcactccagtctgggtgacagaacgagactctgttcttaaaaaaaaaaaagacatcagtccgggtgcgctggctcacacatgtaatcccggcactttgggaggccaagacgggcagatcacttgaggtcaaaagtttgagactagcctggccaaaatggtgaaaccccgcctctactaaaaatacaaaagttagccaggtgtggtggcagagcctgtagccccagctacatgggaggctgaggcacaagaatcgcctgaacccaggaagtggaggttgcagtgagccaagattgcaccactgcactctagcctgggcgacagagcaagactctgtctcaaaaaaaaaaaaaagaaaaaagaaaagacatcagtcaatacatgtgatgtgaagcatacattcattcagtgcagcaataattcagagatggggcttccaggtcataggtggattcaaaaatgttatctttttttttttctgttcttttctttctttctttttgtttgttttttgagacagggtctcgctgtgtcatctaggctggagtgcaatggtgtgatcttggcttactgcagctcaacctcctcagttcaagcactcctcctgcctcagcctcccatgaagctgggaccacaggtgtgtaccaccacacctggctaattttttttttactttcttgtagagatggggtctcactttgttgcccaggttggcaaagatttcctgattggcaattggttgaaagagttgttattatctaaaaacctggaatcaacagaaaggagtgtctgggttaagataagggcttgtaaagactagagttcttattatgtatatgaagtcttatgggtaaccactcccagaggcaataaatggcaaatgtttcctttagacatcctaaaaaggttctagactctcagccaatctcttcaggatcagaaagtgacctggaaagagaagggaatcctctatagaaagtaaattttccccacaagagacaactttgtaggaccatttcaaaatatgttcaaggaatctttattttattttattttttttgagatggagtctcgctctgtcacccaggctggagtgcgatctcggctcattgcaagctccgcctcctgggttcacaccattctcctgcttcggcctcccaagtagctgggactacaggcgcctgccaccacgcccggctaattttttgtatttttagtagagactgggtttcaccatgttagccaggatggtctcgatctcctgacctcgtgatccgcctgcctcggtctcccaaagtgcttttgggataaaatagtttggtttctttcagggccctgctatctgctatgtgatgctatacttagaatcacgttggaatttggtatcttattgctacagggtgtttgctgtctgtcttaggatctctcttttaatgttaatgctggtcagttgtgtgcctgaactccaaagggaggagagtataatgaggcatgcctgattgccccttcctgtcgtgatctgaactatttttttcaggtttagctgggtccctttggtcccagcttagtcagttggagggcttagaattgtctttttggttttcacaggtataatattgggctagtcacattcatactctaagaaatgagaatcattgtataggttgttataacaatcaatgaaatttcacaattcctgtgaatgtaaggaatttggggggaatgtttgacagggaggttaagaatacagccaaggtagctgaacatggagtggagtttccaaaggctaccatgaaaggatttggaaaggaaaggaggagtagcaaactagcttaggataaaggaccagagcattatgaagatgagaaaactagacatgagagggatttgcattttgagcagtgactggaaaaacaagaaccagagaaatagtggatcaggttctgatggcaagctgataaacactcaggttgtgagaattcactgttgcctagtggttgtgatgtggtggtggacagagttggagaacagggcagtaggtcttttttatattggcctttaagttttggcaggtgggcagcagctagtgggtgagaagtcaaattttgattcagaaagcaaattttgcttaattgtaacccacattttaaaatctgtaatagtcttttttttctaattggtaaattgtggtcaaaaccagtccaggataattgcttagtatggtaatgaactgtgttcatttgtttttatctcctggcctgattatacttatttcctattgcttttggtttcttaaataatcagctgagtaaaccccaaaccaaaaatatttggtttatattttaaccaactgaatatttgtgtttatcattcattccttccatcattatgttatatttctggtacctgaatgtgaaagtttatgttagcaaatcataacaggaatacactctaaatatctgggcctaatccttgcttctggagttatttcagagacagaagaagcatggtttattataagttttttggatagcacatttggtatagctccatatccaaaagccagccagaatgtatcagtgaccaagatgaagagggcacatcaaatagaccctggacttatgggacttatgccaactcatacttgaaatatcttttttcttatgtatgatgacttgcatggcaaggaaacagcacattttgtagcaaacatttctgattgttacctttatcatataagattctctatcttttgaatttaataactcaatgtctcttcagagcaattgggcagaacccagagttcaaaattcagttctagaatagcttcttaaggaacaatttaatttgtttatttctaaagaaatattgctatggttttcagaaaaggaaaggaagtctggcagatagcccctaatgaccacctctagttatacaaataatacttgaaagcaattgctaaaacaaataagaaaacaataagaactgtagtggaaatgcagtgtgatacttaaagcctccagtacacaatctgtcccacttatcagcaacactgccttgtttttttttattttattctgtctgccacttgcagtttaactgtaacaccgagatgtccagattagggttaggaatttcaattaataattttagacttctgcatcattatgccagcttgagcaaggaacttgactttcacaagacttaggcacatgcaaataatccagaaattgactgaagggaaataacttattgtaaaaacaattttatgtgaacattgattaaatagcacctaaaatttataacaagccactcagggaaagaaaatacctttaaaaaaaaactcatggtttaattattgtttgtgaagatgaaagcaattaggaattttattaaatatatgtggaagtcttggggaaataataaaatagtgatacatgtggcagtactaatcttcactttctttttctatttcagggtttgaacataatctttcatgtagctttggctctcctaaaggtaagtcttttttttaatcttaagttaccacattctcttacctctttgcccttggaactggaataattcaatttacagtctttgactcatttcagtttctcagacacacaaaaatagatgacttctctgagaaactctgatcctcttccctcctctcatctttttctgttgttgtttatttggagtcttttttttcttataatccatttatttaatggtactatcatagagctctttccagtaacataaaatatctttttatcatatgaattggatgatataagagaaaaggttaaaaattgttttctgtcaaaatgatgcctgcttttttcttaaaacactttttactataacatctctggaggtacctaaacatataattgaattattaaaaagtttttataatatactgactaaaaaagaaactgctacatttcaatttgcagttctttccatgatagttagaaatttataaaacactttagaattctattgtaattaccttgttggattttatgtcaacatatcatacagctttaataatgtggtaactgcaaggcatttgctgcagagttgatgaagataacccagctggtttttgtccttcagtcagagaagacattctgatattaaaggcaataattgcctcaaaggcacaggcttaccctttcctcagtataacatggtggttaaaatggcagacctggactcagacagatttgcttctaatttcagccctaccatatgaccttaggcaaatttttctaagtgctcaaagtctgggttttgagataataataggaattaatttatgggattgttaaaagaattgagatgatcaaagaagtccttagtatagtatctagaacattttactgcctagtaaagttagctgtcattattattgttctttacaaggtgactcagaatgtgttcttagatcccttatcattcttctgaatctctcaaaagataatgatgtggtatcataggaggacctcttgatacgttaggagagccttaaccatacctaaccattaacataaccttgattctaaacaaaggcatgaaatagtacaggccctctgcaactcagtaagtggatttctattcctcatctcttattcctttacacatttgctctttgtgaagttcataagatacactttttaaaattaaatcgattgtgtttatatattttttatgccaaagctatttagaaaatagaaaaatattttaaataaaataacacaaacatatttgctgtgtcccttaatgaagtcatgggttttgacctctaatttttttctttcattaaaacaaatccaagctgaaactttccaacatgtcctctcaacagggctggaataagacttttagaatgcctaagcattgaaagtatatgtaatacagactaaaaaaatattaaaacataaagtaagtataaggaggtccaagaaagttctgatttctcatattatatctaatgttttaaactctcagatattatgtctttcctaaaatgcctttcctcatttttttggtgacttatctttactagtgctttcactgaatgcttaatctgtcttttgagtaacccaggactacctctctggatatcagacctataccctgtgtcaacttaatactatatacattagtaaattatcttcttgattgacatgttgacttgttcatattattttcatttattttgtccatgttaacacagacaaggcctctacagaggacatactctggccactgggcaggaaggctttgtctgtcttctttagcaatacatgggcactcttgtagcatcatcttagagaattttactagttagagaagataaaaagagccttctcaccactagtgccctatatttatgtaacttccttatatgaatcctgaagctgacccccccaatagacagagtatatatgggactaaactgaagtgtactttaatgatctattgccaccacttggaaaaaaagaatacgcaaacatatatgacagtcactgactttcagcttctagtgtagtataccagataaaataatatgtatttgtttatatcaaaattaaaaactttggagaagttcaaattgctgggtttttttttcttttgttttgttttgttttttgctttttgagacagggtcttattctgctcactctgttgcctaggctggagtatagtggcgtggtgatagcttactgcagcctcaaattcctgggctcaagtgatcctccctcctcagcctcttgaggagctagaattacaggtagatgccaccatgcccagctaattttaaaaatattgtagagacaggggtctcactatgttgctcaggctggtctcaaactcctggactcaagcagtcctcctgccttggcctcccaaagcactgggattataggtgtgagccaatgagcctggccttcaaagtgcttatgaattgagcctaaggaattttcagtatagctacagagagacttcagatttctctgtattataagcatttcttgtgatgaggggacagaactaacatttcttgaacatttatactctgtgttaagtactaacagattatctcattaacatacattaaatgtctaggatttatttgtagaatagtaatggtattagccagagaaaacatctaattcttcccccagcccctagttgataattgagagatcaaagctcaagatcaccttaagacttttgtctcagtagtgggaaagttggatttataatttttttgaatgggatagatataggatgaattctgtgttgctcagttaggttttaaagacacctactttctgaacgggaccaacttctttttggttagtaatagcctatcaggtagctaaaaagctatggacctaaaagaatgattcacaatactaggcagcatcatgaaatcattttgtgtccagtaggtaggtcagatatattcctccaaatgtaatttatttacttatatgaaacattaggtagtcatagaatacattcaatagatttaatagactggagatgatcagtcagaattgttcttagcacttcatgttgggcacagaaatttttcagtcagaataggttttttgtttgctgtccgtggttaaaagcaaatgacagagtgtttttctctggccttcccaaagtattatatgcttatttcgtgtcctacatgtgtatgcagacactacagagataaagaaagcccaatcataatcctgttcccagggatgaccataataaaaacttggtataaaacctttatcccatgctttggcctatggttatataagtatgcattacctacctatacacatatgtatatatgtatgtatgtatatttttaatctgagtttgagataagatgggaaagtgggaggaaatccagaagaacagtgtgaaaggatgcacataaatttattttctttcaaaaaatgctgttgaacaatactctttttcattcagtatatcgtgaatatctttccatgtcactaaacacatgtaagggttaaaagcatgtggacattggagtcagactacttaaattcagattcattcaaaacaatttatccaatggtcttaggtaaattacaatttctccattttttaaatgggggaatattagtaataccagtctcataagattgttgtcagagtttaatgagttaatatatgattgatgcctagaactcagtactacagtgtactgaggtgctattgttagagacagaatttctcttttgactggtttttatcctactgtatgtgccataatttattttgaggcagagtctggttctgttgcccaggctgcagagcggtggcacaatcttggctcactgcaacctccgcctcctggggtgcaagtgattctcctgcctcagcctcctgagtggctgggattacaagtgcaagccaccaagccctgctaaattttgtatttttagtagagacggggtttcaccatgttggccaggctggtctcgaactcctaacctcaggtgatccacctgcctcagcctcccaaagtgttgggattacaggcatgagccaccgcaccctgccctgtaccatatatatatatatttttttttgaaagccactgactttattgatctaaaaaactttacaaggacagtgacttttctgccaaaaaaggagccaaatggtatcaaacggactgaaattgagggtgggggtgagggatggggccaggaatccattcaggaaagctggtgactgtccccagggaagtagcaggggaaaaaggaaggcggaggcatgcaagagtgagaatccaaaaaagttaaaatgattaggagagaaaactcccaaaagaccctggagtacattggaggtgagtaggacaatagcagtcttttcctttgttgaggacaggggaggagtccctactcggttgcaaactccggatgagggctggggattgagggcttcccagaaagcatcacaagaaggtgtcacaccactctcgaaggcatctgaagcagtcctgggactgcttggcattggcaccaccagtgtccctcagccattctcagaagaggtcttcatctttctttagcaccagaaactggccaaggacaacataggccttgtcaaagcacccttcctccagcttcttgtccataacttcaccaatcccggccaggctccctactggcttttcccccacggactctgccacaaagtctcggtgcttttgggaggttgtaatcttgttcaggtttaattgtcagcttcagttcccataatggttcctcctgccacctggctgctcctgcctatacctcaagccactagaactttcccctgtaccacaatttatttaaccaattttatatttagtttttatggacatttgtttccagaatttcctgttaaataaaaccgtaacaaatatccttaaacttgcatctttgcatacttatctgatatctctggggtaaatttctagagatggaattgctaggtcaaactgtaaccaaattttaattttggatacatattacaaaattcttctctgctagcaatgtgagagtacattttcccatactcttcaaaaatttctaaacattaagcacctttatggaaatcaaaagcaagttataaatataaatataatatataaatatataaatttatttatacataaatataataaatataaatgtaaaacaaagcaatttaaaagtaatgatttagtaattttttattactaaatcatataaataaagctcttcagccagctttgaagactccagtattttcttttttggggagaatatccagtttctttagggaagcagtggatcatggctaaattctagaagactggaccttctcttagtttggaggggcttatataaaagttctgacactttagggggccaaggtgggtgaattaggtcaagggttcgagaccagcctggccaacatgacgaaaccccgtctctactaaaaatacaaaaaacgccaggcgtggtggtgggcacctgtaatcccagctacttgggaggctgaggcacaagaatcgcttgaacccgggaggcagagtttgcagtgagccaagattgcaccattgcactccagcctgagtgacagagcgagactccatctcaaaaaaaaaaaaaaaagagttctgaagtgtatctttgatgtttttggcttttcagccctttccagtatggtttttccttaccattccattgaagcttttttagtatcttacttgatccttcaacagttgtcaaaacagcataatgacatacacaacgcttccttttttttccccttctttttttatgttttggaaacatcttcccttggtttctgtcctttcttttatctccccctctgctacttctgtctttttttttcctcactcctttttccccctagccattagcttggagttctacagatctccagcctctaggaatttgcttattgcttctcccttgttgatcttattcattcccctggtttcatctataaatgtttactctcatttatttttattttttttaatccctcaccgccctcccaccctttccccttctgagtctccaatgtccattttctactttgtatgcttttgcatacccatagcttagctctcacttagtgagaacatttggtatttggttttccattcctgagttacttcacttaggataatggcctcctctttcaagtttctacaaaagacattatttcattcttttttatggctgagtagtattccatggtgtatatattaatatatcacattttctcatctactcctcaggtgatgggcacttaggttgatgtttactctcatttatatttaatccaaacccacatatttggctgtggactgaacatgtcggcttggatgtttcacaggcacatcaaaagtcaaaactgaaataatgtgccctcccaaatgtacttttcatctagtaacctccacttcagtaaggactctacccagctgctcaaaccagaaacctagaagttatccttaactctcttctcaatatcccatatcagttcagtcaccaagtcctgtggattctacttcttgaaaatttttagaatcttcccacttttctcctattcttacttaggtagcttttaggccaccaaattttccaggaagatgatgccctcctggattattgcaggacctcctgtaataataaatattggatacctatgaagtgccaggtactgttctagacattggagataaagtagtaaccaggaaagaccctgctttcatggaacttgcattccaatgagagaaagatagtaattaaacaaataaatgaatatatatgttagttcattcttgcattgctataaagaaacattcgaggctgggtaatttatttaaaaaaaaaaaaaaaaaaaaagaagtttcagccaggtacattggctcatgcctgtaatcccagcactttgggaggccaaggtgggcggatcactggaggtcaggagttagagaccagcctggccaacatagtgaaaccctgtctctactaaaaatataaaaattagccaggcatggtggcgtgtgcctgtagtcccagctacttgggaggctgaggcaggagaatctcttgaacctgggaggcagaggttgcagtgagccaaaattgcaccactgcactccagcctgggcaacagagtgagactctgtctccaaaaaaaaaaaaagaaaaaaaatggttttattttggcttacagttcaacaggttatatacgaaacatagtactgatatctgcttctggtgagggcctcaggaagcttacaatcatggcagaaagcaaggggagctgtatatcacatgacaagaggagaagcaagatacagaagggggaggtcccagactcttttacaacagccagatctcacgtgaactcactgagtgagaactagctcattagcaaggggatggcaataagccattcatgagggatctacactcccatgacccaaacacctcccactcggccctaccttcaacattggggattacacttcaacatgagatttggaggggactacacttcaacatgagatttggaggggacaaacatccaaaccatatcaatatgattagtttagatcatgctgaggtttatgaaagaggtaggtttgagaagatggtggcttggatttgagtgttagcagtggaactgacagaagtgggtgactgcactttccccatatactcttgaccattgttgagtccgttgccacactgccagtagtctttttaaagcagatttttttttttttactttgaatttcaggggtacttgtgtaggtctgttatatagataaattgtgtgtcatgggggtttggtatacagattatttcttcacccaggtgataagcatagtacccaataggtggtttttggatcctcaccctcctccaccctcaagtaggccccatgtctattgttcccttctttgtgtccacgtgtactcaatgtttagctcccacttacaagtgagagcacgtggtatttggttttctgttctgtgttagtttgcttcggatgatggcctccagctgcatccatgctgctgcaaaggacatgatctcattctccttatggatgcatagtattctatagtgtttaccacattttatttaaccagggtactgttgatgggcatctaggttgattccatgtctttgctattgtgaatagtgctgcgatgaacatgcatgtgcatgtgtctttatggtagaacagtttatattcctttgggcatatacaaagtaatgggatggctggatcaaatggtaattctgttgtaagttctttgagaaattgccaaactgctttccatggtggctgaactaatttgtattcccaccaacagtgtataagcattctctttactcttcaccctcacccagcatctgttgttttttggctttttaatactattaaagcagattttagtcattattcaacaatatttagtaaacacctatttagagacagatactgttctatgtgcttgaatagaaatgagtgaactaaagtaacaaagctacttgcctctgtggaaattattttctagcaagagacagttgataattgtattagttcattttcacactgctgataaagacatacacaagactgggcaatttataaaagaaagaggtttaatggacttacagttccacgtggctgggccaggcctcacaatcatgaaggacggcaaggaggagcaagtcacatccaacatggatggcagcagacaaagagagagggcttgtgtagggaaactcttgtttttatttatttatttattttttaatttaaaagtaaactttaatgtcaaaaatgcaaacttgaggaggccagaaagatcacacacaagactgccacttcacacttggatggttgcacagcagtccggcagaggcgctcctcacttgccagacagtgcgggggccagggagaggcactcctcacttcccagagggtggcacggccaggcagaggcgctcctcagttttcagacggtgcagccgccaggcagaggtgctcctcacttcccagacaatgcaggggccggggagaggcgctgctcacttcccagcagaggctctcctcacttcccagatggtggggccgcctagcagaggcgctcctcatttttcagacggtgcggccgccaggcagaggcactcctcacttcccagacggagacagtgtgggggccggacaagggccgaacagaggcattcctcacttcccagacggtggaaactcccgtttttaaaacatcagatctcatgagactattcactaccaggagaacagcatgggaaagacccaccaccatgattcaattacattccaccaagttcctcccacaacacatgggaattgtgggagttagaattcaagatgaggtttgggtggggacacagccaaaccatatcaacaataaacataataaatatataaatatagtatattagaagttatagtattatggggaaaaggaaaagtaccgcagggtgatgggagttatgggtaggttgcaatgttaaatagggtagtcaggataggccccaactagagggtgagatttggacaaagactgcaggtagtgaggggatgctctgtgctgggagtgtgactgagtgttgagggacagatggaagccagcgagactgcaacaagagagtgagggaagggcggtaggagatgaggtcagagaagtaaattttttcttgcttaaagtcctttaaaggcctccattgctcttaggataaagttcacaattttgacacagtccacatagtttttatgatctggcacaacttacctctccatcctcaactgccccttccctccctctcatttgcactgtctcaatcaagccataatgaacttctttcaggttttcccaatagaccaatctgtctttcacttaagagtcatcacatatactggtttcctctgccaggaatgctctgtctccctctcttcaataagctaatttccatttagctttactacgttaggaactttctgtgccttctgcaaacttaggttagacagtgaaaacacaggttccctttgtcttctaggacatctatttgacagtcctttgcatacttgggactgatacctgattaaatggttggttggttgttgtcttcctcattgtagttaatctctatgtggggtctgcccactagtttgcctttgtattggagttgctggcacatagtaggcacttaaatatttattgactactgacttagagtcaaattgagaaagcataggttttcttttccctcacttcctcctatgtgtatatgaataagaattctgccaggatagcagctttttcaacccaggtctcctttgctttttttttttttttttttttttttaagatagattctagctctgttgctcaggctggagtgcagtggctctatctcagctcactggaacctccacctcccaggtttaagaggttctcgtgcctcagcctctggaatagctgggactacaggcatgcgccgccacacctggctaatttttgtatttttggtagaggcaggctttcaccatgtgggccaggctggtctcaaactcctggcctaaagtgatccacccgccttggcctcccaaagcgctaggattacaggcatgagccaccgtgcctggcctcctttgcttttaaaaaccttgaaattaattgctcttgtccccagtatttagcttctctcattttcattattgagatataatttatgtgtcataaaattccctttaaaaatgtacaattagtggctgggtgtggtggctcatgcctgtaatcccagcactttgggaggctgaggtgggtggatcagaggtcaggagatcgagaccatcctggctaacacggtgaaaccccgtctctactaaaaaacaaaaaattggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtagcgggcgcctgtagtcccagctactcgggaggctgaggcaggagaatggcgtgaacctgggaggcggagcttgcagtgagccaagatcgcgccactgcactccagcctgggcgacagagcgagactccgtctcaaaaaaaaaaaaaaaaaaaaaaaaaaaaaaaaaaaaaattagccaggcgtggtggcaggtgcctgtagtcccagctatgcaggaggctgaggcaagagaatggcgtgaacccgggaggcggagcttgcagtgagccgagatcgtgccactgcactccagcctgggcaacagagcaagactccgtctcaaaaaaaaaaaaaaaaaaaaaaagtacaattagtggtttgtagggttgtcacaaacttgtgcacccatcacctttatctaattctagaacattcttatcaccccataagcatagtagccacttcccatttccccatcctatcaccacctgacaacttctaatctgttttctatctctgtagatttacctattctgaacatttcatataaatgggatcatatgataagtggtcttttgtgactggctttttttccttagcataatgttttcaacgtttatccatgtcgtagcatatatcagttcttaattcctttttattgctagataatattccattgttcaaatgtaccacattttatttatccattaatcagttaataaacatttcagttgtttccattttgattgttatgaataatactactgtgaacatttgtgtacaaggttttgtgaacatatgctttcagttctcttggttatatgcctaggaacagaattcttggatcatatggtaattatgtgtttaactttttaaggagctgccaaacagttttccaaagcagctgcaccattacatcccccgtggcaacgtataagtatgttgtaaggcctaaaattaaagcccaatatgatgtgctgcctcaacatctggcagaaatcaggaaggcctccagtcacctaagtgcaaggtctcctccttattttgctcctgtggataaggtttcctagccaaacaaccctccttagccaaagggtgaggcgctgttcttttctttgattttgtttttttagggctggggtctcactctgttgcccaggttggagtgcagtggcacaatcatagctcattgcaacctccaattcctagactcaatccttctgcctcagcctccaaagtagctgagactgtaggcgtgagccactatacccagtggcattgttctttcttagagtagcaaacttcagttccttgccagcctgtgtcattattcagacaagccaatcacatcatcccaggggagctagggggcaccccactctcttgataccataaagctgcctcccacagcccctgattgttcactgtgttttaatccagcccttccatgatgttttcctcccttggggatgtgaatacctgttactaataaactactgtcaatctcatctgtccgtgtcaggtaaactactgtcaatctcatctgtccgtgtcaatctcatctgtccgtgtttgaccatggctgcaaccgtagggcaggaattcctcccgtattagcagggtgaataggagacaatcgaaacaatgagggtttgattcttctacatccttgctaacacttgttattgtctactttattttttattatagccaccttagtggacatgaagtgacatcttgttatgttttgatttgcattctcctgatgtgggacatcttttctagtctacagccataccaccctgaatgcgcccgatctcatctgaacatattttcatgtgcttattggccgtttgtatatcttttttggagaaatggctgttcagatcctttgcccactttctaattgggtttcctgcacttttattgttgagttgtaacagatatatattttttgagtcagggtctcattctgttgcccaggctggaatgcagtggcataatcatggctcactgcagtttcagactcctgggctcaaaggatcctcctacatcagactcccaagtagctgtgactacgtgtgtgccaccatgtccagcaaatttttttttttttttagagacagggtcttactatgttgcccaggctgagctataacagttctttatatgtgctgggtattgcctcccattctgtggactgtcttttcattttctagataatgtcctttgaaacacaaacatttttaattttaaggaagtccaatttattttttctttagttgtttgtgcatttggtgtcatatctaaggtcacgaaaatttcttcttctaagggttttataattgtagcttttacatttaggactttgatgcattttgagttaatttttgtatatgatgtaaggcagggcattatggctgaatcgtgtttcccccctacccccaaaattcatatgttgaagtcgtaacccctagttactcagactgtgacagtatttggaaatagaatctttaaagaggtaattaagttaaaatgagctcattagggtgggccctagtccaatataactagtatccttaagaggacattgggacacagacatgtatggagagaagatcatgcaaagtcacagggagaagacagccatctacaagccaaagtgtgagaagaaacaaaccctgctgacaccttgatcttagacttctagcctccagaactgtgagaaaataaatcactgttgttaagccacccagtctgattcctttttatgacagccctagcataccatacactaggggtacaccttcatcctttagcacatggctatctacttgtccccataccatttgttgaaaagactcttctttctcctttggatggtcttggcatccttgtcaaaaatcagttgaccatggacagttttatttctggagtctctattcccttatctgtgtgtctgttcttacaccagtaccacagtcttgattactctagctttgtaataagttttgagataaggaagtgtgcattctccagttttgttcttctctttcaagattgttttggctattccaggtcccttgcattttcatatgaattttaggatcagtttgtcagtttctgccaaaaaggcaataggattttaatagggattgctttgaatctctgtatccattgaggagtaatgccatctgaatgtaaaccaaaaatgaaatcctaagccccctgaccattcttttacctcagtcccttgacaagggcatctcagaggtaacctgaaaaaacaaattcagcccatgatgggggaaggtgggagtctgacatgcctcattatgccatcttcccttttggaatcaccaatagaacagacttgttaagtctgttaaacatttacaatctattctctccaagcctgctatctggaggcttcacctgcatgataaaaccatggtatccacaaccccttatcttaacccagacattcctaagtgtttagacaacaacttaactttttcaaccaattgccaataagaaaatctttgaatctacctgtgacccggaagctcccacttccccgttgtttcacctttctggaccaaaccaatgtacatcttccatggatttgattgatgtctcatgtcttcctaaaatgtataaaactaagctgttctccgaccaccttgggcacatgttttcatgatctgagggctgtgtcatgggccattggtcatttatatttggctcagcataaacctcttcaaatattttacagagcttgactcttcatcgacattaacaatattgagacttttgatccatgaacatgaggttttttcacatttatttaggtcttatttaattttttttgatgatactttgtggtttttagcatacaaaagtcttaaagcacttgaaaaaatttaattctaacttttattctgcttgatgctattgtgaattgaattgtttgttaatttcattttcactgcgtcctcattactggtatccaaaaatacaactgactttccttttttttttttttgagacggagtctcaccctgtcacccaggctgtagtgcagtggcgcaatctcggctcactgcaagctccgcctcccaggttaaatagaaccaacttatctatattgatcttataacctgcaaccttgttgaactcattttcagctttaatattcatgtatgtgtattgtgtgtttcccaagatttttgaaatacaagatgtcattgtattagtatgttttcatgcagctgataaagacatacccgagactgggcaatttacaaaaaaaaggggtttattggacttacagttccatgtggctggggaggcctcacaatcatgcctgaaggtgaaaggcacatctcacgcggctgtggcaagagagagaatgagagcaaagtgaaacaagtttccccttattaaaacatcagatttcgtgagacttattcactaccacaagaacagtatggaggaaaccacccccatgattcggttatctccacctggtccctcccacaacacatgggaattatgcgagtacaattcaagatgagatttgggtggggacacaaagccaaattgtatcagtcatcttgtagacatatttttacttcttcctttctgatttggatgcattttctttctttttcttgcctaattcctctgactaaaacctccagtactggcagaataggtaactaggcagacatgaacaggacaggagagggccctcctccccaggaatgtcaggtgaccatcaggtaatggtcatgcagttgttaaactatctaacataatggttgtagcttgcgccagggaaaggctgtctcccaatagatagaaaccacctgaagctggtgatcagcagcttcttaataagatctcaggattttgcgagtaggctcaagcatgcccaccaggaggcaaactggtggagtttaacaggtatatgaccctcctctgggaacactagtcaactggtaagggaaaaatacctcaaatgaacatgcacacaacttcagtaaacacactgtacatgcggccccaccccagggctagcaggccactgtgcatgtggacagcccaccccaagggaagaatcaggggagaagaaacacaaaccctggaatcatgccaatgtataaaaccctaagtcaagggtcagacagtatacttgaatctctcaagttgcctgcttggctcacttccaagaatactttacttcctttcattcctgctctaaaagtttttaataaattctcactcctgctcaaaaacttgccttaatctctcactctgccttatgccctcttggacaaattctttttattgaggaggcaagaatctcgagttgctgcagacctgtacagattcactgctaacagtacaatgttgaatggaagtggcaagagtaattatctttgtcttgttcctgatctcttttaccctctatcagaaaagttttttttttccttagaacttcatttctggattactactgtcaccaccattgtcactgtaaccacctgacaggtgcttcctgcccactgcacaaacaaaatcaattcatggagcattgcagtaaagaaagaggttaattgatatgaagacagccacactttgcaggtgatggaattattactcaaatcagtctcattgaaggttagggattttcccaaggtagtttggaagaaggggtggaggtggctagacaatggatacttgctgctgattggttgggggcacaatcataggggtgtggaaaacggtcatcttgtgcgctgagttgcttctgggtggggccacaggagcagttggtgggtccaggtggagccattggtgtcatgcaaaaaacctgaaaagatatcccaaaaggccattcttaggttctataatagtgatgttatctacaggagtaattgggaaagttgcatatcttgtgacctccagaataatggctgacaatcacgtccacaccatagaagaattcaagctcctctatccccctagcctggtggtctctcattagctttacaaggtcggttgagttttggggaaaggctattatcatttaaactataaactaaatgtttcccaaagttagcttggcttaagcccaggaataatgaatggcagcttgaaggctaaagccaggaggggagttggctagatgagatcaagaagttagccgggcatggtggtgggcgcctgtagtcccagcgactccagaggctgagccaggagaatggtgtgaacccaggaggcagagcttgcagtgagccgagatcacgccactgcactccagcctgggcgacagagcaagactccgtctcaaaaaaaaaagaaagaaaagcaaaagaccttgaaactggaaaatggatttcagttctccctagtctttgatgtaccaacttgggttaaaagttcttgtttctgtgtttgaagatagtgacttaaggaagaactgaagttgggaatgtagtttctgtagttaatattcatgttacaaaaatagaagtctaaacacctgaaaaaaagaatgaaacaactcataaactttttttttggatttgcaatgattttgtacattccattagttttgtaactttcatgaaggaatgcctattgtcctgttggtggcagtaaaacaccactcctggatcatttgttacttgaatatttcatttgtttgtttttaactttctctagtgcatcttcagtttgatgataggttagtttcaagatgctatctagtaaatgctaaaacaaaccaacaaacacaaatactgggcttctaattaggatactcaaggaattttaaagttttaaagtttcagaaataatacattttatgaaacagggatctgtatcaggaaaaaatgtatatcatcacagtaccatgcacatattatataataccttaaatttgttgaagcaatttctcattacttatttctcatgaaacaatccaaaatatcaagaagggaagacagttgaataaacacaccatttccaagtagtcagtgattaaattgaacttaatgtaccctaagaaatacaagctcccttgacagagaacaaacagaacaaaaaaatccagtttcctccttgttctatttttgtgagcaaaataagtactcatttaagcttccatcccttttacttaaaaatccctctctgtcttcatcctcttctgctttgctcttgtctttaatgaaggtctgttctgcccccattccaaggctaacttcctcactatgtccttgatcccatctttcctgtctctctttggagaagcctgtgatggttagttagttcacttattcaacagatattcactattgacagtccctgggttagatgtcaggggatacagagatgacattctgtgtcctgaagttgtcacatctaataggggaggcacacagacataagaattcagtgtgtttgatcctggggtttaaaagggatctttgggagcctaaaggcagaatgccaaattcattctgggaaactagtaaacattttccaaaggtggcatctaacctgagaataggacatgagggtgagagtgaacagcatgtagaagaggaatgaggaagaatggctgaggcaagtcctttgccatggcacatttgagggggatgcgcaggatacgattctgaggggctttaattacatttctgccatcaatttattgtggaattttaatcaaatcatctaaccttttaacacttaatttcctaacttataaaataaagagacagggaagcatgctctaaatttatgtcatgccagctgtgtcaatctgtgctataggtgtgtgtatatgtgtgtatgtttgtatgtcttatataaccatttcagtcctttaatgagtagataagaatctttgtataatttgcatgtttgttgtttaagtgcttggctaaatttatctttgcctcttttacaaaaaaaaaagtgtttacagaacaatataataaaattaggagcaaaggaatattttatttgttatacttcaagatgaataccaccaaaatgttttcatttcaacttaaaaatctctttataaccatacttgaatataaacaacccatttgttctacattagtgaaatgttagtgtgtgtattttctagcactcacacctctgcactgtgatcattctatcaggtatttctagatatccaagcaatgtgttggatctatgtaaaaaaaatctgacagctaccatcaataacaatataattgtgtagcatttaaacagtttgtaatgagctctcaaatgcattttttaaatgtttaataaataaaattaatagtaagacacctatcatttattgagcacttaaaatgtatctgatgctgtgctaagcactttaaaactaatcttcacggccgggcacattggcccacgcctataatcccagcactttggaaggccgaggcaggtggatcacgaggtcagaagttcaagaccagcctggccaagatggtgaaaccccatctctactaaaaatacaaaaaattagccgggcctggtggtgggtgcctgtaatcccagctactcgagaggctgaggcaaagaattgcttgaagccgggaggcagaggttgcagtgagctgagatcacgccactgcactacagcctggacgacagagtcagactgtctcaaaaaaaaacaaaaaacaaaacaaaaaaaaataactaatcttcactacctttaattttgtttattgtagtataatatacgtaacataaaatgtacaattttggtcagggcagtggctcaggcctgtaatcccagcactttgggaggccaaggtgggtggatcacctgaggtcaggagttcgagatcaccctggccaacatggagaaaccccatttctactaaaaatacaaaattagcgggtgttgtggcgtgtgcctggctactcaggagactgagatgggagaatcgcttgaacccgggaggcggagcttgtggtgagctgagatcgcaccactgcactccagcctgggcaacagagcaagactccatctcaaaaaaaaaaaaaaaaaaaaaaaaagtacagttttaaccattcctaagtacacagttcagtgacattaggtaaattgacattgttgtgcaactatcaccaccatccatctccagatctttttttcatcttgcaaaactgaaactcttgcacctgttaaatagtaactccccattcctttctccccttagcccctggcagtcaccattctgctttctgtctctatgaatttggctactctaggtacctcatgtaagtggaattatatcgtatttgtcttatctctggcatatttcacttagcatagtgtatgacccttaatttttttactgacattaattaaaagaaatcctaattttaacaataattctattactgttaatattgtattactattttatcagtgattctattactgttaatactgtattgacttgttggtatgaatcaatatgctcattttacagattaggaaactaagacttataaaaagttaaaaaacttggttaaagtcattcagttaggcaaatgacataccacaatcacaactaggcctgtcttactacagaggcagtgttcttaacttctaagctatggggtgtgtgtgtgtgtgtgtgtttattttaaaccttacaattgctctgtgaacaagagattatatcctacttgatactcaaatcccaggcatggcgacatatgcctgtaatcctagctacttggaaggctaaggtggaaagatcacttgagcccatgagtgcaagactaatctgaacaacatagtgagacccgttatctaaaaagtaataaacaaataaataaataaaagccaggtggctctcactaaaaattccatgcctttttacgttatacagcaggagacccttaaattatagtgaaatcagtctccattccacaaatctatgttgacatcatactatgagtgaaaacaggttttttaattcaagttgtttgaattaagcatattctattgtatgttcaaagatagttgtcccaatttaaaaatgtccttggttgaataggatagaagcagagccagagcaaccaagagccattgctatatgaacaaataattgaatttaggctaatgaaaatgaactcactgtcaaaaatcatcatgaaattaaaatattctctgctcttgactggctggaataatatttgattcctgagttctgcctttccacttattctgtcataatctttgagatatatgaagtcatccctgaatactgtttaatgctctggttaaactccatttcactctgaccaatcagagtatgtgagctgatcataaggagctattatcaagagacttgtcagaggattcactgcccaatatgtttttatgaccctttttatctgtaagagttgctggtattgctttttagaatgaaatagactaattttgtccattacagtgttgatagtttgataactcactgtgggaatcaattgatcttatcagaataatataaccagtagaggaaatgtaactgaagcatatacagttttatttaatatattgtttatgcaggttgagaaaaggctgaaatatgctccttttgctagaaatgtaataactaaaacgcccatagccttgatcttttttatcttttattgcttttccttgactaagagaatttggttttggtaaagctaaatgaatttagaataaagtcatttatttgtgtcatacgtaagcttgattaagaaggtttttatggccaagagccatggctcatgcctgtaatcccagcactttgagaagctgaggcaggaggatcacatgagtcttggagttcaaaaccagcctgggcaacatagtgagatcttgtctctacaaaaaataaaaataaaaaaaatagcaaggcatagtggcctggcattgcactccggtgatcacaccattgcactccagccctgggtgacagagtgagatcctgtctcaaaaaaacaaaggaagattttttttttttctatttagaaagagagtgcataaaagagaaaccataggcagggacagtacctcatgcctgtaatctcagcactttggcagggcaaggcaagcggatcgcttgagtctaggagtttgagagaagcctgggcaacatagagagacctcatctctccaaaaaatacaaaaattagccaggcacgatggcacgtgcctgtagtctcagttatttgggaggctgagatgggaggatcacttgggcctgaggggttgaggctgcagtgagccatgattgtgcactgcactccagtatgggcaacagagcaagaccctgtctcagaaaaagaaagaaaccataaaaagtataatggcttgaaaaagatggtgtatttctcccacagatattaatctagagagaaaatgactggccccaaaaggcagatagctcagttacataagatcactcaaggactcaggttctataatgaatttgttcaattatctcttaggatgttgtcctcatgtacatggttaaagtcagacacatctttcaattcggaggaagagggaaatttcaagcaaaagtggagggaaggcaatttccttttaagcaaatagtgaggaagttgcatacatcacttttattcacattccattgacaaaaattttgtccatggccacacttagctgcaagggaactaggaaataattgtctgaaactcagcagccatgtgccgtgttaaaattattatatttatggaaccaggagaaaacttttttttttttttttgagactgagtttcgttcttgttgcccaggctggagtgcaatggtgtgatctcagttcactacaacctccacctcccaggttcaagagattctcctgcctcagcctcccgagtagctgggattacaggcagactccaccacgcctggctaattttgtgtttttagtagagacagggtttcaccatgttggtcaggctggtctcgaactcccgacctcaggagatccgcccaccttggcctcctaaagtgctgggattacagacgtgagccactgtgcctggccgggagaaaactttttaagaaaacaatcagcagtctatatagtctaccctactgacctttcagtgtctgtgattacctatattctcacacatagacactccctctctcccaagggagacattccaaggctcccttggattagttcatctgctcaaagtcaagaatacccggatggtgcacattcctgattttcaggtctgtgatggtccctcacagttcactaatgtgttttctgttcatctcacatccagtatacaaaagtggtaggaaaaatataactgcaataaaagctgtcattcagaagatggaagaatgggaaacatgtcacagtcagtccgtaggaatttccaagattcttgctatttcagtagaggagatttcttggttagcctgtgtagctgtcccctggttctaatttctaagaactacaccattttccattgtcctccatggccatatctaaagttggtgttagaggccaggcgtggtggctcacacctgtaatcccagcactttgggaggccaaggcaggcagataacttgagatcaggagttcaagatcagcctggccaacatggtgaaaccccttctctactaaaagtataaaaaaaaattagctgggtgtggtggcaggtgcctgtaatcccagctactcgggaggctgaggcaggagaattgcttgaaccccggtgggtggaggttgcagtgggctgagattacaccactgcactccagcctggacaaaacaatgagacttcatctcaaaaaataaaaaaaaaataataataaagttggtattagagaatagtacatcctcctagggagctgcacactttcaaaaacttgctacttgtggagatttggaagcccaagagttgtgttagtgatcaaacaaatgactcttttttaggccaattttgatttcttttgggaaataattctctgaatacttttgtcgacttgtggtctttttgcttgcattcagttccttctgagtaaacaggtctaaagatttcttctagacatagttcctaaatcttctcatttatttgtttacctgtttgcatttaatggcccatcctttttccctccattttaatggtggttaccctgaggctagctaaaatcacaaactggagtcagaaggcaataccattaatttgatctttgcctgttagctggctgtatgttttggctgagaagtcttaatgagaggtacttaggaaaaatgtagagccttttaaatccttctgtttggggacaagtagtttgattttctaatcctgtatccttaaattactgtacttaatcagtttagattgtagaccatgttctctgaagtgacaggtattataggcacacagtctgccttccaagttatcaaaggcagtagttttactaaatattgtgacatgacataaaaaggatcattagttttccagactgcaatattggttttttcaccttgatctttactcagccacaaagccaagaaacatatttgacgttttaagtttttattttggcagtaaatcaattctggttacctatcccaaaatataataccttaaataagaattttttttctttttatgtgatggtatgtggagatagcacatggtccagacctttatgcatctcagctccatgagatcattcacagacttgtgttcttttcatcctgttgttctgcagcagtatttctcatgctcagaactattggcattttggggcagttaattctttgttataggtggctgtcatgtgcattacaggatgttcaacagtacccctcatctctacaggatgcccataggacatgctcagttgagacaaacaacatctgcagacattgcccagtgttcccctgggggcaaaatcacccctggttgagcatcattgctttatagttgcctaggatctcatcgtcatctgcatgatcaaagcagattttgatccataatgaagagaaaaatcaatcattcgaaatcactctagattttataattggcagacaaaaacattaatactgtaactttattccatatgttcaaaaaaataagtaaagaaatgcaagatatttaaaaagaaccaaattaaactttaagagataaaaattacaatgtctgatagaactaagaaatacattgaataggatgaagggcagatgggacattgcagaagaaaagattagtgaacttgaaaacatagcaattgaaactattcaaaattcaatacaaagaaaaagcaaatttaaaaaaaggcagaaaggagcatcagtgagctgtgaaatccttcaaaaggcctaatgaatgtgtaattggaggacctgaaggaaaggatgggagtgaatggtgggcaaaaagcacttgaagaaataatggctgatatttttccaaatttgatgaaaatttttccaaatttgatgaaaattatagacccaagaagtttagtgaattccaagcaaaagaaatatgaagaaaactacatcaaggcgtgttatgatgaaattgctcaaaaccagtgataaaggtaaaatcttaaaaagcatccaaaggaaaaaagataatatgtgtaaagaaacaaagaaaagtatatcagcagatttctccttagaaacagtgccagcaataagacagtgggaccacatgttaaaaatactaagcaaaacaaaacaaatgcaaaaatgtctctcaaaaactaagatgaaatgcttttatagacatacaaaagctaaaagaattcatcactaggagatctggattactgaaaatgttaaaggaagtcctaaggaagaagcaaaataatacttcacagaaatatgaatctgctctatgcaaaagaattggggagcgtggcaaatggtacctatgtgggtaaaaatgtaataagagtacaattctgtattcttcaggtcctttctttgcttatcactttggtgggtttctcttcctctgtagctttcaacaataagtccttgaaccttctgcattttttttttaagtcagagtctcacactgtcaccgaggctggagtgtaatggcgtgatctcagctcactgcaatctccacctcctgggttcaagcgattctcctgcctcagcctcccgagtagctggaattacaggtgcctgccaccatgcccggctaattttttgtatttttagtagagatggggtttcactatgttggccaggcttgtctcaaactcctgaccttgtgatccacccaccttagcctcccaaagtgctgggattacaggagtgagccactgcacccggccaccttctgcatttttatattgcattattgcctttggagaagtcgtaaatacacttttcaaaaaaagtaatttctaatttttgtcctaacccaacttccaatttaataactgtagtgattctatataaaatcttcagtgggccaggcaacttgtgtacagcacaacttcagggataccattcccatagactatgattgcacatctgtacatcatgtttctgattataacactgcattcaccttttcactctcccatcaaaagtatttgagttgaacttgagtactgtttcctaaaaacatctttatctcatatatcatctccccttttctttgtataatactgagccttcctagcccttatgttgtggcttaaaccccaccttctttaaaggatgattctaaactctttctgcccaaaatgaacatctactgtgattataccatgtgtcattcattatgacaccaaaatgccatcttgttgttatttagatgttttgtatgtgtatgtcttgtcttgaattcttcaattaaactgtttattttttaaagacagtgtgaggctgtttatcccctaggagagcaagtgaagttctgcatgttcagcaagcatccctaatcccagaattgatgcataaagtagcaaaaggccaaaggattattaaccttatgttttttccagttgttctatttaagcaaactacaccccatctaaaacaaggtttgaagtagtttggacttttccctaaagatttgatttctgcttggttttgaagttttgtattagaaagaaatcatactaacccttacttcatttgattaatatttgttaattgtttatatggtaaatacaggtctcttcacatagattatgtatactgaactcctttcttttgaatacaaaagccccatatttcccaaatttagtttttatttaaacaatcatatcctggatcacctgaggtcaggagtttgagaccagcctgaccaacatggtgaaactccatctctactaaaaatacaaaaattagcttggtgtggtgggaggcacctgtaaaaccagctacttgggaggctgaggcaggagaattgcttgagcccaggagggggagattgcagtgagccgagatagtgccactgcattccagcctgggaaacaagagtgaaactccatcttacaataaataaataaataaataaataaataaataaataaataaataaataaattaaataagccctaattaaaatttccctcagtattaccagtgttgggtatggcctcacattgtttccatcctgcttttcccatatttaataggccctcactgactcctgaatattgaaaattgagttcaaatacatagtttattcctcgaaatcctccctccatactctgctcagatggatgattccaacctcaccatggatctctgctctacctaaactggaagtggactcaagattagccacacataccttacgcttgcctgctttctgtctgggaataggcttcctccagccttcctaaatctcatgtttttcaagtctagctcctatctaacccctgatcatcagttaccttcctctatttttacattatcatcctaaatagagataactcacagggaatactgttgtattatagtttacttgctaaagtacatgcttttgatatatatatatatttttattatactttaagttctagggtacatgtgcacaacgtgcaggtttgttacatatgtatacatgtgccatgttggtgtgctgcacccattaactcgtcatttacattaggtatatctcctaatgctatccctcccccccacccccccaccccacaacagtccccggtgtgtgatgttccccttcttgtgtccaagtgttctcattgttcaattcccacctgtgagtgagaacatgcggtgtttggttttttgttcttgcgacagtttgctgagaatgatggtttccaatttcatccatgtccctacaaaggacatgaactcatcctttttatggctgcatagtattccatggtgtatatgtgccacattttcttaatgcagtctatcattgttggacatttgggttggttccaagtctttgctattgtgagtagtaccgcaataaacatacatgtgcatgtatccttatagcagcatgatttatattcctttgggtatatacccagtaatgggatggctgggtcaaatggtatttctagttctagatccctgaggaatcgccacactgacttccacaatggttgaactagtttacagtcccaccaacactgtaaaaatgttcctatttctccacatcctctccagcacctgttgtttcctgactttttaatgatcgccattctaactggtgtgagatgatatctcattgtggttttgatttgtatttctctgatggccagtgatgatgagcattttttcatgtgtctgttggctacataaatgtcttcttttgagaagtgtctcttcatatccttcacccactttttgatggggctgtttttttcttgtaaatttgtttgagttctttgtagattctggatattagtcctgtgtcagatgagtagattgcaaaaattttctcccattctgtaggttgcctgttcactctgatggtggtttcttttgctgtgcagaagctctttagtttaattagatcccatctgtcaattttggcttttgttgccattgcttttggtgttttagacatgaagtccttgcccatgcttatgtcctgaatggtattggctaggttttcttctatggtttttatggttttaggtctaatatttaagtctttaatccatcttgaattaatttttgtataaggtataaggaagggatccagtttcaggtttctacatatggctagccagttttcccagcaccatttgttaaatgggaatcctttccccatttcttgtttttctcaggtttgtcaaagatcagatggttgtagatgtgtggtcttatttctaagggctctgttctgttccattggtctgtatctctgttttggtaccagtaccatgctgttttggttactgtagccttgtaatataatttgaagtaaggtagcgtgatgcctccagctttgttcttttggcttaggattgacttggcgatgcgggctcttttttggttgcatatgaactttaaagtagttttttccaattctgtgaagaaagtcattggtagcttgatggggatggcactgaatctataaattaccttgggcagtatggccattttcatgatattgattcttcctatccctgagcatggaatgttcctccattcgtttgtgccctcttttatttcattgagcagtggtttgcagttctccttgaagaggtccttcacatcccttgtaagttggattcctaggtattttattctctttgaagcaattgtgaatgggaattcactcatgatttggctctctgtttgtctgttattggtgtataagaatacttgtgatttttgtacattgattttgtatcctgagactttgctgaagttgcttatcagcttaaggagattttgggctgagacgatggggttttctagatatacagtcatgtcatctgcaaacagggacctgctttacttaaatgctgtgtaaagaatttggtggaagctctttgaaatttttcttcatttgttactcttctctggaggagctctgcatttccgcatgggatgtcagtttgcatcacagtagagaatggacattttgtgggtaccgtggattgagctagtggtattgagagacaggactaagctggatttcctaggccgactaagaattcctaaacctagctgtggacggtgaccacacccacctttaaacacggggcttgtaactcagctcacacctgaccaatcaggtagtaaagagggctcactaaaatgcaaattaggctaaaaacaggaggcaaagaagtagtcaaatcatctatcatctgagagcacagggtgagggacaatgattgggatataaaccccaggcattccggagctgggatcgggcaaccccctttgggtcccctcccattgtatgggagctctgttttcactctattaaatcttgcaactgcacactcttttggtccatgtttgttctggctggagctgagcttttgctcaccgttcatcactgctgaatgctaccatcgcagacccaccgttgacttccagccctctggatcctgcagggtgtccgctgcactcctgatctagtgaggcgcccattgcccctcctgatggggctaaaggctcgccattgttcctgcgtggctaaatgcccaggtttgtcctattctagccaaacactagtcgctgggttcaacggttctattccgtgactcacggcttctaatagagctataacaccgcatggcccaaggttccattccttggaatctgtgaggccaagaaccccaggccggagaacaaaaggcttcctaccatgttgggagcagccgtcaccatcttgggagctctaagaacaaagacccaccctgcccccgccgcccgtaacagtatgagggagtaccagataagaaatctaaatacattcctaggtcttcctgagctagttcttttttgtaatgacttcattattcaagttaatgcctaatacctaagagatattcaaatagaattgcgacaacttactcaaatctgtattcatcttcaatttgaaattagtactgccattctctgttgataattgagaggttactgaacatctttgcatctttgatatgttttcttcttcttcttcttttttttttttttttttttgagatggagcctcactctgccgccaggctggagtgcagtggcgtgatcccaggtcactgcaacctccacctcccgagttcaagtgattctcctgcctcagtctccctagtggctgggactacaggcgcatgccaccatgcctagctaattttttttatctttactagagaaggggtttcaccatattggccaggatggtctccatctcatgacctcatgatcctcccgcctcgccctcctagagtgctgagattacaggccgtgagtttttcttcttcttcttctttttttttttttttttttttttttttgagacagagtctggcttgtcacccaggctggagtgcagtggtgcgatctcggctcgctacaagctccgcctcccgggttcaggccattctcccgcctcagcctcccgagtagctgggactacaggcacccgccatcacgcccggccaattttttgtatttttagtagtgacggagtttcaccgtgttagccaggatggtcttgatcttctgacctcgtgatccgcccacctcggctcccgaaagtgctgggattacaggcttgagccaccgcgcctggactcagtttttcttcttttatttggataactatagatttacctacttattctctattcttccttctctttagtgctctgttgtcaatttattatatttatcttatctcagatttcttttctttcttttatatgaccagtgtgcaatccctcctatattgtggtgggaggtgggagaggtttaccccagcaagcgtgggactggtagtggaaacatcttctacccagacatggtaatgttttattttgtaaaggttgagttgagtagatgaactgaaggaggtaattgagacaagtgtgggccatcaagcaagactggcctgaggggcatgtcaggaatcggagttcaaagccaagaatagaccaaactgcaggaaagcaaaagcaaaatcaaaatgagtgtaaaggaaggcagcctagaaatgggggtaagggtagtgtgtggagagcaacgtgggtgtttacctggtactaggcttttacatgttctacaagcccttgcatggttgaggaagctccattttgaagaatcagtattggagcagaagccaccagtcagtttcttcttgattattaaatcataagcaactcctccttaaataaaaagtaatgaaagatggcatattttaaataggacccattgtattctcagtagcatttaaatgaaaaggtatgttttgggggtgagaatatactacagtatttcacaatacaatatttccatatgagtgattttattttatttttttatttttgtttttatttttgagacagagtttcactcttgttgcccaggctggagtacaatggcgcaatctcggctcactgcaacctctgcctgccgggttcaagcaattctcctgcctcagcctcctgagtagctgggattacaggcatgcgccgccaatcacaactaattttgtatttttagtagagacagggtttcactgtgttggccaggctggtctcaaactcctgacctcagatgatccacccatttcagcctcccaaagtgctgggattacaggcgtgagccactgcactcaccctgagtgattttaaaatagagaattgtcttgttctgagattaaggttagcttatcgttcagctactgtttcagtaaaataaataattccagtaaaggaacgataattgtagttatcttggcttggtatattatgctatggttaggcaattttagagtaaagagaagaaatcaaaagctcttgcttagcacacttgctgcttaggcattcttgttggaaaataatgcgttctcatttcagagcaaagacagcaaagctgactctggtatttggagagctaaaggagtgaaacttcttttaagaacgggaccattcgagccctgtaggagcttttgagcatgcgtattcaactgctcactctcatgtctataacccacgctgcttctccaccgttatgtgcagaccataagccctacagtggtgacagctgcttttaggcccctttgccttaaatacagtagaatgcttatatattagacttttagttcttgaattttggctagatatttcaactttcatttaaatgttgtaacatcccatgatcagagcattataacctggagtatcactgataggaaagaaatagtaaaaaaaagtatgtaaatatgtaaatgtaaacataaatggaaatttgaactcagttatttgactaatgtgtgtataccatctggctaactccatttcaaacaccttatgcatttacttgtagtttttatcttctctaaatataataacttgtagaggaggagtgtggaagagtcttccatttaccaaagtgatttctgtgtcattttcttgagtttgatttcagtcttgtgactggtaaattctaagtatctgcccttttgagcaaataaacttgtcaatcagatattttctaaaggggatattttttgttaatattagtttaggttcatgtggacattgtttaaaaagctttgggaactttaatgattggattttataacactttattagttatagccaactatgttactacttccatcaacacccatactctgtttctttgtgaaatgaaaaatattgttttatttgacactctcctccttattatattgtacacagtaaaatccaaacggaagccaataacttctgaactctaattgtgtccatcctgtaaagcatatgggtttgttcactgattcacttccagagaactaggtcatcatcatgagaacccccacattccccaaatcaaatttacatgttcttgaaggaacaccaaatggtaatgagtactttgctaaataacgttgacctttatttattttcttatggattttatgctgctttactatgtgtcagtatccctcccttcttttagaaatccataaacattgcacttgctttcattttgaactttcttcttactaatttagacattaaataaaagagacatatatgcttattatcccctagtttaatatatatattttaaaaagttaagctgatattttaattttatttcttcacgtgagcatcatttattcatttgttcatttactcaatatgtatttaaatgatctctgaccacagtgactaaaaactgttgggtactagaggtgcgaaaatgaatatgttgtgtggttaatctcagagtttcactgggaagtaggggagacagacgtgcctacaaataattgtcgtagaagagttgttattgtagggtcataaatgggacaggatgcaaaggcagaggagggaagtaatgacagggatgacttgaaagagaaagtgaggctggacatagtggctcacacctgtaatcccagcactttgggaggccgaggtgggtggatcacctgaggtcaggagttccagaccagcctggccaacatggtgaaaccctgtctctactaaaaaaacaaaaatgaaccgggcgtggtggtgtgtgcctgtaatcccagctacttgggaggctgaggcaggagaatcgcttgaacctgggaggtggagattgcagtgagctgacattgcaccattgcactctggcctgggtgacagagcaagactctgtgtcaaaaaaaaaaaaaaaaaaataagagaaagtgacatctgactcttgaaagattagcaagacaaaacaaggaatgatgttttaggcaacaagaacaatatatgtagataagaaaagcataatttttaaaaagcatatttgggaaataatgagaagtttcatgaggacattgggcatgaggggtcaaggtgacagatgcaattggaaaggtaggatagatctagcttgtctgaaggatgtcttgtgctttgaacctgtggaccagaggatatggatactttcagacaattgcatgatcaaatgttttgttttaggaagataatttggaggcgaaaagactgaaatgtgaaggtactggtaatacatatggagaatagttaggatactattagaatagtctgggggagaaataatgaaggcttctttaaccaaggctgcaacaataggggtgtagaggggcaaactgagcagcatttcccaggtactgtagggaacttgggtacagttggatatgtgagacaacgaatagtgagtcattactatcctccacttttcttttatcttccttttaaaaacttccctgtcctggtctctctttaattttaaggaaaagagctgctaaaatgtgtgctttatagagaaagaagcttactagaccttacatgttctcacttatggcatttagtgataaccagggtgtccctaagcaattgaatagtgataccagaccagcttctgcatggtacagctttaatgtattattgtttgaacttcattaataattagacttgcgacgaaagtaaccagttcaagtgatcttataatcaactttgtgcctcagcacctggaactttgagagagccactgtgttcatttatcaggaggcattctgcttcctctgtggtgtgccattccctgacttggtaaagaatattgtctctctggcagttttgtattagtgagttatacaaaggaggtcatagcaaaccacctgtactttagaaagttaacacagaaacactgaagaggtatttcttctttgtggtacttcttatattcaagcttggctctatttccgtagcacaccagtccaggctctcattttctcacattcgattgactacaagagctttctgacttgtctaccttcagtctcttcctctcttaagctgtcctgccctctgctattagattaatctttctaaaaggtaatcttcgtagcattcctcacctacttgttgtccagtacccatctttttggaattccattttcatcataatttggcctcagatgtacttactggcctcaaatgtacctattggacacattgggatgaagtcttgttctgttgcccaggctggagtgcaatggcatgatctcggcttactggaacctccatctcccaggttccagtgatcctcgtgcctcagcctcctgtgtagctggaatcacaggcgtgcaccaccacaactggctaatttttttgtatttttagtagagatagggtttcaccatgttgcctaggctgttctcgaactcctgagctcaggccatcctctctcttcagccacccaaagtgctgggggttcaggtgtgagccactgcagtcagcctgttttatgcttttaagtttcttctctttcctgaagtagttgactgttacataacatgtattatccaaagttcacaggatactctaaataccaatattatgatatccttatttttaaatatagaaacctttctcctcttaccaaaaaccacagtgactcagctacttgcatgtctaaaatggtctctgcatttttctgtggctagtctttatgatggttatagatcagtaatagcctttttggaagcataatattatgtattaatcatggcattcttaaggaatcactgcaattaaccaggtagaccaatttagttggaccgtggtctgtttttttagtatgtaaaaacatgggttcaggggattaaaacaactcaacattcatgaagaatatattttcagatgctcttacattccctgatttttcaatactgctacgatttttttttacagagtttctttacttatgaaattgatataaaataactgccttgtcataagaatgtataataactgagaagggcaaagactgtaagctaaatttactcagcatctgctacatgggagtgactcagttcattgctcagcaaacccacaagttactgtgttgtgtctctgtggggtctcctggggagaacagaaacaataaatgttaaatctgtaaatgtgtcaaggggtcactgtggttgactcttggttgctaaaggaaacagaggttctaaggccctgtaaaattataatatttcaaagtgaaaatgaatgaattaatagaagaagctgagacaaggatcttattttgtgtttgttttcctctcaatacccttgccaattaacattttttgaatctcttgctcttctccactgtaagcctgccctgatattttctaattggatacagagataatacataactggccaggtgtggtggctcatgacagtaatcttggcactttgggaggctgaggtgtgcagagcactggaggccaggagttcaagaccagcctggccaacatagtgaaaccccatctctactaaaaatacaaaaaaattagctggctgtggtggctcacacctgtggttccagctgcacaggaggctgagacacgaggataactgaaacctgggaagcagaggttgcagtgagccgagatcatgccactgcattccagtctgggagacagagcaagactttgtctcaaaaaaaaaaaagagaatacgtaacaaagaagtaagaaaacaatttcaagtggtgataaatgtcataaaagaaataatacaaattttttactgcccttcattagataaagatagtaagagagaaggcctctgggccgggcacggtggctaatgcctgtaatcctagcactttgggaggccaaggtgggtagatcacctgaggtcaggagttcgagaccagcctgaccaacatggtgaaaccccgtctctactaaaaatacaaaattagccaggcatgatggctggctatttttgaatgccagtaatcctagctactcagtaggcggagtcaggagaatcgcttgaacccaggaggcagaggttgcagtgagccaagattgcgctattgcactctagcctgggcgacaaaagtgaaaaaaaaaaagaaaagagaaagcctctgtgagcaaaatgacattggaattgaatgatgcagtagagctagccatatgaagattggcggcaaaaacggtgcagaggcccttctgaaattctgctgcatctatttgaagccatgagtgtgtgtgtgtgtgtgtgggcagggggcggggggtatgtgtttatgtatggtgggagagctagagtgggaggaggctgtgcaatctattaccacctttgtttcacaacatggacttgtccatttcaagaaaaaaaaaatgaggctgagcgtggtggcttacacctgtaatcccagcactttgggaggctgaggtgggtggatcacttgaggtcaggagttcgagaccagcctggccaacatggtgaaaccccgtctctactaaaaatacaaaaattagcctggcgtgctggcacgtgcctgtaatctcagctacttgggaggctgagacaggagaattgcttgaacccaggaggcagaggttgcagtgagccaagatcgtgccattgcactccagcctgggtgaagaagagagactccatctcaaaaaaaaaaaaagaaaaaaaaatgaatgtccctatcttgacatattaattttgtagaaataaattcacttgctaatacatgggttggcccatataactcctccattgaaaatattattttttacagtgacagctgttaaacatatacctaacattctatgtaatatgaagatgaagatgttagagattgcaaatttaatagggaattggagatggaccataggaagaaggtagagacaattcacaacttactaggatgagtacaacacctcattattttttaacagcaatgacaatacacacacataaagataaaaaaatgctggtctagcttgagaggatcagggaatagtctagattctatacacgataattttaatctgatcaattcaaaatttaaaaacaggcttctgctaacatatgtttataccttctgcttaagcttgaaaataaatatgagctttatccacactgtccaggaaaggggatgaacgaactgagatagcattccattttcaagcctgtgccactaacatggcttcaagaaagcagctcttacagagacgctgtggctgagctgccaaggatgtagctccttgaactgttcatctggaaaagaaagtgcttatcagttaaaaattgagaaggcagatgtgctttattataacaactgtgtgtttagaagtgacagttctcagggcagacttgtggataccccttctcaactcaacctaagaatcttagattctttcttaccagatggcaggctcaggttcctgaccagttccacgtggaataaagtggtgaagcataatctttctaataagataggttctttatgggatacattacttgaaagaccagattacagtgcaggaaatgctaggttccctgccgtgcatctgtgctctgaatatcttggcttcctgactctgcctctgacaagttttatgatgatgagcagtcacttatctactgcctcagtcttttcaacaggataaacatgttagaccttggtgttttctagggtccaacaaggtttcattactttattattctgttatatctagagtatctgtttcagtttgggcagccctatgagagatactgtccaaagtgtgttcttgaagtagcaagcatgattgtgaatagtctagaatggtccagaaaccacctcataggagacccagtttgcagcagggatgattagcttagagaaaagaaaattaagactgtctttgaatattttaattaacgtcacgtggaaaaaaagaagtagacttagtctgtgttgctgtaaaatatttaattgaggtgactcttataggaagtgctctaaccacaaaaggaaaaacaaaacaaagggaacaggaggaaatttttagagatgatggataagtttacggcactgatagtgataatggtttcacaagtgtatacttatggcaaagtacatcaaattatacatataaaatatctacaactttctgtatgtcagccatactcaataaagcaactaaaactatatataactgagcctagttactagaagtttcagatgtctggcttactatgtacagtatagccctttcctaaatgtccagtaataagataagcagcctattgagctacatgtcaataatgacacagaagtagaaacaggccagtgcggtggctcacgcctataatcctagcactttgggaagccaaggcgggtggatcatctgaggtcaggagttcgagaccagcctgaccaacatggtgaaaccccgtctctactgaaaatacaaaattagcagggtgtggtggcgagcacctgtaatcccggctacttgggaggctgaggcaggagaatcacttgaactcaggaggcagaggttgcagtgagccaagattatgccactgcactccagcctggttaacaagagcgaaactccatctccaaaaaaaaagaaaaaaagaaaaagataaagaaaaaccaagtagaaacaaaatgactctctacagaccataagacattcttacattaataaaggcattacagtagaatctgatcacaaggattggcaataggtattagtgatgctaccaagactattcagaatgttattaaattgcttttggtaggggaaagttctcctttctatttaaaaacaaaaaaccttctttaacagttatgccttaaattttacaaggttagagcattcctaaaaagctaggtaagtctacaatattttacagagatgctataaacatgtgacctcaaccacctaccaaaatgtcaggtaactgcacagtatcttctatattgtactctaattcttcgatgtttgagttccaactataaaataatgagactcatttccctgtgatacaacttgtaagctcagtctcattacatttcattttagcttttaagtagcttgaataatccttaaagttagaaagcagcatctgatctgtctttctatatccagaagcatatagtacagtgttgagcaaaatcaagacttttttttttttgagatggattttcactgtgtcacccaggctggagtgcagtgtcatgatcttggctcactgcaacctctgcctcccaggttcaagtgattctcctgcttcagcctctccagtagctgggattacaggtatgcaaccaccacacccagctaatttttgtatttttagtagagacaggtttatgatatgttggccaggttggtctcaaactcctgacctcaagcgatccgcccacctcggcctcccaaagtgctgcgattacaggtgtgagccaccatgcccggcccagaatcaagacttgaatgaaagaaagagtgtgatttgtgcaggattttacactaccacgatggcaccactactcactgtgtcatctgtattttgacctgtttgctggatcttaggaacttgcaaaatcattgaaggttcatctttttaaaaattgtcaatcaggcaaagaatagctagagaattaggttttgctctcctagtcaagaagggcatggatcctttgctacttattgatgtgtctgtgtcttagtgaaccgaagaggcaggtgatctgacaggaatgtcttttcagtgtttgactaactctctttctattgtgaatatatccaaagttctttttgtctttctaaaccctaacccagataaacgcaatgtatttttacacattttcttttcttctatgtgatttcctggaaagaatgaaaaaaactactagttgttgagcacctaccatgtgctaggctctacgagaggttcctttatatgcattaatttattaaattttcagagcagctttgccagctaggtgatgttgccatacagaagctcagagggctaagtaacttattcatgtcatacagctagtaaatgtgactaaaagatgatgtaataagcaatgccctgttttggtcttagagatatatttaattatcattactcttggatttttgtctaggcccatcccagtagtataaacccacttttgtctgcatctactgtggacaacaaagacatacctacctcatagcacacagtgtgtcaccccttttatagtgtccatcacaccctactttatctttgtatttggatacctccctgattttaagctcctgcaggtcagaaggtgtttcctttttcatttttgtaactactgaaataactacctagcatgttttgttacattcagttttcttaattataggtccatgaattaagtcaaatgtgcttttcattttacaatggaaatctatatgtgtcctgaatatgtctgataaccatgacacagtggagtggttcaggaagagcattctcaagtgcaaggctctaactgggattgcagcactgaccacctgcttccagtactccagagaatgacacttctagtcattagaccatggctttgggaccattgcctggttttttctcttactctctcttattgggtatgaaaggattcagaatatgtcacccctcccccccagtatatcactgtggcataaggattattttgaggtaaaggcgattaaggaaaagcagacataggacaagctctctgccatcccccgtatgcctgaaagtcaagcataaattcctcttgtgaaggtgcctcgccactcactttccataccagcaaagggatagcaaccttataaatggagaggagatggcaccaagaaagagtctatacaaacaaaccttattaactagtctttatctgtcataagtttccccatatatttgccttcctacaatttgtcaccctaggagctcaaagtccttttcctttgttttatcacttctctacagaagtattgttccttattaacatgctaataaaccccaagtcccaagtttttgtttttctgagacagggtctcactttctcaccaaggctggagtgtagtggcacaatagtggctcattgcagccttggctttccaggctcaagtgatcctcccacttcagcctcctggttagctcagactacaggtgtgtgccaccatgattaattattgttgttattattataattatttatagagacaaggtttttgccatgttgctcaggctggtcttgaactcctgggctcaagccatctgcctgccttggcgtcccaaagtcctgggattataggtgtgagctactgtgcctggcctcagccccaagtactaaccactcctttgagttagtcattactgagtttctcccatgtgtgtgcatactacatgtgttaataaagttctgtttatgtttatcttgctaacctgtattgtctcagacttatttgcagggccccaggcagagaacctaggaggatagagggaataagtttttcttctctatgggtgattcatccaaaagaaatgtgagaaatcatgcattattaactagttaaatcggaagagtttcttttctcttattccattttatggactactttataactcagaaatgttttctgtgaagtgttctgttgggtacatgcttataatcccagctactcagtaggctgaggtaggagatcccttgagcccaggagttcaagatcagcctgggtaacacagcaagacgccatttcaaaagaagaatgttctgtgattgttctgtgatttattactgaatcgcaacaacaataaaaaaagtatttgggatttggggaggaagaggaggaaaagctcactgaaatgagtgatgcttttagggcttcaaaaatccctagaatctcttttttcatttcaccaagtagtgttctagaagaatcattttacctgatattgatgaacattctattctgaaagaatatcctgaaaaaaggaccagggcagaaatgatggaaattttgaatgcaaggatttttgaggggaagcatgaaggaaacatgagggatttttgatggggaaactgaagtacatgaccacttgttgtagtgccttgtacacagcattttgttaaacatacctaactgttttaagtgaaacttggtttgctcattaagataacatattttgctgggcacggtggctcacacctgtaatcccagcactttgggaggccgagacgggtagatcatgaggtcaggagttgaagaccagcctggccaacatggtgaaaccccatctctactcaaaatacaaaagttagccgggcatggtggcacatgcttgtaattccagctactcgtggggctgaggcagcagaatggcttgaacctgggaggcggaggttgcaatgagctgagatcacgccactgcattccagcctgggcaacagagcgagactctgtctcaaaaaaaaaaaatcatattttaattattacatttaatacatagtatatatgattttaacttctttttgtgagcatcagagccaaaccatacagttccaaaatcattttgattaatttttacttatttttactggaatctttttgggcaagtcctgtttctggtttatgtaagaaaaaatgcttcagctagtacttttcaagaccaagttagttgagtggaaacatcttccctaccctttaaaaagtcaactagaaaaaaatcctataacctaagaagtcactgaattcttcattcacatttaagagcaattcaggatgttcccttgttcttaaatgtgaaatgtctatggcagtgctgtacatagcagtagcacagtcctatcaaacaaaatttaatgcagaacaccagtatatatacaaggtaaaaatggagctgaggggagtgtgtgtgtgtctaaatgtgcgtggtgttgggggggtgtgtgtgtgtggtgtgtgggatgtgtgtgtagggggtgtgtgtgtggtgtgtctgtgggtgtgtgcaggagggtgtggggggtgtgatgtgtgggggtgtatgtggtggtgtgtgggcgtgtagtgtggagtgggagtgtgggtgtgtgggggggtgtgtggggagtgtgtgtgtggtgtggggtatggggaggtgtggggggatgtgtgtgtgtgtgtggggtgtggtgtgtggtgtgtgggtgtgggtgtgtgtgtgtgtttagggatacagtatgaaaggcccagaaccttttccttcttatggcctccctcttccagctgaacctatcctcatcctaggcagtacatcaaacatttactccagaactttaggacctgaaatttatttgtatatacgtaatattctatgcttatgatcattttacattaagatctttactttgcatagttttttgtttttgtttttagagatggggttccactatgttgcccaggttagagtgtagtggctgttcacaggcaggaacgtagcacattagagcctggaactcctgagctcaaaggatcctcccacctcagcctctggagtagctgggaatacaggcacacactactgttcctagctctactttatttagtttgttaagaaatcattttagcactttgggaggccgaggcaggcggatcacaaggtcaggagatcgagaccatcctggctaacacggtgaaaccccatctctactaaaaatacaaaaaaaaaaaaaaaaaatagctgggtgtggtggcgggcgcttgtagtcccagctactcgggaggctgagacaggagaatgatgtgaacccgggaggcagagcttgcagctgagatgctgccactgcactccagcctgggtgacagagcgacaatccgtttcaaacaaaaaaaaaaagaaatcatttttggaagagataaaaggcttgacagcaatatataaatatttcatttaaaataacttgttaaataatacttaaatgttaaatttcttaaaattcttgtttttctgagattttggaaaaacaaaaccaaataatatattgttaagggaggcagaatctcccttcctatttctttaagctcattttcataattaatctatttatttaggcctacagacatacatcaataaatatgtttctatttggttatttgtagatatgtaactcttatttgtcagagtagaaaactaagactcacaaaatacatgctctggctctcttagccttgtttctctttgtaccatgctataatttgtatggagaaaccagcctggtacttaagagagcaactacagaaccacagaatcaagatgctgaatatggattagttaattgttaggataaagttaagagactgtccctatggtgatttggtcattttgccttcatttggctacaactgattatttattcacaacaagtaaactaatataacacattagcactaagattgtaaaattttgaactatggataatttttatattactggggaaggattaatttgaccagagatttatcagaacaatgttttcaactattagctgagtgtttatcaaggtctgtggcatacaaaagttatttttgctttgagaatttcaattctaatagttctttaaatgtatactcttaatacgtgttaggtttttattatttatcatattgcttgtttacaaaaatcttccttttaatcatggccagccttcccagaatcctgaaatgcttcttgtatttgcattgcaaagagtcattattattgcataaacacttcaacttgagggtgtgtcatttcttggttgcttggtctttggctcttctgtccatactctatcattttaccctaatacctctcttctgtagcggtttcagtcatctaataaggattggaacatcccactttaaatccaagtataagatctattctcgttgttagaaagcaagagtgaataaaggtcagctgttcagatgactggctgtctgatttttttctgtgagcgtcacatgttaggaaaagctagttcatctctctgtggcttaggattcaacagcataagctgtcagactaacactgattgaaggtagactgggagggggaagcgcatctgtccaatggctcgccattggcttcttattacagcattctcccctgagacacactctgcatgctcattcacctacctcctcctcttccctccccttccttccctaccccttcattactgattcacagcgagaggcagcagcagcagcagtagcagcagcagcagcaacaacagcgctgcttgtcacgaatcgaggattgcaatgagctcatcgttttctccttgcagcttcacaactgccctggcttcctggctactgctgctgctgtcttctcacacatagacacgcacacacaccctttctcgcacacacacacacacacacacacacacacacacacacacacacacacactctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttgtgcctcggcttctggcggtgagattgtttttcattgaacttcatttgtagggaatctgctatcctctgtgaaaattccttgtatctctgaaagaggcttgttgtctctggttttcttctccttctccccattctgccgagaaggaaatgctgagtggccactgttgtgcagctcatttggagcctggtccacaccaccccttaattggttagaggagatcatggctcttttctcagagcccagggtcacattagtggcattatctctgtggcagcaaaaaaatggttttctgcctggctaggctcagcaataaagcagaatacccaagtgcttgatgtaggcattctgttatgtatatctccaaagggttaaattttacaacagacatagcaacttatctagactgtgtgtggtttgctttctaacctccccattagattgccaatttgattgttgttttgttttgttttttgatagagaattttaccacctaaaaatactttggtaggaaattttaggtttctctcctagaatgattgaactgtttatctgtgaaacagcttaaagctgctggcttctgtgctgtgaatctgggaagtctgacttgcttgttatttgatttcctgaataagagaaaaatcacccttcctcatttcctaccaagggttaaaattaaatacccacaatcgctgttgcaggcttgagaactatacctagcaactattctataaggtaattggtttacagtagtcctataccattatgtggtaatggaataagaataatttagccttgtctgttttatagaatggagtttaataccattttagactatttcctcactatggttctctcatattagagtcttttcagtacagtatttacatgactgaatttaactcttttctctcctatatctcccttcactataattcatctctatttatacttatctttacaattactagttcagtctttatgtatgtatttacatgcaaatataatctcttctgtacaatcataacagacatgttagatagccatgtaaataagaaatttcccatcctaaggaaagtctatttgtcattccaaaacaaagtttgatgcagtgactagcatacaattataggggggatatttttgagaaatgtagttcctttgtcatttaaagaagaaataaaaagagctgaagacatgtgttttaatgtccaggtgaagtcattacttccctgaacctcatctttttcttaaaggagaaaactaaggattcatgattctatttagaaaggagttttgttttgttttgttttgttttgtaagtgaaatgagaagcattttatttcaggagttttgatattgtgaagtgctaaactatatttcaacaaattctctacatctctgaggaatcaggcttggtctaatatatttctgcatcctaaagactactcaactttgtgactcaaaggcttccaatggtaactttccagtaatttggtgccacctctctttggcatttacattttcagtgttttgaaggaaaacataaattggtaattaagaatattttgcatactcaactctgcattagggatgaatttaaactgcctctagtctgaaaaaattaattagcaataaaatccacagggagttgggttctcaagcttgagctctttggaggtcatgtatatctgtgtattgcaattgtaccaactctggttggttgccaaattaggcatctgaagtagtgcatctctcaggtggtcttgagaccttacttaggctctatcagttagagcctaagtaataatgccacctgcattatgtgtgaaaagcatatgctaggccagatgcagtggctcaagcctgtatacccagcactttgggaggctgaggcgggcagatcacctgaggttgggagtttgagaccagcctgaccaacaatggagaaaccccatctctactaaaaatacaaaattagccgggcgtggtggcacgtgcctttaatcccagttatttgggaggctgagacaggagaattgcttgaatccgggaggcagagattgcggtgagctgagatcgtgccattgcactccagcctgggcaataagagctaaactccatctcaaaaagaaaaagaaaagcatacgctgatttatcttgggggccacttgaaaatctctggctttgttttacacagttgcacttgaaaaattattggtaatacgagggtactctacattttgggaaattacaagttctttaattagcaatatggctgttagttgggctctgctattcagtaagttactgctcaaagtttagcatgtgtaccagggggaaattgttcagccttgtgttattgaactggctaatgatgtgggatcaatggctaatctgcacaggacactcctaagaggaatcctgccacatgcagtattgcaatcttttcatttctagtcaagaggaagtactaaagtgtaaaacatctctttacctttttagtcatgtttcaaacatgaatgcttgtgggttaagcacatacaagtactttattttacttttaagatcccattatttttttttcatcataaaaccagtcatttttcaaaaaaatcaaataaatgaagatttaccaagatagtgttgtggatttggtctctgagccttattacttattgttccctgattcacagagggatcgtcaaactactagaactctaggtttctttaaccttcagttggaaggaggttactgatataatagaggatgcacatttggaatttttgcttgttacccttcaaaggtacacccagttaaggacaattttcctttaataaatcaggtgcaagcatgtcattttagatattaccacaaggcctaaattctatgtgtacattcaccaaacatgtttttcttttgtgaaattaaaatactgaaacaggagatgcaaacatcctagacatcagctaactggtatttcccttttctaaagcctgtgctttcaaatgattctcagacctccagaaatttttagctgaataaaaattctgttagataccataactaaaggaaaaagaagccatttaggataaaaatagtgaagataagaaagagaatcacatttagattttttttttttcaaatagtcccctaaaagaatcaaacatagaatctgctgcttattagaggcccttaaagaaatatttattcaagaatagtgagaagtttggaatagaagcatctggagctaatactcaaacagtggaaatatttccacccaccctacctctttcaaaaaaaaaatcaggccaagcgcagtggctcacgcctgtaatcccagcatgttgggaggctgaggcaggcggatcacctgaggtcaggagttcaagaccagcctggcccacatggcaaaatcccatctctcctaaaaatacaaaaattagtcaggtgtgggggtgggcgcctgtaatcccagctactctgggaggctgaggcaggagaatcacttgaacccagaaggtgggatgcaccactgcactccagcctaggtgacagaatgagattccgtctaaaaaaaaaaaaattcaccttaaaatatgatactcttgcactgaatttttcagtgggaaaaacacattgaaaatggtatcagtggtggcatgtggccagagtccatactctgtaagtgtgtgatatttggagaaggaggagaaactttgactttgcttatattcaaaatctccccttttccctgcggatgttttttttttgtttgttttgttttgttttgttttttgtttttttttttgagatagggtttcagttacccaggctggagtgcagtggtgtgattttggctcactgcaacctccgcctcccaggctcaggcaatcctcccacctcatcctcctgagcagctgggactacaggcgcccaccaccatgcctggcttatttttgtattttttgtagaactgaggtttcatctcatctctacaaaactggaaaggctgttcttcacctgggaaattcttgccaacgctggtctaaaactcctgagctcaagcgatctctccagcttggccttccaaagtgttgggattacaggtgtgaaccaccgtgcccggcctccctcgggatttttaattttgctactatatgccataagaagttatcagatcattttatgttaaaattagtgttatctggagtttgaatacagctactcattttccacagtgaatcgaaggagggttgattatacatacacaaatgatctagctgtcccttttcgtagccattttaaggtttcattttggtcaaagtacttatgctgataaattgcatcctaatcttgtttgtttttaactttgtagactttcttaaacattaagtttaaggaaggatgaaagagcagaggagaatatgtcttccctttttacctctgttgttaacagctgcaaggattgctctttaaagagaggttacaacttataacagaagttaaaaacccaaatgcagaagttgccatgtatacttctgataccccccaaaaaatctaaaaatcaatttttatatgaaaataagtcctaaatacactccataatttccattgtatacatcttaacttttgaatattggatatgcttgaagtggagccttaataaattcatggaacaaatttatgtcgatatctattatgtgtcaggcaatttgcttaattcatatcactggggtaagtgcaaaggatacttacattaacattctacttacctttccctctggatatttcttcctacctacttgaaagggaaaagaagtaggacttgtttaaatgactttacttttatctttttatatagttctatgcaaatgaagaaagaagtaatgtcacctttgaaatgtaattggtaaacatggttcatattatttaaaaggatttgtcagaaagctcagggagcaaaagacggttgtgtagtagagccactaatttcaaaaagttatcctttattagttcttattttattttatttttggagacaaagtctcgttctgttgcccaggctggagtgcagtggcatgatctcggttcactgcaacctccatctcctgggttcttgcaattctcctgcctcagcctcccaagtagctgagactacaggtgcgtgccaccacgcccagctaatttttgtatttttagtagagatggggttttgccatgttggttaggctggttttgaacacctgacctcaagtgattcactctcctcggcttcccaaagtgctgggattacaggtgtaagccactgcgcccggcctattagttcttatttaaaagctggtagagttattttctttattttccaagggaaggaaacatgcctctgcttattgaaattgtcgaaatcttattcgtattatcttctggctaacattacttaactaatgttgggaaaggagttgcattttcattattttactcttccctcgccattgttctgaaagcaatatagaaaagctctaacaatttcccagttgaagaacagcctttccagtttaaatcagtttttctagcctgaagggattttgttcagtgagcacagatgtataattgtaaaccagaagccagcacaacctattttgggtacttggtttggtttttgaagtgttagtctgccttttaggggtacatttttaaagcatagatcttatgatcgcaagatcattcgttaagcctcttcattgtcagggtaagggtttagtattcatacaattataaactcaattatgagcactaattatctgcagagccagctcattaataattagtatgtgtgcaggcatggtagctcactcctgtaatcttagctactaggaagactgaggcaggagaatggcttgaggccaggagttaaaaaccaatctgggcaacatagcaaaaccccatctgtaaaagaaacaaacaaaaaaacaaatttgccaggtgtggtggtgcatgcctgtagtccaagctactaggaaggctgagacaggaggattgcttaagcccaggagtttgaggctctagtgagctatgattgtgctaccgcacttcagactggatgacagagcaagaccctgcctctaaaaaagtaacaacaataataacaataattagtgctaggatggtgagatagtagcactaggatggtgagaactggttctggagccctggttgacaccatgttttattttcataaacagcactactacttgtattttagactaattacattacattaatgcttgacattcataaagcttatttatttatttattttgagacaaggtctcactctgtcacctaggctggagtacagtggtgcaatatcagctcactgcagcctccatgtcccaggttcaagcaattctcctgcctcagcctccagaatatctgggattacaggcgtgtgccactacgcccggctaatttttgtatttttagtagatacagggtttcaccatgttgaccaggctggtctcgaactcctgacctcaaagtgatccgcccaccttggcctcccaaaatgctgagattacaggtgtaagccaccatgcctggcctgtaaagcatatatatttaacaaaataatatgtataggtgattcaaattttgttaaatatgtgtaagatatgtatgtaatgatggggtaaaggactataaataatgtaataaaatattaattatgtttatctctgtagtcagaccttatattaggcttttaaaaaattttttattttgggccatgaatatgtaatcaagaaaaagtttatgaccccaccatgtagacaatacacatacatatgtacgaattatgattgaaaaagtattcttttaaaaaaaaagccaaacaacttttgataaattcttagtgaaacatccaaatctttgcagaacaagaaaacatccaatctttgccgagcaagaagtgtctatcccttgattgtagagggaaaaacctcttagatacagttgtcagcaaatgaagagttatctctgtaagcttataatctgcttatggcattacaaaggcatttgaggtaatacttaatgattatggaagtctctcgaagatagaaaattggaggaaaaaacccatcagaatcaaagtaggactaactacaggttgtcttctagaatactggcagcaaggtttttgttttatgtgttttgtgcttactggcatttttgttttcgttcacaatgaaattagctgtattgcagcccataagaaaaatataagttcttccaacttagactgcccactttatggaattaaaaatatcagtgaggccaggcacagtggttcacatctgtaatcccaacactttgggaggcctgggtgggaggactgcttaaggccaggagtttgagaccagcctgtgcaacgtagcgagacccccatctctaccaaaaacaaaacaaaacaacaacaacaacaacaacaacaaattcttttttttttttttttttgagatggagtctcactgtattgcccaggctggagtgcagtgcagtggcgcgatctcggcccactgcaagctccgcctcctgggttcatgccattctcctgcctcagcctccccagtagctgggactacaggcacccatcaccatgcccggctaaaattttttttgtatttttagtagagatggggtttcaccgtgttagccaggatggtctcaatctcctgatctcgtgatctgcccgtctcagcctcccaaagtactgggattacaggcatgagctaccgtgcccagccaaaaaagaattcttaaaacgtagctggcatggtggcacacgcatgtagtcctggctactcgggagcctaagatgggaaggtttcttgagcccaggagttcgaggctgcagtgagctatgattgcaccatcgtactccagcctgggcaacaaattgaggccctgtctcaaaaaacaaacaaaaaattcagtgagagcaaggtactgcttttagccactaagatatctatttttgagcatatttgagcaacacagatgctatcaccccttatatttcttttggaattcaaaaaatgcactcttataccttaaattatttcattctcaaatacttgtttttttggtgtgtgtgtgtgttggtttttctttctttcttttttttttttgagacagagtttcactcttgttgcccaggctggagtgcaatggtgcagtctcggctctctgcaacctccacctcctggattcaagcgattctcctgcctcagcctcccaagtagctgggattacaggcatgcgccaccacgcctggctaattttttttatatttttagtagagatggagtttcaccgtgttggtcaggctgatctggaacccctgacctcaagtgatccacccgcctcggcctcccaaagtactgggaatacaggtatgagccaccaagcacggcctcattctcaaatacttgtgattaaagatattcccattttttaaatgggaaaacttacatagcactacaagtttgccaaagttgaagttaaaatgaatttattacatcctttgcaaccctgagtacctttaatgtgtcaagtactccagaggctgaggttagcaaattgaataagatgcagttttcacacctttgtatacttgagcctccctgccccatggttgccagatctcttctcttcttgagcttaactgagctgggcaatccatgtgatttgcagcaatatcaacaccaacaatgtctaggaaaggacagccacagggaactctggcttctcgtgtccagagacttaacctgagttaggcttcagccccaccctggtgggaaccccattgctgtaccctccctgaggctattagcctctcttaagcagcatctctgcctacatggccatccctgcttgactagaggtccggtgtgtgagaatgtaggattcctcattcttgataccaatctatctgcttttgtatgtgctaaaaggctggatttgaaattaggccttggcaatattagaaaattagataactatgctactgtctgcagagaagagatcgcccatcaccattttggggcatctgtttccaggtaactagaggttaattgcattgaaaatagaagaggtgccttcagaggactttcggtagtgaggaaagggttaatcctgtttctccacaaaccctggaagcagtttgtctggaattgtccaaaccactaccagagagctaatcatcagaactggtattacatgtgaaaaacgaagcctagggatgtgtggtacatctggtagaattggtagctggatgctttcccccataattcagccgttgatattttagttagagaggctctctctcagactgaagttgtttccagtaactgccttttccagctaagttaaggtgagttgagagcatgctaagcattctccaccacttgttgctattgcatctgtatgtttatgaggaaagagaaatctgagatgtactggagttttttgttttttcattaccactgttagcctagctccattttttgattactaatttgtggacctttgtgaaactgcctggtatgaatatgttcttttctttcacatttctgtttaaagggcaggggaaaagggaagcaaactctagcaaaagagagatgaaagtagatttcattcatttattctgttagaaatttgagtgcctcctatattctgggcattgttcttgttgctgtggatgtagcagtgtgaaagacagacaaagaggggaagaaggggagcagatataaaactggaaagtgaattggtggggaatgggctaggaggaagaatttaagtgctcagagaaggtctcactcagatcttatattgagctaaaatctagattacaagatgttgctaggattggactacatgtcttgctagtcatgataatgacttggaccagggtggtgatgacgaaaactgagaccctgttacaagcaggaatttctctggcttcctgcctactttttcagtgcagtctttaatcagctttacattttaatttaaataaagtaatattttgacacagcatgtagttatgtgatttctgggtgcttttttaattgttgaagtttttgactattaagtactgactgtaaaacatctaatttgtttttggcttctgtgtactcatcttcctaaatctataatatgtatcacagtgtttgccaaagttgtttatagctgtttattaaaatatttattgtctttcttattataaaagcgttatacagaaagtataacaaaatgtaatgaaaaaaataaccttcaggttacagtgacccatgcctgtaatcccagcactttgggaggctgaggtgggaagataccctgagcccaggagttatcagcttgggcaacagagtgagactcccatctctatttaaaaaaaaaaaaattataagtagctgggtgtggtggtgtgtgcctgtagttccatctactcaggaggctgaggcgggaggatcacttgagcctgggaggttgaggttgcagggagccatgattgcactatgcactcccgcctgggcaacaggagaccttgtctcaaaaaaagtaaaaataagtggtataacccatgattccactatacagataaacattttgttttctttttagtcttttttctgtgcacagatatatttatttccaaatggttttttagtttttgaagaagtaaatttggtaaacaatagttttcagaagagatcagtagttaggtggtttgtttcatttactttttcatagcattcttcaaggtatgggatcaatttcctattcttttcacttgaactgctgctgtcattagttgaaaagccatcttcccattaggtgtttattgtgtaactgatgtattttggttgcattttctatgtcttcagccagctttttaataatatccttaaaatgttcattgagctgaagtcacagattagtcctagagtccagtttcttttccttttttagccttattcttttctcagagctgtaacttggtaagctttgccaggaaccatcattctaattttcaggtaatatgaattcagtatgttagtttgttcattaactcttagattgcttctgtgatttatggtgatttatttcagcttatagtaacatcatctaaatattgaaatgttagaaatatcttcttaaaatgtttggaactaacttagatcttagctataaaagtatattcaagaaaatataaattctttttgaaatatatttgtcctcaaagcaggctgaaatgtaatgacgattcttgatgattattttgcagacctcaaaggaagaccttctgcaggctgattttgaaggtgctttaaagttctttagagttcagcttccaaagagatacagggcagaggaaaatgcaagaagactgatggagcaggcttgcaatattaaagtaagaacatgagtttttatataataaaggtaaaatatgagtgcagaataatatgacaaattatgtaaaaatttttttatatgttgcaaggtttgattatgtttaagattagattgtgtatgaactgatttctcccagatgtgtttgtcaggctaatgtgtgtatagtagctgtaccttctagtaggacttaaagttggcaggctcagattataacaataggaagataaacatttatctcataggtggggctctagagtgggctgctgtgatagtggtttccatggaagcagacttagtatttagcttttgccatctgttttaagattatttaggacaaagcaagaaaagcttgcttaggcaatgctttcatttctctaagtgacttggaaagtttgagtcttgatctgcccattcccatcccacacctgccaaatatctgtggatacattggtccatgtcacatgtctgataaagctaaacacattttataaatcaatttgaaattgaaaactctttccagaaagttgtagtattaaggtgagagagcactcttaaaatatttggaaccaatttactgatgttaattcttatacctctacaatataccagggtatctttttacctaaccataacgtaaatataaattgttttcctaaacaaacagagatcctggtcttagggactttacattcttgcagaaggaaacagacaataagcaacataataaatacattatttatttaacatgttagaaagtgataaatagctgtgaaaaaaaagagagtaggggaagataaagggaggttggattagtgggggagcaaaggttatgattgttattagatagtcaatgtggacctcactgagtcaatgaaggagatgagagattagtcatggagatgtcctggggaaaagctttctaggcagagtcaatagccagttcaaaggtccagagactgcctcatgcctgggtgggcttgagaaacaggaaggccagtgcagctggagtgaagtgaatgaaatgggagtagtaggaatgctcacaaagagccagaaaatgtaggccattgtaagcatttaggctttactttgagtgaagcagggagctcttgcagggtttttagtggagcaatgatatgatctgtctgaggtttttaaaggatcacaatggctattttgttaaaaacaaccataggaaggtaagagaagtagggacatcaaacaggagattttggagtaatcctcttgagagatgatgatagactgaaccagggtgttaacagtggagatagagatggagtggagatggagatggttggaacctgagtatttttgaaagagaaccaataagatttcctgatatattaaatgtgagtgtgaggagaaaagaagagttaaaatgattgcactgattttgaactacgcaactaggagataagagtcaccatcaacttattaagcatattacttaaaaggtactttgacacagacttcttttaggcaccagagccactgtaacattttttggtataacacaatctttttaaatttaaatcaaattataaatgttaaaaagtacagttaaaaagtacactgaaagtaagtaactgggcagaaaaaaattattttgtctttcaagtgagctttatattcaaagagatcattttccaaagctatcataagaaagatggatttctgaagttttcattctgaaatgcaaactctttaaagccttcacgactgattgttttatttggccaaagtgtaagccacatttatttgtaactttgaaagtatactctagtgggcatgatgcctttgactgaattttgtgggtggtgagtttgaaaggtaggcttcagccaactgattgtttcggagatgccagagagaagtattgtaaattgggtcaatgttgtaggcatcctttaaaataaaatatttatttctaagaataaaagagtagagaaataagaggtacaggtaaggtgaaaagttaaaggttttcaagggaaatctcagaggattgccaagtcactgaggacaaaagaaacccaggaaaacaattgaaaaacatgaaatgtatagggaaaatttttttctccaatataatttatgaagttcctggaggtggctagttattatcaatccagaaacatgggatctgagagatggagaagcgtaaaatgttagaaaacaagttcaaaatataatccaaatggactgctcctggaagggaagtgctgggtacaaccagaataaattttttggacatgaataggtaaatatgaatatttttaaagcttttaataagatttcaataatttaaaatttttaataatttaataatttgtaaagttttaatagttttttgtggggttttctttgcattatctaaggagaatgcctttttcttggatatttaagacggtatccacgggacaccatttcatttataacatataattgtagagtgaatgattgtgaggcagatgtgaggtgaaactgaaagaaggaagacataagtcatccagtattgggctgggattgtgctgggactagaatgtaggtctccaatccaaaggtctaaaattgtttttaaaccaagacctatattttggttgcttttatgtcaagaccatgactatatgtacgtacttacatacacataactgaagagatacttacccttacactgaggcactctgatgttttttgttctattgtattgtatttccttttttttttttgaaatggagtctcattctgttgcccaggctggagtgcagtggcacaatctctgctcactgcaacctcccaggttcaagcaattctcctgcctcagcctcctgagtagctgggactacagtcatgtgccaccacgcctggctatttttgtatttttagtagagacagggtttcaccatgttggccaggctggtctcgaactcctgaccccaagtaatccgtccgtctcagcttcccaaagtgctgggattacaggtgtgagccaccattgcccaacctattgtattgtattgtattgtattttaaacttctccccggatcccaagaaaatccccaaaccaaaaggctgaccacaacccactaaatcgattttacaatagcttgtagttttgaaaaaacactaagacctatcccactgttcctaccacctccccgttccccactctgatctgccacaacccatgagaggctgtagatgacgaggtgttacaatgaataatggaagtgcatgtgtaggtaaggatgtgagtcatcatgccatcattacagcagcttgtgctggcagttggaaattttaggagatgatggacttatagactgagacttatgtgttagacaaagcattcatggacaaaggtgactgcaggcatggaataggcaagaaagtttaactccttatccatagcctatttaagattaaagatagaatttctgccaaaagtaatcaagttttaaacatttttaaattattttcaaagttggtgttgtatatagttgtgtcttttttgaatggacatgttcccatttaattaccccccaaaataatcactttcctttaattttaaggaactgtaaccagtgatttcagtgaaactgaaactggctttaaaatagatgcagcagttgcaagcaaaaaataacttgttagctctgtatgtggtttatttctgtgagtgtaccaacaagatttgttaataaagcacattagattggataaataattttatttttccaaaacttgtatgacattaaatatcaggaacattttcaatagcttctaaactggtaatttaactaatgtgactccaagttattctaatacccttctgttcctatggtttcaactaggccaaaatcagaaaacatattgacccatcaggctttactttgaacagtcatttggttacttttaatattgaaatcaagacctaaataaaagatgtttaaagtgcctaatatgaatatcctgtattttcccagggagtcagtttttattaaatatcatactttgatttttgccttatagttaaaaatgctgccattgcagagcttcttaaacttggattttggcttcagagactctgaattaccagaaatttgaatttctttgtatgaacatatgagcattttgtttttcttagtaacataatacatagcttttttttttttttttttttttgagatagagttttgctcttgttgcccaggctggagtgcaatggtgccatctcagctcactgcaacctccgcctcccggattcaagcaattctcctgcttcagcctcccgagtagctgggattataggcatgcaccaccacgcccagataatgttctatttttagtagagatggggtttctccatcaggctagtctcatactcccgacctcaggttatccaccccccttggccacccaaagtgttaggattacaggcgtgagccaccacaccaggcctcgtaatatatagctttattaagtgcatatacacataatctttataattcttgatctgattacctgtttttctacatatttttattcaataccatttatattgtatcaggttgaattgatgaaattaccattcctgttggtcagaaactgtcaggtatttgattggtttatgatttatgattcagtattttatgcctccttacagctcaaataggtgcatatgtagcttagctctatggccatgtaaacttttcctgagaattattctccaaaggctaagaaacaagtcttttttttttttttttgagatggagtcttgctctgtcaccaggctggaatgcaatggcgcgatccctgcctcctgcaaccttcgcctccctggttcaagcagttcccctgcccagccttccgagtagctgggactacaggcgtgcgccaccatgcctggctaattttttgtgttttagtagattcagggtttcaccatgttggccaggatagtctcgatctcctgatctcatgatccacccaccttggcttcccaaagtactgggattacaggcgtgagccactgcactcggtcagtcctttttttttgttttgttttgtttttaagttgatttttatttggaataatgttccaagtaccatatttacgatggacttcagtagtagcaaagttcataagcacaatcatccaaaattttctgttggtagagctttataatagagctttttaaaatatgttagtttatttcacttgtatttcattagtaaaataatttgagcaaaattaaaaggcaaaatctgacattaacctaaaggaagaaaattaggaaagaaaagttatttattgagtgcctgttgtgtcccaggaactatgccaagaggacttttcagaggaagtaagagttaaaatgaaatctgaaagattattaggagttaaggagtgtatcaaggcagggagaaggatgtttcatgcagacaatatgcagaagcccataggtaaaaaaaatatggagttgcccaagacctgaatgtaggtcatgactggagagtaggttgcaaggagggagaggcagttaggggagtagatagagaaaagactagagaggtaagcaggagccagccagcttgtgcagagccttgtaaaccacggtaagcaatttggattttatcctgaggggagtgataagcactgaaggatttaaaataggagacataaattatcaggttattgttaggaaggtcattctggttgctgtgtgggaatggattgaaagggttaagattcggtattggtgacagaccatttcaggagctgttgcagtcatctaggtgagaagagaccagagtttttgtaataggctgaagaaattatggatgaattccagagacattcaagacataaaattaacagattttagtgattacatgtgagcctcagggcagataaagagagccagcgatagcacttaggattcttacttaagcaacttggtggaaatcacactgagaaaggaaacaaacaagagaacaaattataagcactaaagataatgagttaacttttgaatatgttgttcgtggtacatatccacaactcatatccaagtagatataaatatccaataggcaggtggatactgaagtgagatctgagctaaaagtagacatttgggagtcatcagcattgaaaccatgggagtgggtgaattcttatagcggagtatatacaatgagcagagagaagggtggaggatagatgcattcacatgtaaaatacagatgagggaatagaagctggtgagactagaaggcaggaagaaacccagaagagtatgactgtgaacactaagggaaaaggtgtttgttttcaagaaggaaggagttgaacaagtgtcagtggtacctagaggtcatgtataaggtactgagaagtggaaagtagctattgtgcaatatttaacgaaaagacatccttaatggtcttaatgaaagtagtttcagttaagttatgacaaataaaagccaatgattcaaggaataaatagcaggtgagtaaatagagaaatgaagatgagactgtttttctaagaaggttagtatggggagaggatggaaaatggaagagatagccggtaattggactgagcatggtggctcacacctgtaatcccaacactttgggaggcggaggtaggaggatcacctgaagtcaggagtttgagagcagcctgggcaacgaagtgagaccccatctctacaaaatatttgaaaaggctgggtgtgatggctcacacctgtaatcccagcactttgggaggctgagacaggtggatcacttgagcccaggagtttaagaccagcctgggcaacatggtgaaaccccgtctctaccagtaaaaaagaaaaaaaaaaattagccaggcatggtgacatgtgtctgtagtttcagctactcaggaggctgagatgggaggattttttgagcttgggaggcatgggttgcagtgagctaagatcatgccactgcactccagcctgggtgacaagagtgagaccctgtctcaaaaaaactccaaaaattatctgggcatggtggcacatgccgggagtcctagctacttgattggctgaagtggaaggttggcttgagcccaggagttggaggctgcagtgagctatgactgtgtcattgcattccagcccaggtgacagagcaagactctgcctgtctctaaaaaaaaaaaaaaaaaaaaaaaaaagagatagtcagcaagcctgagagtaagtatgggagagagagagatgagtaagtacaagagagagagataagaggatgttgagactaagatggatttttggaggatgggaaagatgagtctttaatgctaaaaaaatttccaatgactcttaatttcttctttgagcacctactatatgccaggcattgtaccagatagacccagggaatatgagattgagcaaaagcacatatgctctcagagctcatggaattcacagtgttaatttaatcaccttaataaatgtatacttacagagtgagataaatgttcagaagagatataataaagatatatgagagcaaagagcaaaggaacctgaccttgactcaatgatctagagaaagcattcttgaactgagattacaaggtattccagactgaaaagcagcatatgcaaagcctgtgaagagggagagaatatagtaagttgtagaaactaggagaaggccagtttgactgtacttcagagaatgatgacagttgatatccagggaccaaaccacttcatctaccaataagaaggaaaagcccacagaaagagaaaagttaaagattaaataaagaaagggaaatatattaacaggaaaaggactctgaggaggtaagggattaacctcaaaagaatggacctttcattacaagctggagggaataggcaagggaaggatggggaaaatggtgaatgtgtagtttggtgaggaagaaattgaggatatttcatttgaagttttctattgtttctgttaaacaggatctaggatgaagggaatgcagtaaagtgacagctttgagaaacatggaagagcttttagactggaaaaactcaaaagaacagctagtctatattgttgtagactatgagttcatagtggcaaaaatctacagtgttttgtaattttctttagaaacatttagtagtccaaatgtatatatgaagaagacagaaggttattttaaccacagttgaggtttgccaatatgaggcaaaggaaggacatggggccagggcagttgtgctaataaactgtatattgggttggggagtaagagggagtagagaaagaggtatccctgatttgtagcgtttgcccatttccatggtatgaatactcccaccatggccaaatttcaagctaccaatgacttaaccgccccactcaatttctgaatattaagagccacttttgagctggtagtttctgacactggtacaccacagggttgaggagatgaggctaatagcaggagagtggttgacatgatgggaaatggagtctaattaatagaaaagagagtgaagatagatgggactgaaagactacaagaaaagggcctgggagaagggaacaaagaattattggactcaggaagaatggcggaagaggagattaattcccttattgggggttacccaagataaaaagcatctttttctcaaaaattcatatattttaaagagaactttctgatactagaaagtaatattgccctgggctcgcccctgtaatcttagcaccttgggaggctgaggcgggcagatcgcctgagctcagggcttcaagatgagcctggccaacatggtgaaaacccgtatctactaaaatacaaaaatttccctaggcatggtggcacgtgcctataatcctagctactcaggaggctgaggcgtgggaattgctggagtccgggaggtggaggttgcagtgaactgacattgcaccactgcactccagcctgggcgacagagtgagactccatctcaaaaagaaaaaaaaaaaaaaactgccctgtgctcataatttccagtgatcgcagcaaaaccatgccaattactattttggcattcatggccacctcctatgatttacttctctttgtcctaataattctgccaccatcactaccattttactctgatcacatgattaagagttggaaatgcattgtgggaggaatagacaaagatggcagaggcagtgcaggtagcgggaatgagggaatgaggaagggcactcatggttaaaaacagaatcctgacccagcatcttctcacacaccaaaattgtcttcctaccccgtgctaaagaggtagctaccaatgataagatgttacttatcacctacttgcctcagaaaattctaagctctgctccagctcaattacctatatattgtgctggactattttctactctcccaaagttgcaaatacaatttgatcttacccctcacaaatcatgtttttaatgagacagtggtagattcctttatctagaatttaattttttttctccgaagacctccatattcataactggatttgaatgtttttgaaaataactttcacagtagagcaaaactgtaaagaacaattgcattaaaagcaatttacctctaatttcttcatgctgtttgctatttattcctggctgttgttgctgtacgtgaacaagaatgtactctctgaaatagaggctttctttgaattagcactgaggtcctacagaagtttttgtcaacttcatggatctaaaatgtgtgcttttatgtacaccattgaaaagattcacttttgattaaaacacatcttgtgttccttttctataaagacctctatatgttgacaaccacatttgagttgttaggtttagtgtcataatcttctgctggagaaatgttatcatgttataggatacagatgtgataattaacacattgataataaagctgggtgcggtggctcacgcctgtaatcccagccctttgggaggccgaggcgggtggatcacgaggtcaggagttggagaccaacctggccaacacagtgaaaccctgtctctactaaaaatacaaaaattagccgggcatggtggcgcacgcctgtagtcccagctactcgagaggctgaggcaggagaatcacttgaacctgggaggcggaagttgtggtgagcggagattgcaccgctgcactgcaagcctgggcaatggaacaagactgtgtctcaaacaaacaaaaaaaattgataatgaagtagtttctatatcaaagcatttgccactgtttgcctttgagacttctattaacactcatagtcttcagtgcaccttagattggggtattgttttgttttattcccagtgagcagggaacatgttaatgttggacatgttctgaaacagttgataacaggcagaggaaacaggtcagagctccagatgcttaggcatcaggcaccttccacatttaaaaaactcagcttttgtggcccttcctaatcagctagaacagtggtctcctaccagggatcattttcatggaagacaatttttccatggtggagggggagggcattagattctcatagacagagcagtctagatcccttgcatgtgcagttcacaatagggttcacgctcctatgaaaatctaatgctactgctgatcagacaggaggcagagctcaggccataatgcttgctctcccacgaggcacctctttctgtgtggcccggttcctaatgaccggtactggtccgctgcctggtggtagggacccctgagctagaacacatttgtcttctttatttgcttctgccattttgtttctaccctgtacctacttctgccagtcattttctggcagttcattaaaaagaaagccatacatacattttaaaattaacctgatgggtaaactaatggatataaaaattgatttatatttgggcaactcttttcttagaaaaacaaatagtaaaccataggaatagagcattatgcctttatagacgttccaaaattggaactatgtgcattccatgcataattaacaacaaaaagaacatcagaattgctatctcacctagtagtttatttttcttcaaaaactttaagttttctttttttccctgcacctaattcacgcccagcagtcttataatggatcaaaacctaatgattatgctcttaaataagagtttccatattttgtttacctttctgaagtgttttgccaattaccttttatccagtagttgtgatttatatctatcagagttgccataacgttagaacttgtcttcactattgggaacagcagtaatcaataattttcccgcaaccatttaccgtgattctacatttctttgaattattttatttatttattatcacttgaattcatattaacattatgtttaaagtgtgcttcatgatttgtatttggggatccgatttacagaagaaaagaaaacattcctctgaacccttgttgcttctcactggaaataatttcattatgttaggcaacaataaaaataaatgaagagaggttggttaatgagcacacaagcatacactttgatagaaggaataagttatagtattcagtagcacatcagggtgactatagttaataatttattgtgtacttcaaaatagaagattcaaaaggttcccaacaaaaagaattgacacatgtttgaggtgatcgatatcctagtactctgatgtaatcattacacatagcattcagggagcaaaatatcgcatgttctccataaatatgtacaattattatgtatcagtaaaaataaattagaaattggctgggtaagtggctcatgcctgtaatacttgcctttgcctcccaatactttgggatactttgccgatcacttgaggtcaggaatttgaaaccagctttaccaacatggtgaaatcctgtctctactaaaaatacaaaatttaggccaggcgcagtggctcacacctgtaatcatagcacttcgggaagccaaggtgggtggatcacctaaggtcaggagttcgagaccagcttggccaacagggtgaaaccccgtctctactaaaaatacaaaacttagccaggtgtggtgacacgtgcctgtaatcccagctactagggaggctggggcaagagagtctcttgaaccaggaaggcagaggttgcagtgagctgagttcgctccacttccctccagcctgggcgaaagagtaaaactccatctcaaaaaaaatatatagatatagatatatacatatctatatatatattagtacaaaaattagctgggcatggtgacacacgcctatagtcccagctacttgggaggctgaggcaggagagtcacttgaacccaggagggggaggtttcagtgagctgagatcgtgccactgcactctggcctgggcgacagagcaagactctgtctctaaataaataagaaataaacttaaatgaaacttaggtgtttcagataagttacattaggaaggttgggccattggatcctgagggtttagtgttctaaacacttaaagcacaactgttttagataccaatgcctgtactctggggaatataaaatataattatattagatttactgagtaatttttcatattttcatttctccaactcagatccatttaccttgcaaataactaaatctaattaatattctggagaaattgcttatttcactcttgggcctttttctctcctcctctctcccctactgttcctaaaaaaaaattttttttttgaaatggtggcagcaacatgtaaatgaccatagcaaccaaaaaaagcgaaatattttaaatgttgttcacatatctccaactgttgtttgtcaagccttctgaagttccacttaaagacaacaaactactgaggagaaaattatattccttgctgtagttaatagttgtgatcaaatgggcattcttttctcattgccaaaccctctgacttggggattttgttacttcaacctgtgagaggaacagagctattgctttcatctagaacatctaccttttgccttttttcttagcctgaggcacttcctacccaaatcattactgtatatgtagttaatatagtctcttttaaatactcattattggttttgcttttttgatttttataatgtgaaggaatcttggagtacaaacgacataaagaggtggtaaaacagtgttctgatagtagtttaggctaggagaagcgtcacgttctcattgtggcacaagttcaacagatttatcagtgtgttagcctttccaggcactgccttattctgttatccctaacccgtagagtcaccatactttctactaactcttgctacttttatcctgaaaagttttagctgaagtttcttacaaaattggttcctgaagaggtcatacttttgtttctgtttctcatgtctgctgttttacatctgcattcattttctagggatgccctaacaaaataaatacacactggaaggattctttactcaacttttattttagaatcgagggtgtggccaggcatggtggctcacacctgtaatcccagcactttgggaggccaaggtggtggatcacttgaggccaggagtttgagaccagcctggccaaaatggcaaaaccccatctctactaaagatacaaaattagctgggtgtggtggcgcatgcctgtaatcccagctgtaatcccaactcgggaggctgaggcaggagaatcgcttgaacccaggaggcagaggttacagtgactggagatggtgccgctgctctccagcctgggcgacagagcaaaactctgtctcaaaacaaacaaacaaacaaaaaaagaatcaagggtacaggtgcaggtttgtcacatgaatatattgcgagatgctgaggcttggagtacaaaggaatctctcacccagatagtgagcttggtgcgcaacaggtggtttttcagctcttggctacttcctgcctccctcaaatagtcctgagtatctgttgttcccatctctatgtccaggtgtactcaatgtttagctcccacttataagtaaaacatgcagtatttggttttctgtttgtgcattagtttgcttaggataatgacctccagttgcatccacgttgctgcagaaaaggtgatttcagttttctttttttctttttttggagacagagtttcactctcattgcccaggctggagtgcaatggtgcgatcttccctcacgcctctcgggttcaagtgattctcctgcctcagcctcctgaatagctgggaatacaggtgtgtgccaccatcctcagctaatttttgtattattagtagagatggggtttcaccatgttggccaggctgctcttgaactcctgacctcaggtaatccacctgcctcggcctctgaaagtgctgagattacaagcgtgagccaccacgcccggccaccacattttctttatccagtccaccgttgataggcacctgcttgattctaagtctttgctgttatgaatagctttgtggtgaacatacaggtacatgtgtctttttggtagaacaatttattttcctctgcgtgtatacccagtaatgggattgctggttcaaatagtaattcaacatttctttgataaatctctaatctgttcaccgcagtggctagagtaatttacattcccaccaacaatgtataagcattcccttttctctgcggcctcgccaacatcttattttttgacattttaacaaaagccattctgactggtgtgacatggtatctcattgtggttttgatttgcatttctctgatgattagtgatgatgagcatttcttcatatgtgtttaggctggttggatgcatagactgggaggcttaaacaacagaaatttgctttctcacagttctgaaggttagaagtccaagatcaagatgttggcagggttgatttcttttgaggcctctcttcttggtttccacatgggatggtcaccatctcattgtatcctcacatgattattcctctgtctatattatctgtgtcctaatctctctctgtctttgtttttttttaagagatggtgtctcaccatgttgcccagactggtgtgcagtggctagtcacaggtgtgattatagctcactgcaatcttgaactactgggctcaaacgatcctcatggcttagcctcctactgagtagcaaggactataggcatgtgccactgtgcccagctctaatctctttttataaggacaccagtcatattggattagagcccaccctaaggacccattttaacttaattgtctctttaaaggccttatctcccaatacagatactggaggtactgggagttaggatttcaacatattaattgggggggcacaattcaccccataacagtgttgttctcatagtaactgagtgcgcatttcttctcaatttctctgaaaacattctcttctgaacgtgaatcttgcttggcagctctgagctatacctccaatatcttataacacgtgacagtttcctatttttgtcagcatacccaacatcacccattttctcctaaactctcagatgatctaaaagatcctatttttttttacagctccaccctccacttctatcagcccacttggttggcaaggaattttctctggcatgcatgatagcttgttagaagttctaatttaccttacataccctgttctagtatggtcttgttgcattaactttcttataatcctgcttttatattgtatcctatgttatgcagaccataacctgccttattcctctcttttcctgaaagagaggcagtgaattgtgcaagtaagttgtatctttgcacaatgtccagtggtagaagaaagtctatattgtattataatagagtattttaagcaacaacatatgttgaatactatataggacacaggtacttagtttactttctagaattatttacataaaaacttttgtccctaaattttgacccaattttaggatggccattatttaagaagccagatggcagacattgcttctgtgaaggaaacattttgaagattgtctgacatagtaggatcttcttagagccatcagaatttgcagtttcaggttcctgacattgcttgtctggagtgctataactgtctcataactggtctctccggctttggtttctgtcccctctagtttcctctgcatgcgaccatttgagttgtctgtctggaaaactaacctcagtttatcactcctcagaggacactgaagctccctgttacctgcaagacaatcccacacacctcaggttggcacacttccctttcactcataccaatatgccatggccttgtcacatcctgtttctgctgcctaggttgctttctgtctgtggagtgcctggagaaggcagaggctttgggagtggacaagtctaggtttgaattctggctccagttcttactgagtgatcctgagaaagttacttgatctccttcgagtatgagtttcctcatcgtgaaacaaggctaatacctactgcacagagatgttgtaagaattaattaaattaaacacatgtgtgaagcattggctaaattaattccttgttgtagctatgtagtcaagcaaactcctatttaccctttaggttgcaggtcaaacatcacctgctctggaaacctaggctgttatttattctgactctggcaattcctacactagagcaccactgttggcgttaagaacgtggttttctgaagccacattgttggagtttaaatttagccttttccatttaattagtagctgtttgatctctggcaagttacttattgtacctcagttatctcttctgtaaaatggagatcctattttctatgaaataggattgctatcaagattataaataggataatataaataagaaacttggcacaatgtagtccataattagtgtacaaccaagatagtcattatgactctagtttctctcattgtgaggtcctcaaggctgtgactcttccttgcccctccctagatgcctgaaccaacacctagcatagtagatgaatcaaggagtccatctactatttatttatatttattgaggtaacaaaccctgtttataaaagatgaagaatattgggctttgcattttccctgaaaatacttctggtaataaacaggaaaatcctcaaatgttacactgagtggtattccaggtttattcctatagaaaaatgaaataaaaagtgaaatctgtctgaattttgcttttaagagtggtgtttattatactgtgtagcttagagggctcatgcaatataaatttgtgaattttccaccattccagaccgttaagacttagatagaaggtcatcattcttccttgatgttgtggataaccagatgccctccctcatccctattagatttttttggattattatacagtgattttaggatactaaaagttttttcaagtttcatttgcataagtttcttagtcgtgtgtgatcaaaataactgtgttgaaagaattgaggctaagatgtatatgccacagactttaaaacagagtagaatgtcagattaaaagagtttatagtcaaaagattgctaatgtaattactaatgtaatataattactaatagatcacaaatgatagactagttatttccatctttatgtatgaagttataatcacattttatattttgatgtacaattttttatgcatttcataattatccatttattttcttcataaattcaaagactgtcatgagtatatctgcatatttatggttgcccattgtatcaattatctattgctgtataacaaaccatcccaaaacttacaggtttaaaacaacaatatttttcgtgattctgtgagttggctaggtggttcttctgttggtatctcctggattcactcatgtggtagcattcaactgttggaacagcttagaacagggcccctctttccccatgcttactcatgctcagcatcttcacaatactgtgatccatgttctcaagaaggcaagatccagtgcacaaacactttatcaagctgtttcaaacataccacaagggaaagggataccaggagtcatgactgattagaagccattcctgtaacaatctgccacattcatgcatggaaaatttgtgtttcagtacaaaaaaaaaaactagcttagtttctgaggagagagctgaaagtctggtgtggaaaggagacttccttcccattcaataaaatttgcttttactcgttaatactttttgtttaatttaatctatttatttttatttataatgtgatttaataatttccttttatataatttggtttttttttgccatgaggtgttatttttcttttttttcttttgaggcagagtctcactctatctcccaggctggagtgcagtggcacgatgtcggctcactgcaacctctgcctcccaggttcaagcgattctccttccttagcctcccaactagctgggactacaggcatgtgccaccatgcctggccaatttttgtatttttagtagagacaaggtttcatcatgttggccaggctggtctcgaactcctgacctcaggtgatctgcccacctcggcatcccaaagtgctgggattacaggcatgagctaccgcacctggtgagctgttatttttcaaacaaaacaaaaatacttcacaaaaccaatgaatgagtgaacctggcatcagtttagggtctctgatagcagaaacagtagatgattatgaattggtaataacatttgagtagagatactctgattacaaggagcatctaacctatgatactgattctatcatacatcagaaaggtgggtttccagagttcggaggaggctcagaattgtttcagttgtctacctcatggttattaataatttataggagatttgagggaaattttcaattttgtttatttaattttattttaatttgacaatactttggtatcttttggttgtgctggttcattgttctgttgaacaatgctaactctaaaaagaacgttttagacaacataaatcaatggaggaagagaatacatttgccaaaattaacatgaacactttcttaagaaaatagcacttgagaatattgcaattaaagactaagagagtactccgagtctcccaaagtacctacattcttagccaagatacagcagcagctgacctttaaattcatatattccaatttaaataggaagttaaagttgaatattacaattggtttttcagggtaaatgttgcccttttttcctgaggatgagtccaccttgtcttaaagaaaggacaactggcaattctttctctgacactgaccaattgaaaatatgagagaaccaaacaaaagctttccatataatatcaacctaactattcagtgttttgctatagacagactctttgattggccctagttaatctgttcttgttttaattcatctcaaggttcagcattagtcattttatcccaacagatataaccttagattctttctatggataatatatttagactcatcttaatgtaaatttttcatggaggttcatgggtagaacctctaggtgactaaaaaaaaactagctttatgtctagataaaacgctacaactttgttccttataaaataatcagacctgtatagtcagtgaaatatcacaagatccaaattctagtgacttaactttagattgatctaacacctaaggtaggagagtggagttgggggtaagcaaaggagaggagatcatgtaatacattctcagtatttggagaacaatgcggtggaaacaagaaagaatacaaaagaaaattcaaaagatctagtattttgtcttttgaaaaataagatccaggctaggtgcggtggttcatgcctataatcctagcactttgggaggccaaggcagacggatcacctgaggccaggagttcgagactagcctggccatcatagtgaaaccctgtctctacaaaaaatgcaaaaattagccaggtgtggtgtcaggcacctgtaatcccagctactcaggaggctgaggcaggagaatcgcttgaacccgggaggtggaggttgcagtgagccgagatcgtgccactacattccagcctgggcgatagagcaagactctatctcaaaaaagaaaaaagaaaaagaaaaagaaaaaagaaaaagaaaaggaaaagaaaaaagaggtccatgagtagagtactgcatttgtcaggaaaactactacattagacaaaacttgcctttaatgcctggagatacttgctgctgtcaaaaggtgcacaacttaattttgcctctttggctgatgttccccactattctagatgaactgcgcccaaaaacagatccaaagatatccttccccacagagagttggtgatggatcttaggaactaagtgctatgagcatgttgcaaaaggagatcacagacccagttcaggctccctccagcagccccttctcccatgacctctatgtcagttacatccatgtgctgacagtgggcacacccacagccactactggctaccttcctcctggctgtctctgtgtgttcatgacttttgctggcacatctgtagccccaggtccctttctccagcttgccactcctacatatttttcccttatgattctatgctgtttgccatttttgtttgaaagcagtgcattggttaacaataactttgtagtgatagcaaccaccatagcaataatgtcctgcttccttgtatgcctggcatgtttatcatttaatcatcacaacaccatgaagtaaatactcttattgacccaattctatagatcagaaaacaggcctagaatgtgtaagtccctaatgaaggctacttggctaataaatgacaaagccaaattttgaatccaggcagtatggtttcagagtctttgctttactacctcttttactcactatttttgtactaatcttacactttactacatattttctgaaggcagtcaaaatttaaaagttgattattactgccagtatttatcagtcgcataatgtatttatttttattttctgagacagggtgtcactccatcacctaggctagagtgtagtggtgtgatcacagctcactgcagcttcaacctcctaggttcaagagatcctctcatcacagctactggagtagctgggactacaggcgcatgccaccacaaccagctaatttgtgtgtgtgtgtgtgtgtgtgtgtgtgtgtgtatgtgtgtatgtgtgtgtgtgtatatatatatgtgtgtgtgtgtagagatatatatatatatatatagtagagacagggttctgtcatgttgcccaaactcctgggctcaagtgatccacctgcatcagcctcccaaagtgctaggattacaggcatgagccatcacacccagcccagtaacagaatttaagactactctagtgcagtatgatcatttacatggcatccactcattctttcacttaatctttaccacttattatgtacccactaggtcctagtactgcagtaggcactccattcagttatgatcataacagaaaatattcctatcctcctgaagctttcaggataatggaagggacagataacacaaaaataatataaaatcgcaagttgtgataaatgttacaaaaggaaacagaaagttgttttaagacagaaaatagtaggaagctaacttagattgaggaatgatgatcaaggagaacttttctgaggaagtgacattgtaagttgaggccctaacagaccaataggagctaaccagctaaagaggaataattaagtatgcttttagaggagcttgtatttctggaaaaatagtagactagatgtcaatataagttctgcctaaaataattaaaaatttttaatgtgtggcttagtaggaaaataaggagcatttttagaagccaggaattatgagaaagtctgaatcctgatatagaagtaaattctaggccaggcacggtggctcacacctgtaatccctgcactttgggaggccaaggcgggaagatcacctgaggttgggagttcaagaccagcctgaccaacatggggaaaccctctctctactaaaaatacaaaattagcagggtgtggtggcacacgcatgtaatcccagctacttgggaggctgaggcaggagaatcgcttgaacctgggaggcggaggttgcagtgagccaagatggcaccattgcactccagcctgggcaacaagagtgaaactccgtctgaaaaaaaaaaaaaaaagtaaattctaaacctgtgttttttttctctgggcatttgccaatccctcgtggccaaaaccatgggctttaatagatcttgtgcaggagacaaaaggcaaagccaggactctcaaagacttctctctcagtaagtgaactaggagaaaaagcccatccccgccccccccgccgccccccattaacctgttcttcccacagacatgctgttgggataattgcctgtcttaaccttagtgcttgaatgggtgggagtcatatatatcaattatatttttatatgcaaatacatttcatcataaaaagaaaagcataaaactctctagacaagcaatactatattgcaaggccctcagtaagaaaggtatttagcctttttcaaaaaagtaaaaggctggtacacatagaacaaaataagtgctggaaaatgaggttggagatgaagccagggaccagattcatgcaggtccttgaaggccttggttaagagtttgaattgtatcctgcaaatcttttgaagggttcctctctaaagatggaaggagagaggaaactgtagcagtattccaggtgagagggagatatgacttggattagaggaaactggaagaaatgaatggattaaagatacattttgaaggtaaaatgtgtctaacctgctgataaattagatgaaagacttgagagtgagtaaaatataaagggttattcctaagcacctgacttgaaaaactgcttgtccaaaagtctttttttctgagctgaggaagtcaggaggaaatttggaggggggaatgatcaagagttcagttttagaaatattaagtttgataaataaagaatgctaatggagatggtaccactgatataataaaactaaagaggtttttaaaatattcttagttagttgaactcgtaatcgaacaagtcaggatgtaatgataatgaaaatttaccttttataggcaattcaatttatagtaaatttcactgagaggcaaattttttaaagtagaatttcaatgcaataaatacaccattcatttaaattcacattcctgggacagaagagctggatgaatttgcagataaagtaaaatattcggagagagacgctgtggcagagattggctaactgttcaccaaatctattttcttttctttctgctgacacagctggactatatttcccagcctcctctggcttctaaaattattttcttttctgttttataagatgataataaaactctgttctcatagggattgtgatgagcaaactaaaatcagttctgaattgtcaaacgtgaaataaaaattcatttttattagtataggcatgtgactgagactgggccaaggaatgggaataaaagtgatgtatatttcttcctttggtctggttatgtaaaaaaaaaattccttatgcagctttcatgctgtctatcccttgtgtcaactggatattggcacccaaagtgacctcggaagccacacattgagggtgaaagaaccaccttcagttgaaattcctaaaatgactgcatggttcagaatccccatgcctacttttctgccatctgaactttgcataaacaaaaaaataaactattattttaaatcattgagattctgtaattcaactgcttcagcagctagcatatattaaaagatgttaatttgatttcaaggtggtatcaagaacataattttattcccattcatttcttttctcttttttttcaacatgtattttctgtcatacatgaccaggcaaattgagtagattaggatgttaggaggtttgtacagggagtgagggaagctaagatgtttgaggtatgagagaggagttgaaggatatactttctttctatgctccatatcagataatctgtttttctctctccctctgtctgacccagtaattcatttcaaagatgtattcttctgtagctatttctttccacctgctaatagcaccctcattgtaaaacagagacttgatgacaatcttgatctctctcttcttgcccagtttaataatcaagtttttacactgggatacaaaataatcataaatcaaagttgagaaatatgttttcttcctttgtacatctgatagtagatttcatagtatctcttgaggtaaacgcttttgagagtatgcaaagtgtgacatatctctgataggacttgctgaagccagaatgtgccctctgtatctttggccaatggattagccagctagacatactctgacattgttctctgttatatttacttatcagtctttttgcattgttggcttcatcgctccttctcttgagggaaggtatgaggtaaattcagttccctatgctgaacacccagcatgattcctggcaaaatgatattataagtgctttgtaactccttggatgaaaaccaaatgaatgctgaaagtagtgtggtatgtatctgactaataaaaatatgttccaggcggggcgcagtggctcatgcctgtaatcccagcactttgggaggccaaggtgggcaaatcacctgaggtcaggagttcaagaccagcctggccaacatgatgaaaccccatctctactgaaaatacaaaaattagctgggcgtggtggcgcatgcctgtaattccagttacttggggggctgaggtgggagaatcacttgaacccgggagggagaggttgcactgagccgagatcgtgccattgcactcctgcctgggcaacaagagcaaaactcggtctcaaaaaaaaaaaaaaatgttccttgtagaatgaattttctgtattattcactataaagaatttatttttaaccacatcaataatatgtctataagatataggtcattacctggaaattgaaaatatttttatgagaaacttctcattatgatgtttattgtgtaaggatcttaagttgttatcacctttgtttgatgaatgtatcttctacttgtgtactctaaaaaattatcagattatttttatgattggtagagtttatagttttgcaagaattgggcaaatctcacacacagggacaggtggaagagcatgcccccatgagagctttaaaggaatacattctggccctgtggagaattgcctcctcttcaattccagtggcatatggttagatttgggcaaacaaatgctatgccaaatatggcatttattgcctcagttcagatgccaggccaggctgaagtttacagctgtgtcctggttgaaattctaaaacaaaaggagtttattcttttaatctagtgtacccctaatctagaatgatggcattgttagcatctagaattattttctttcccattttatatgatgataataaaagctattctcataggaattgttatgagcagacctaaattcagtgctgatttgtcaaaagtgaaataaaaaaatcttttgtctgtgtggtcttaggtggcagaaatgtaattataagtaagccctaatttctgctaggtatactagtgcttgaccctagtgaatggatagtctctttatagaagtagatatattaatccctttaaccccttgaaaactagtagtagtagctatttgatatacctctttccaaaaagtttctagctggccaggctaagttctcatgcctttggtggtatagcatatggacatttatcttggcagtgattacgtgtaagtataaaagaaatacttaaaatgcaataaaatgagcatatctgtttcacaagactaatgtttcttgctaatcatagagaacctaggataaaatgcataatgttgatcattggaactgaggaaagcttaacaattatactatattggataggtgaaatctaggagtttctgtatacccagagtcctttcctaaggggtcctacctgtagcctcttgctaaggataccaactctagctagatacatatagatggccatgttctatattgcatgactttaccatcttgaccacatctcagaacatttgacctaaagcattcaggtagcttgaaggctgacagatttaacgacctagtacaagtgttttatctaactgatgatagtgacatagtggactgatcagatgttctttcttaggaaatttttaatttgaaatagagagtattatttgataggagcaaacaccaactgcttaaccagaaaaagaggcagacaaaaatgacatgggccgggcgctgtggctcacgcttgtaatcccagcactttgggaggccgaggcgggcggatcacgaggtcaggggatcgagaccacagtgaaaccccgtctctactaaaaatacaaaaaattagccgggcttgctggcgggcgcctgtagtcccagctactcggagaggctgaggcgggagaatggcgtgaacccgggaggcggagcttgtagtgagccgagatcgcaccactgcactccagcctgggcgacaaagcgagactccgtctcaaaaaaaaaaaaaaaaaaaaaaaaaaaaaaaaaaaaatgacatgagtcagtagaagccatgaataagcaagagtgacaagtaagtatgagctaagtcatgaacttttttacgtgtgtgtgtgtgtgtgtgtgtgtgtgttggtaggggtgggggtagatacatatatttaaattgtatctgtgggggaagaggatggtcaacaaattgctgccaaggggataaagaactaattacatcattacttatctattggattctgaacaacttgaaattctccatctgtgttcctatacttttcatgagacctggttaaactactttccatgagttcccataaggcctagccacaaaacatacctttgttccttattttcatgtgaaaccttacaatagctgttcccagttacccctctcacatgcacatccacacacagatacttgagacaactttactgagtctctattctttgtggtcaaaggatcctaatttatacagctgttctatgagttcagtgtttattattttagctctgtaaccaaggcaaggactgatgaacaatagcagttttgtggccacccaagaatatattgaccttgaataggaaaaagtaacgtatataatcctaattgtttaagagaggtgatgcattacagggagggctcagagaaagatggctaacactaatagcacatgttggcattgaggagactacgtggaaatgtgcatttagcaaaatagcttcagaacaatattttttctttctcccctattagattttgagttcctgaagcactcatcttggtgtgcctcaccaattcccaggagagggctctgtatataataggtgaaacactattgagtacataatgtggcccagctatggttctgtcttaaggtttagcagcagctttgaactgcctggtaaaaatattttttcaggcagactaaactgaactgaagagagagatacaagttagagacaagagtcggatttccagaaatttctgggagagatagatatagacagtgtagaacagccaagaaactatgggaggaatttcaaggaaccagataatatatgcataatgttggtcatcagaactaaggaaagctgaactattatactatattagataggccattcacatttaggggactaaggaccagaacatactgttatctagaacatcagaacatctgcagagcacagaacagcatagcatttggccagaaagcatgacatagagtatgggatagaggaggagaattggcaaaaaataaattctagattctgatttttaaaatgacagaacaaagattacagcattattttccttctcccttacaaattatccaactgcactgggagagcaacatggtagaaacatgaaccctatcttcaaagaaagatatatgcacaactccagactacaaaatgtgatgaagaatgataaatgcagttaaaaatgcccacagctgcagatctcacacaaagctggcagaactttctagggggcaaaaccaataatgcccagtttatgggataggatttgtgtactagcagcaggagctttcttggccttcctagggtataaagaagaaagcgggggtgctgggcacggtgactcacgcctgtaatcccagcactttgggaggctgaggcgtgcggatcacctgaggtcaggagctcaaaaccctgtctctactaaaaatacaaaaaaaaaaaaacaaaaaaaaagaaaaaaatttagctgggcgtggtggcaggcacctgtaatcccagctacttgggagactgaggcaggagaattgcttgaacctgggaggtggaggttgcagtgagctgagattgagccattgcattccagcctgggtgacagagtgagaatctgtctcaaaaaaaaaaataaaaaaaaaaaaagaagaagaagggtaatagactcaatgaggaatcacacagacaagatggaaaacatgggaaacacaaagaaaaaagtagagattatatctttactgtcagacaagattgaatttagtggaaaagttttaaataaggcaatgaggaataattcaaagcaacagtatagcattaaacatccataaagcagaaactacagaaaatataaagaataatagttacatagtagtgataagaatgtttattcacttctcttagttcataagagatcaagtggacaacaactaagagaaagaaaacccaaataaaataatgaagtcaatatttgagattgtcaagctttgtatcctgaaaactaagaatgtcaaataaaacattcacaaaaatagaccataaagaaaatttcaaagaatttcaaaaggcaaagtaaatatatacagcattctgtgatctcattgcaataaaagtagaacttaggaaaaagaatatcatcacctggacattttaaatttcctactaaaataattcttagatcagaagaaaccaaacaagttatagaaaatctaaaacaaaagcataatgaaaacaatacatatcagaacttgtgagatggagctaaaatagagttcagaggcacttatcttaatgaagaaagaaaataactccattaaatatctaactcaaagttagaaaaattatcaataaacataaaaaagcagaagaagggaataaaagttataaattagacaaaaattgatcagctaaataaaagagctgattttttaaaaatatgatattaagtttataaaatcaaaaagtagacaggaaagggcataaaccaagaaataatggggaaatgataaaaatagaaaagaagagaatcctaagaaaatattttgttcaatcctgtgcaaattaatttgagaacctagaagaaatggatgattttctaggaaaattgaaaaaataaatactaactttagataactagaaaatctaaactattagcacagaataactttcttttttttttttgatataggaagtcctttattttgtcatgtgaaaccatataacagctgcctaaccacaatgtagatgccaataggagatggctcagaaatagcactagtgactcaaatagtgaccattatgataaaaggaataaagttttgactgatttatagcagttttaaaatgcgttttatattgagtagttatttcatgttttctcaaaagaattattatgttaaaccaaaaataaactaggtatatagtttgttcatataacaaatctacattcaaagacatgcttacaaattttccacttagtccatttttctgttcttagcattactacaaatgcctccttccgtcatcatgttgaattcttcagcatcttctatatcatttccaggggcatctctgggaagtagtgatgcctgtcttccttcagaagcactgataaccccaatatacccacagtacacacattttccctctcctgaggtgtgctactttttggcacaacagaaaaaactcattactaggatttgaaaacctaaattctgggcctggttaggtcataaactacagaaccatagatcatatattctccccaggagcctgtttctccactgcataaataattcatatttgcttggccctttgtagtcctttactgtttcatttatcttcatgataacccttaaatttaagtaaggtagcagtatgctcattttatagaagaaattcagtctcaaagaggatacacagtctcccaaagatcccacaatagtaatatattaggcagagctaaactcacacaatcttactcaagatcctagtgctggtacatggtatgctcataagtttgctaaaatggatgaagcagcagtttctcaggtccctttcagtgatcctgttctctgcttccacttgatgttttttctctcgtctctcaactagcattaacatccaaaactatatataatcactaaatttcatttaccatcattttcttatttaattattctttaaatttttctatttccatgttaaatccagagaaatgttactttttcgaaagtttctactgctgcctgcctctctgaaggccatgggacttacctatttgtttgtcaaagcaaaaattcccaacattttgtaaacaccactaattactttttataactgtaaaaacaattattccatacttaaaaccaattcaaaataaaataaatcctcgatacttcttactccctggagtagtaattttaattagattctactgattcgtaattttttcctctgtgcctttatttgggaaatactgttagtctacctcactatcaagtctctttccctaacaagaaaatgtcacagtcttttttttttttttttttatactttaagttttagggtacatgtgcacattgtgcaggttagttacatatgtatacatgtgccatgctggtgtgctgcacccactaactcgtcatctagcattaggtatatctcccaatgctatccctcccctctccccccaccccacaacagtccccagagtgtgatattccccttcctgtgtccatgtgatctcattgttcaattcccacctatgagggagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactggtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgttcgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgaagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagatcactcatgatttggctctctgtttgtctgttattggtgtataagaatgcttgtgatttttgtacattgattttgtatcctgagactttgctgaagttgcttatcagcttaaggagattttgggctgagatgatggagttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggagtgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactactgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtgatatcccctttattattttttattgtgtctatttgattcttctctcttttcttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcccgctttctcttgtgggcatttagtgctataaatttccctctacacactgctttgaatgcctcccagagattctggtatgttgtgtctttgttctcgttggtttcaaagaacatctttatttctgccttcatttcgttacgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctgttaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagttcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgttgggtcttgactctttatccaacttgccagtctgtgtcttttaattggagaattgagtccatttacatttaaagttaatattgttatgtgtgaatttgatcctgtcattatgatgttagctggtgattttgctcgttagttgatgcagtttcttctcagcatagatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttttgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggattatctttgtggcgttctctgtatttcctgagtctgaacgttggcctgccttgctagattggggaagttctcctgggtaatatcctgcagagtgttttccaacttggttccattctccacatcactttgaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagacttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgcagtgtgaggtgtcagtttgcccctgctggggggtgcctcccagttaggctgctcgggggtcaggggtcagggacccacttgaggaggcagtctgcccgttctcagatctccagctgcttgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcttcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcaccgctttctttgactcagaaagggaactccctgaccccttgcgcttcccaggtgaggcaatgcctcgccctgcttcggctcgcgcacggtgcgtgcacccactggcctgcgcccactgtctggcactccctagtgagatgaacccggtacctcagatggaaatgcagaaatcacccgtcttctgcgtggctcacgctgggagctgtagaccggagctgttcctattcggccatcttgaaaatgtcacagtcttaagagtcaggaaagcttttactttcactatcacatatgaagaatgaactaaacacctaaactggacagtaaaacttaaatgagggattcaggatatttcccaaggggccatatgacgaatttaaaagttggtatgatgtgcctaaaataacacgctcttttacttataataaaggtacagatgtagtgattagtcatgctgacatgtacatataaaatatgcctatgccaaattaaaagaaaacaaaatacattctatggcaatcctgaaaagtcagggaggtcaataaatattaagagtatgctctcacaattagcattaaacacatggtaattaacacaatttaatatgtgaaaaatgagaaaatatacaggatgagaagtacacttaggaatttgttgtgattttcttcattttgattgtattgctttcttgtcttcaggagatttcgacttctgaattcgcatctttctgttctaaatggtattcttgggctattttctcagcagttcatgtttctggataaagtttatgattattgagaagtgtcaatgcttctacaatggaaattttgcctttgggaatgatcttaatatttatcatattaaagtgatggccaaaaggcaatctgaattctttcagctcttgacatctttcagcagcttttacctgcatggaagacacaggatctttggaatcaacatacacatcttttagaaatgacagcagcttgtcatctttatgagcaatctctcccttaatttctggatagaaactaatctgctcttgcaggaggctgttggtagaggggtgtctgggattgggagggggcttcatcttgttgatttcccattcctctcagttctctaggttgaaattcctgatcctgcgagtcactgcagcccccatctcctcataacatgatgccctcaggtttacgccacacgtgggaacaccagtgcaggaaacctccggggtaccctagaataactttcttctactgaggccttggtgatttaacaggagaattctaccaaacctttcaggaataaatcaactcagtcttcccaaatacatatgctttaataaatgtggatatctctggaaggacacatgagaaactagtaaacagttattattcccagggaacagaactgggactgagggacattattagaaagaagtcttgctttttcctgtatatcttttataccttttgtgttttgtaccatttgcatatggtactcatccaagtatgaggaatttagaacatctttgttttacatttgaacaagttgacaacactgtttggcttttgttattatgtttaccttacgttttcagtaaatgtagtaggcataatttcttaaatacctcccttccccaaagatgtcccaccgtaattcctggaatcatgatgaatatgatgctctattactgattctgtgattatgttttgccatatggcacagttgacattaaaataggaaattcaagcctacattatctgagtgggcctaatcgaatcatatgagccttgaaagcagagagctttctttggctaatggcaggaaggaaagtcaaagagattggaagtatgagaaggactcagtgtgcaatagctgctttgaaagtggaggagaccacttgagaaagaaggcaagtagttttgaggagctgagggcagctcccagctgacagctagcaagggaactggccaaatccttgcaacctcaaggaactactagctctgtcaaaaacctgaaagaggttgagagtggattcttccccagtctccagatgagagtccagcccaacaggcatcttgatttcagctttgtgataccctgagcagagcccacttgggactcctgacctatggggatgtgagataataaatggatattgttttcagctgctaaatatgttatataggagtagaaactaatagagcaaaattatgttctaaaactttaatacatgtgggctttcagaggctttagagatgggagccatattccctccagtctgggtgtgatgggtagtgccaaagaagctgcagagccggtggaacagtgtcatgtgtcagccagaggctgcatcgtttccattggtgccataagtagaatatgctctgctgtcttttcattactttctccaattgtgcagagaatgaattttttatatctgtctcagtctttagaagcaattttttagcatttctgttttaaataatcttgtattttcaatgaagaagttgccatttctttctttttttttgagacagggccttgctctgtcgcccatgctggagtacaatcaccacttactgcaaccttgaccttccaggctcaagcaatcttcccatctcagtctcctgagtagcttggctacagacacgcaccaccatgcacagctttttttttttttaattttttttgatagagacagagtctctctgtggttgcccaggctggtctcgaactcctgggctctagcagtcctcccacctcagcttcccaaagtgttgggattacaatgtgtgccacaacacctggccttttctttggatgtcttaggaaattaactcctacctttctaaaaattcctgggtttatgtgacctggatttaaatggtcatgagagaaatttctgatatgatagtgcaatcaagtaacactggaattctttgactaccttagtttttctagagtttcacttaaattaacccaattttgttccattggcagttttatccaagactgaataaaggtagtttaccttttaagttgctatacactagaacttacctttcaattaattcttttaatttaacagtgtggaaagctattatttactttttatttaattgatagtacttttgtaaacttttacctgaaaaaagtaactttgagaaccacagagaagaaacatattggttaaggtttctgaagagtgtcggaggattcaagagtgtggggaattgcttctgtgattcccatcacttcacattctgagtagaaaagcacacaacagaaatgctgcaagtcagcatcaggagtccatagcatccatcatcaagtgcaataagactgtgactctctgttactgagttgtgatgctttttctttttgccagtaagttacatggtccagttttttctttcttagatgacttcagggacttgttgtaagcctgctgaggtcaaggaatgcttctgccttatgtgcagtgtattataaaaagatttatctgtgataaaagtggaactcggctgggcatggtggctcacacctgtaatcccagcaatttgggaggctgaggcgggctgatcacttgaggccaggagttcgagaccagcctggccaacatagtgaaaccccatcgctactaaaaatacaaaaaaattagctgggcgtgttggcatgggcctgtaatcccagctactcaggaggctgaggcaagagaatcacttgaacccaggagacagaggctgcagtgagctgagatcatgccactgcactccagcctgggtgacagagcaagatttggtctcaaaaaaaaaaataaaaacaaaaaaaagtagaacccatgaagaaaaatttaaacaactgattttaatgactgtaaaggagtatcactagtagaaaaatgtttctatattgttaggataatcaagtttctttaaagataatattgatcatttttagcagaagtttgttatttatctttaggaaatgaaattaaatattttgctttgttttgtttttaatgtttctaaaaggaatgaaactgcattattgctgattctgttgtggattgaggcatttagagtagcaaaaattatattaatgctctgtgccaaaacacataaaatggctttatcactgattggtgtctcaattataaaaaggtaataatttgcataatatgataagaatgccacttgaaagaaaggaggctgggttgttttttttttttttaacatccagtaaaacatgattgacatcatctagtcaaattatatattatactgagctttattttctgtataaaccatattttacagatattattttaaaagaaattgaaatcttctgggcttaggtttcagagttatatataactcataagtgagctgtgtgagctgagttccttaaacctaggtctcatttcaaaggctagctttgggctggttgcagtggctcacgcctgtaatcccagcactttgggaggctgaggcaggtggatcacaaggtcaggagatcaagactatcctggctaacacggtgaaaccctgtctctactaaaaatacaaaaaattagccaggcatggtggcgcacacctgtagtcccagctactcgggaggctgagacaggagaattgcttgaacctgggaggtggaggttgcggtgagccgagatggcgccactgcactccagcctgggcgacagagcgagactccactccatctcaaaaaaacaaaaaaaacaaaaaggctagctttgttccaaagcccaaacctggctctggtagactattttctaagctatctcttgatgagctttgctaaaggaaagggaagtatggtacagatcacctcaaagtcatgtttggctctctctgcatttggagttttcctctggcatgtttatattctgaataatgcttctcctaggctaaatacagtttggaccctgcatcttacaacagatgtgacagaggaatgcttatggtcaataatgatgtacagtccacagtgataaagaaattggtgggaatgagactttgagaagtataatgaatgtcagattgcaggctgcccatagtacatccagcatcagcacactgtagtttgccttaactaatttgggcctctgcagctttgggacagtattgcaaataggtggtataataagcttaaataacagatttccatcacttaaatatgaaaatctcagatttgtcacagtaataatattgacctcatgtttttgtttttattttttgttcattgacttcatgaatgaatagtttggcaggaaagcaggtaatacacttccaggccttatattacataggtgttgaggctagagaatgtcacagaggcgtgcccttattcataaaacactaggggaaatgccttactgtgttttattaagcgaagacctttcattgtaaaggtgagattattcctttagaaaccatataaattactgaagggaattatgagcaagaatatattttgggttcatagatgccaaatgcccatctcactggatgattattattctaagtattttccattacctagtttcagctcaggaaatcaattagacccttaagggcctaagcaagcaggaaatgagtgatagatttatagattccaccagtgaatttgaaaaaaaaacttttaccttttaaattataactgcaatagactcaatataaatgctttttttttttttttttttttttttttttttttttttttttttttgagacgttgtctcactctgtcacccaggctggagcgcagtgatcttggctcactgtaacctctgcccccaggattcaagtgattctcttgcctcagcctcctgagtagctgggattacaggcacgtaccaccgcatctggctagtttttgtatttttagtagagacagggtttcgccatgttggccaggctggtctcgaactcctgacctcaagtgatccacccgcctcggcttcccaaagtgctgggattacaggagtgagccaccacacccagcccataaatgccttttttagtgctccctctttctttcctatgtaaacccttttcaagttagattttccctatgatattctcaataaagaacaaattacataaaatcaggaacctgattttatattaagtgtaggaagtcaaattaccattgagcgtaggtcatatattctagtagtagagaccaatctattttctgccttgttctggagggtcatagcaaatctgaaccaggcagccaggtagaccaccactctgatggccccattcaagcttagagcttccccagtctgaaagacactggaggaagcttcttcccaccttatttagctccaagagttcagttgtgctctgtggaacactaggaataactgtatcctagacataaaccaagggcaagacatggttttagtttccatgagggcctttgcttaagagtcagaagggctgctacacatcttaattttgccactgaatagctatgtgataccaggcctttgacataagcagttaagttagaggactccagagggcctgtccagctcttacataagtctaaattccacctgtgatttcataggatccttaagtaagcattccacttctatgggcctcattttctgcccctattaaacaaagacatggctcttgagagcctgtttaaagcaggtttttgaaaagaaagtctcaagtcaaagaaattttgaaatggatttagattaaaaggtatttttgtgtgtgtggagaatgtgggattaactcacttatttttattatgtatagaaatttcagtttgttactatagactatttacagaaatatgagttcttgagtttttcattctgctaccccagatgtgtagcactctgctttgtacatagaaagcacttagcaacttgtgtgttctcttgaatttaactgaagtcccacttgaaaaggtaaagttatataaactactttttagtatttgaagtttctttaagcctatttttaatgatggcttggtgttcatgcaatgacttatttttgtttgtactggcagagcgtagctttttcagttggccagttaaaatggaaagacaagctggacgcagtggctcacgcctgtaatcccagcactttgggaggccaaggcgagtggatcacaaggtcaggagttcaagaccagcctggccaagatggtgaaaccccatctctactaaaactacaaaaaattagccgggtgtggtggcgggcacctgtagtcccagctactcgggaggctgaggcagagaattgcttgaacacaggaggcggaagttgcagtgaaccaagatcgtgccactgcactccagcctgggtgacagaacaagactccctctcaataaaaaaaaaaaaaaaagaaaagaaaagaaagtaagacaacttgtgctcttatttttaaaatattatatacttctagccccatacaaatattctcagattagactaaccaattacacattggaatacctggacagttttaaaatacaactaaaactgaacagaagcatccaaaggtcaaccactgttttactggacataccttttactttgctattttatgtattttatattaaagttagacctttgaggccaggtgcagtggctcacacctgtaatcccagcactttgggaggctgaggtgggcagatcacctgaggacaggagtttgaaaccagactggccaacatggagaaaacccatctgtactaaaaatactaaaattagccgggcgtgctggtgcgcacctgtaatcccagctactcaggaggctgaagcaggagaatcacttgaacctgggaggcggaggttgcagtgagtcaagatcaccccactgcattccagcctgggagacagagcaagactccgtctccaaaaaaaaaaaaagttagacctttgggtttaaaagccccaggataaacacatgaaaaaaactttcaaaatttacaagtgtaaaatatgctcagtacatccttcttcccacccaaccaaacaacaacatctcaagttaaatcaagtggtataaaatgtcaacctagaattctaccactgccccagggaagttctgtctgcccactgtcgtctgcttttacaggtctacactagaaacaacttcccttgataggaagtactgactttgttcagagctgtaaaattatacccagaacctcccttgttcttgttctatatgagtcccagggcctgagagccgccatttatgacgctttggtttgtcacaccctgcacacaccattagagacatttttctctcttggctttgtatctgcttccttctgttgctaccctctccatttcctattttcctaatttttaaaaatgaaatttatttttgctttttcatttgtctaagacttaggctttcatttccccagctgtaaatcaggcattagataataatctctaaagccaattccaatactctgtgaagtcattgtatcttatatttatgagtaaatatagttatcatctttttgataataaattcatcaataaaccatggattggaatacataagaatctgaaaaccctttataaccctcctatctctgaaattcacagatactgctatatagaactgattgatgaatttcaataatatctacaccaacatataattaataatgatatgtattaataatattgataacaatgagacacccacaggtgacttgtcagtaactgatttgtgatttcctaattttaagagtgtgtgtattcttgttgtaatctatgagagcaagaaccttctcaaaataaaagaaagtttttcacagatactaattcagtgactcatttactgacaattttcagtagggtcagaaacaatatcagattggtctgaaattataaaaaatatttttaagagtctaatagttaaaagttaatttggggtgaaaaacaactcctctctataattgtattttattttattgttttattgtttaattattttattgtgtatttttaggcagggtctcactttgtaacccaggctgggatgcagtggcactcattgcagtcttgacctcccaggctcagatgatcctcctacctcagcttcccaagtagttgggattacaggcatgtgccaccatgcctggctaatttttttaaaacttttttgtagagatggggtctcactacgttacttatactggtcttgaactcctgggctcaagtgatcctcctgcccttggcttctcaaagtattggaattacaggcataagccacacactagaccagtaattttaatatactgtatatccatggtcctcaacagggagtgattttgccttgaggggacatttagcaatgtctggaagatattttggttgccataaccttgggttgtgagatgctactggtatctggtgtgcagaggccaatgattgtgcaaagcatctttaaatgcacaggatagctccccacaacaaagagtcagccattccaaaacactaatagtgccaagattgaaaaactcttccgtatgtgactgtgtgactcaactgagttctatgatttggagagtcttttcatatttaattctagaggttgtgaaaataaaatgaaggtcattataatgtcatagttcagccatgtgtaccattaccaactgcttgctgactcttggccttttatccttacctagactattagaccttcacaatggattcttaagtctggcctgagacacttattattactacaggaaaacaaaaaagaaagcaaaagatcctactatctggtaataaatgtctcatctgagcaggtttaaagatcaaataatctttgaaaaataacaattctggctattattaaaaagtcaaaaaataacagatgctggtgaggttgttgagaaaaaggaatattttacactgttgatgggagtgtaaattagttcaaccattgtggaaaagatagtgtggcgattcctcaaagacctaatgacagaaataccatttgacccagcaatccctttagtggttatataacaaaaggaatataaatcattctgttataaagacacatgcatgcgtatattcattgcaacactattcacaatagcaaagacatggaatcaacttaaatgcccatcagtgatagactgtttaaagaaaatgtgaggccgagcgtggtggctcacgcctttaatcccagcactttgggaggccaagacgggtggatcatgaggtcaggagatcgagaccatcttgcctaacatggtgaaacgccatctctactaaaaatacaaaaaaaattagccaggcgtggtggcgggtgcctgtagtcccagctactcgggaggctgaggcaggagaatggcatgaacccaggaggcagaggttgcagtgagcggagattgtgctactgcactccagcctgggagacagagcgagactccatctcaaaaaaaaagaaaatgtggtacatatataccatggaatgctatacagccataaaaaagaatgagattgtgtcctttgcagggacatggatggagctggaggccattatccttaacaaactaacaccgaatactgtgtgttctcacttacaagtgggtgctaaatgatggtcacacagaggggagcaacacacaccggggactaccagagggcagagggtaggagggagaggatcaggaaaaataactaatggatactaagcttaatacctgggtgatgaaataatctgtacaaaaaaaccccatggcacacgtttgcctgtgtaacaaacctgcacatcctacacatgtacccctgaacttaaaagttaaaaaaaaattagaaataacaatttttatatagcagtatgctttaaaatgatgtcatggactgttaaacttcagtagacttgaccaatcatttagtccaatgctttttttttttttttttttttttccaaataaagtaagagcctcactatctaagctcacatggtatattggttgcaggattaatacaaggaggcatgattacatgatcacaatccagacacaagtcacctccttcatgacaaaattcatcacaaatgtaggttctttatgtggttcttatatggccctcactagcttttgcatcaaggtttgctcagtgtggactttacgaaaatcaggaaggagatgatttagtgagtaaggggattagaaattgtatcctggcaccatttacacaactcgcaacacaatattaaaaaatgactagggagacggaggtggaaggatattttatttatataaatcttagccatgcccagtggtacacacctactgtcccaggtacttgggaggctgaggcaagataagttgaggttgcagtgagctgtgatcatgccactacactccaatctggataacagagcaagaccctgtttaaaaaaaaattaaaaatcaagtgattttttaaaaatgaagaaaaggacaagtagagaggtagggtggggaattttcccttgaatcctcaaaataataaaactgtatattccactttttatctccttccttcacaacatttgaaattccacagtaattttcccttcggttatttgcctatttcctttttaatggtttccattgttatacccagtagattaaacaacattcttctttacttattgaattgatatagtaagatctgcaaaaaaaagttattccaaaatgcttatagtaaagaacaaagtttttagggatctaatagtttctttccttcccaaccttattgagatataaatgacaaataaaaattatttatatttaaggtgtataacatgatgcatacattgtgaaataattaccacagtcaagctaattaacacatccaataccccatatagttaatgtgtgtgtgtgtgtgtatgtgtgtggtgggaacacttatgatctagcaaatctacatctcccttaccaaacttcaatatacagtagagtatcatgaacttgtagtcaccatactgtatattagatcctcagaactttgtcatcttataactgaaatttgggccctttgagcaacatctctctatcttatcccccgacaaggagcaaccaccattctactctctgcttctgtgagtttgacatttttagattccatctgtaactgaagtcatataatatttgtctttctgtgtctggcttatttcacttagcataatgtcttccagcttcatccatgttgtcatgaagggcaagatttccttcttttttatgactgaataatattctattatgtatatctataaatgtaaatatatataccaccttttttgtatccattcatccatcaacagatgcttaggttatttctatatcttggtcattatgaataattctgcagcgaatgtaggagtgcaaatatctcttcgagatactatgctgatttcattacctttggttacatatccagaagttggattgctgcagtagttccattttttatatttgaagatcctctgtactattcttcatagtaactgggccaatttacatttccaccaaaagtgtataaaagttctcttttctccatatcctcactaacaattgttatctctttttttttaaataatggccatcctaacaggtatgaggtaatatttcatggttttgatttgtatttccctaatgattaatgatgttgagcaccttttcatatacttgctggctgtatttatgacttctttgggaaaatatctattcaggtcctttggccatttttaaattgggttatttggtgttttgctgttgagttatatgaattctttaaatattttggatattaatccctcatgagatatatagtttggaaatattttcttccattttctaggttgcatttccattttgttgactgtttcctttgctgtgcagagctttttagtttgatgtagtcctacgtgtttatttttgcttttattgcctgtgcttgtgtcaaaaaatcattgccaaaatgagtgtaaaggagtttttcccttaagttttcttctaggagttttgtgatttcaggtcttaaatttaagtctttaaatatttcacgttaatgtttgttatggtataagataagggtccagtttcattctcttgcatgtggagatccagtttttccagcaccgtttattggagggactatcctttccccattgtgtattctccttggtgcccttgtcaaagagagatctagtagtttctaagcagcatcatgaagctgtatctttactgatttcatgttacaacaaaatttttttaagcacaaacccaggggtgtgacataccctgaaactggtgatttgaaaaacagtactgttagagaaagggatctatggagatcattgttagtagtagtaattggggcattggatcaggataccccagttatcctgatccaataccttaattatataattaagtttttaagtgtagaagtgggtgtaatgatcactgttttgataaaattaaaatattaatgtgttaaagtacccatctcatttggtgctagtagaaaacgaaatgcataaaaactattgctaaaagtcactaaacctctcttacagcctaattagcaagttaatgctttttccttttggctgttccctaatttttcattcaatttatcttttcctgaaaacctgctaatttcatgcactttagccctacggaagaggacgttgcttagcaactgcctaaataactaatagacctaggtatctagtaaaggcttgaaggatttacttattttaaatttatatatttgtgtattaaccatcaaatccaagaggaagttgtttcactttggtatttcttcggatttctgcatttttatgattaattcttttcttttttttttaaatggagtcttgctgtgtcgcccaggttggagtgcagtagctcgatcttggctcactgcaacctctgccacctggattcaagtgattctcctgcctcagcctcccaggtagctgggactacaggcgcacctaccatgcctggcaaatttttgtatttttagtagagacggggtttcaccatcttggccaggctgatctcgaattcctgacctcaaatgttccacccacctcggcgtcccaaagtgctgggattacaggggtgagccactgtgcctggcctgcatttttataattaatttgtacatgagttgtttgtagcaaaaaaaaaaaaaaagaaaaacagtatatttaatgggaacttcttttttctcccttcaacctcttagtaacattgctgtatttgtcatttactttagttaatcttttctaacagaataccctatcaatgatatttgctgagttaagaaatgttttctgggccgggcgcagtggctcatgcctgtaatcccagcacttttggaggccgaggcgggtggatcacgaggtcaggagatcgagaccatcctggctaacatggtgaaaccccgtctctactaaaaagacaaaaaattagccgggcatggtggcggacgcctgtagtcccagctactcgggaggctgaggcaggagaatggtgtgaacccgggaggcggagcttgcagtgagccgagatcatgccactgcactccagtctgggtgacagagcgagactccgtcttaaaaaaaaaaaaaaaggaatgttttctggccaggcacagtggctcacacctgtaatcccagcactttaggaggccaaggcaggcagatcatgaggtcaagagttcgagaccagcctggccaacatggtgaaaccctgttgctactaagaatacaaaaattagccgggagtggtggtgtgtgcctataatcctagctactcgggaggctgaggcaggagaattgcttgaacccaggaggcagaggttgcagtgagccaagatcgtgccactgcactccagccttggcaacaaagcaagactctgtcacagaaaaaaaaagttttctaattcactggatacagaattctataatatttctttttaatggtaagctaattattttagaggaaatacattaaggttttaggagaaggaatttagaaattaaattgaagtcgttgctattacctatacatgatggttttacttttggttgtttgacccagaagtatctcagaagctcatctgagctaagggttttctaaggtttgagggtatgagtggtgctgtcattttgcaatgtcctgttatacttaatttagccttggtgtgtttacttgtctgaggttaagtctccccactatgacatataaagctgtattattatccaaatctcagacctattttcttcactcttatattagttcattctcacgctgctaataaagacataccagagactggttaatttataaaggaaagttgtttaattgactcacagttcagcatggctggggaggcctcaggaaacttacagttactgcagaaggggaagcaaacatgttcttcttcacatggtggcaggaaggagaagaatgcgagcaaaatggggaaaagccccttctaaaaccatcagatctcatgagaattcactcactatcacaagaacagcatgggggaaccacccccatgatctggtcacctcccatgaggtccctcccccaacatatgggaattacaatttggattacaattcaatatgagactttgtctggggacacagccaaaccatatcaactgtgtttctgttcaactgccctgaagtaaaaacaaaataccagcaaattttcttactgcaccctttgcattctgtggtgttgagacattaaagaccatttgcatcaggctagtgtggtggctcactcctgtaatctcagcactttgggaagcctggggagaggatcacccagagctcaagggtttgagaccagcccggacaacattgccaaaccctgtctctacaaaacctacaaaaattagctggatgtggtggcacacacctgtggtcccagctacttgggaggctgaggtgggaggatcaccgaagcccgggaagtttgaggctgccgtaagccaagagattgcgccactgcactccagcctgggtgacagagtgagaccctgtctcaaaaaaagtaaataaataaataaaagaagaccacgtgccacttgcacaaatatattagcagtaaaaagaacacatagttgggcatgatggcacatgcctgtaatcccagctacttgggaggctgaggcaggggattatttgaacccaggaggtggaggttgcagtgagccgagatggtgccactgcattccagcgtgggtgacagaacaagactccctctcaaaaaagaacacaggcaacttatattaatagtgttaagcgagtctacattaaagagaaactgtgctttcaaagagttacttttgtctcagaatgaagctcctttacaaaatggctgctttagaattctatcttgcagagaggctttgggcaaatttatagcatattttctttcacaggcaagaactcctaagatatcattttgtgtaatgattaattatcctctatagatatcagagatttttttttgttttaatggagtatcttcagtaagacattaccctatcataaaataaagtgtatttaaagcaatattgccaggcacagtaacttgtgcctgtggtcccacccactcgggagctgcggtgagaagattgcttagcccaggaattcaagtctggcctgggcaacatagcaagaacctgtaactttttaaaaaaggaaatattagattattagtagctatagtaactataaataatagaacatttcatctacaattgactaatatagagcttatttataaactgcaatctgtaagactgtatgtatcatgttcacatctcaactgtgctcatatctcatttgcattgtcaaccactgtacaaagagaacaatgtaggataactagagtgaagtttaaagattcatacttagtaagttatctgatacaaagacaatatctgccaaatagtttaggacaaaaatgatttttaagagatatgtatctttgagagagagtgaaggagaggaggggagagggagggagggggagagagagagagagagagagagagagagagagagagagagagagagagagagatgccagcctgccaatattcaaagagtttaaacttcaaccataacgtttattttttctccttctctcatctttccctctatatctatctatagaaatataaaaacatattttagatttaacataaaaaattaactgtcattcaaatgaatgaaattagaatgttctgggcattgccactgccaccactatgacagctgttttagaattatgaaaatctttttattattttattttagaccattaagcaatttactattgctcttaaagcatacataaagccaatttttaacatcatggaagccatcgctgacaagaatgttgcctcaattcacatgatattttctattatagcagtctgttaatgtgtattgcattcatcagtaacttgaggaggaattgataaattgccttcagtcttctttctcctcatatttgcgaatgccttatataataaatactactacaggccaggcatggtggctcacacctgtaatcccagcactttgggaagctgaggtgggtgaatggcttgagtttgtgagttcgagaccagcctgggcaacatggtgaaaccccttctctactaaaaatataaaaaatgagccaggcttggtagtgcatgcctgtagttccagctacttgggagactgagagaggaggattacctgagcctggaaggttgaggccacagtgagctgtgatcgtgccactgcactccaccctggacaatagtgagaccctgtctcaaaaaaaaaatttttttttttaaatttaaaaattagctgggagtggtggcgcttgtagtcccaattactgtggaaactgaggtgggaggatcacttgaacccaggaggttgaggctgcagtgagctgtaaatgcatcactgcactccagcctgggcaacagagagaaaccctgtctcaaaaatgatagatagccagccatggtggctcacgcctgtaatcccagcatgttgggaggctgaggcggccggatcacgaggtcaggagttcaagatcagcctggccaacatggtgaaaccttgtttttactaaaaatacaaaaattagccgggtgtggtggtgtgcgcttatagtcccagctgcttgggaagatgaggcaggagaaatgcttgaacccgggaggtggaggttgcagtgggccgagatcgcgccaaaaaaaaaagatagatagatagatagatactgttggatgcaatataagttttcagcccatattttcgttatataaggatacaacattaagagcaaaatactaagataagagaaatatagagtctaccattagaaattttaaaacttctatttcaggatttctaaatgggctattcaaaagtgaattgaatctcctgtcttttctcttgctttcatttgtgacaaacctgatgtaggtgggaaaaaacctgagcctttgtaatcacatgtttgggtttaatcataactctcatttagtagtagtgtgacttatttatttatctgagacagagtcttgctctgtcacccaggctggactgcagtgacgtgatctcagctcactgcaacctccacctcctgagttcaagcaattctcctgccttagcctcccaagtagctgggattacaggtgcatgccaccaggctgactaatttttgtatttttagtagagatggggtttcaccatgttgttcaggctggtctcaaactcctgatctcaggtgatcctcccatctcggcctcccaaagtgctgggattacaggcatgagccactgagcccagccaaagtagtgtgactttaaattgcttaaactcttttttttttgatggagtcttgctccgtcgcccagggtggagtgcagtggcacgatctctgctcaccgcagcctccgccgcctggggttaagcctcagcctcccgagtagctagaactgtaggcacccaccaccatgaccagctaatttttttttgtatttttattagagatgaggtttcaccatgttggccaggctggtctcgaactcctgacctcaggcgattcacccaccttagcctgccaaagtgctgggattacaggcatgatttccatggcacccagcctaaattgcttaaactcttagagcaagtatctcttctgtaaaattgggataattaaatctgctacaaagtattgtgtaagaactaaaagagataatgaaattatggctcctccctagcacagtaggttttaaatatgtgttatttctctcccccttccccatttacctctgatggaaacttagttgacatctttgaagtgaagtggtttgttggtcagttcttagtttctgagttagctgctactctaagccattgcacagggtatttcttttgactcaagataaaaatgaactgtggaaaaccttattataatatagttatgaagaaggattatttattttcacatgatagcccatagtaatggtgttttgttgatcaggttacaatagattaatatcattatataacaaatgctcttttttccctgttcttttcatagttgttcaatttaatgagaggtaattgattaaattctgtttgcattgtagtcaggaaaccggagagggcagcaaactgtaggagattgtgccccaacgccccacccaggcctccctatcaagacttcacctccactaacctgtctcagtcatttctaacagaaggactcatgtaaattaccaaattactcccaaataaatcagtgtccagaaagatttagttgtttatggaaaattggtagaggattgaaattgtatgacactgttattcatctctcctggacaaggaaatacgaaaaaaaaaaatggaggcattggttgtgttctcgtatactgagaacctcactccctgccccatttctaaaggttacaattccatcttctctttagttttcatcaaatagttttgccccctgtacatcatttttattaatattgataataacaaccaacatcaatcaaatgctttccagagtcaggtacctcactgcattgttactattttctcgttttgtggatgatgacatggtttggctctgtgtccctgcccaaatatcatctcaaattgtaatccccacatgtccagggagggaggtgagtggatcatgggggagtggatcatgggaggtgagtggaacagcatccaccatgctgttcttgtgatcctgagtgagttctcacaagatctgatggttttataagcatctggcatttcccctgctttcccttctctctcctgccgccatgtgaagaaggtccttgcttccccttcaccttccgccatgattgtaagtttcccaaggcctctccagccatgtagaactgtgagtcaattaaaactctttcctttatgaattacccagtcttggggtttttcttcgtagcagtgtgaaaacggactaatacagatgagaaaaccaaggagtgagacaacttatgtaatttgctcattgtcactgctatagactgaatgtttgtgtccccccaaaattcacatgttgaaatacccaaatgtgacgatattaagagacgggatctttgactggtgattagatcatgcgggttaagttctcttgaatgagattagtgcccttataaaaaaaactccaaggagaccccttcctcattctaccatgtaaggacacagagagaagacctctgcctgtgactagaaaacacgctcccaccagacaccaaatctgccagcaccttcatcttccacactccagaaatgtgataaataaatttctgttgtgtataagttatccagtctatggtattttattctagtagcagcccaaacagactaagacagtcacatagccagtgagtggtggagcccagtatcaaaccaggttattctaaattctggagcccacacttcctttctctaatggcataaatggaagctagaaaggcaggaatttagtaatcttcaatgactggctttggcctaatttgttgacctgatatttgcaaattaccataggctaatttaaatctgcctttgtaacttctgctgtgtccagtatcagtttaccactctggtcattctaaattattttttccctgtaaaaaattatttcactttgcctatctaaattcaatccatcttttccatgaaggcttccccatctgcagagggacttcattctattacagtcctatatcactaattattgtattacatgacagacatagctttttttatagtctgtaacctatgtatgtgtgtgaaggagacatcagtgtttgagaaacagcagtgtttggcacatggctaattctggtatatgtttgcctacttccttatcctttagcttgcacactagaaacagacacacctgttttttaatcctagcagctctatttctagctgtaggtatcgagtcaaatcacaaaacttctccatattttaattatctacaaaaaaggaataattatggtatctagtttattgatttacagtgaagatgaaatgagattttgtgtttaggacatagtgaatacttattaaatattagctgccactattataacttctttttttttttttttgagatggagtctcgctctgttgcccaggctggagtgcagtggtgcgatcttagcttactgcaagctccaccttccaggctcacgccattctcctgcctcagcctcctgagtagctgggactacaggcgcctgccacaacacccggctaattttttttatatttttagtagagatggggtttcaccgtgttagccaggatggtctcgatctcctgacctcgtgatccacccacctcggcctcccaaagtgctgggattacaggcatgagccaccacgcccggcctattataacatttttagtaaatattcattgttatagattatttgtattactagattacaaaatctgtaatcccccttatgcacattataagcatttagtaaatgttgagttttttgtttgtttgtttgtttgttttttgttttgaaacagagtcttgctgtgtcacctaggctggagtgcagtggcgcgatctcagctgattctcctgcctcaggctgctgagtagctgggattacaggcatatgccaccacgcctagataatttttatacttttagtagggacggggtttcaccacgttggccaagctggtctcgaactcctgacagcgtgatctgcctgccttggcctcccaaagtgctgagattacaggcatgagccaccacacctggcctgagttgcttttttaaaataaataaagatttaattcacataccatcaaacttgtcaagttttaactgcaggttttaactgcaggatttaaccaagtgccctgctgtaaactgccagtatataacataatgcaggcatgtgaggtcccattggaaagggagttatccaggctgggagaaaaacttgagagaaatgggcacttgcatgaaatcctattgctgttccctaaacctaccctctgatcttatgaaaaaacgaatatcatgtgaaatgatttcatttcatttgattgttagtgaaatgttttaaataattatttgaatgctttagaaattaatgtatcgttatttgtaattagaattcagttgtgcactctgctcaaaatgagacaaagtgaagcattactcatgttttcaggtaagtatgaaactcttcattttgagtgataacaaatatcggtgaatgcttacaagcacttgaaacatttacttttggttaggtaaaatttaatgtgaatgtgatggcggtggattttagtttcaaatgaggtaaaaagctgaattgttaaagagttgcatctattctttcatagtctggaatctacctcaccctcattctttgtggtgagttgcaaatgaggcagcaagatacccagcatacctgttaagcaagtatttatgtcccactggtttttctttttttagtttaatgctaggttttttttttctttttttgaacaatctgttttctgaggttttgaattttcctagcaactgctaggagagataggaaggataatgagctgaatggctggtattcaacacaagaataatggtgttctttatttacctttgcataattttaaagagaacaagtttacttatcttttacttgttcttttcccattgtaaaaactcagtaggtgttactagactattctgaaatacaaattctgaaaagctttcttctgatatttctatggtttctcattcatattttctcttttgttacctcacttagagcacatgggctttgtaatgtacactgctaagagtagatagaaacctgcttggaatattgattttctgtaattaagaatgtatttatagaattttatctttcttatagttctattttttttttttttaagaggcagcatcttattctgtcacccaggctggagtgtagtggcacaattgcagttcactgtagcctgaacctcctgggttccccgcaaatagctgagactacaggaacttgctaccatgcctggctgatttttcaattttttgtaaagatgtagtctcactatgttgcccaggctggttttataatactgggctcaagcagtcctcctccctcagcctcccgggattatgagtgtgagccaccacaaccagcctttcttatagttatttatctcactgtgaacactgtgaacattttgtcattttggagatccttaacattgagtcatgtatactttgtgaatgtttgcatagagttacctaggaacatctggaagaatgttcatgaaagattagaggagggccagtcatgcaggaggaacagtttctccagggtgctacccatctatatgggggttgcagaagacctttctgccctctaaaccatatttcctttttttatttctttgagacagagttttgctctgtcgcccaggctggagtgcagtggtgcaatctcggctcactgcaacctctgcctcctgggttcaagcgattctcctgcctcagcctccagggtagctgggactacaggcacacaccaccatgcccggctaatttttttgtatttttattagagacggggtttcaccatgttggccaggctggtctccaactcctgacctcgtgatccacccgcctcggcctccaaaagtgctgggattacaggcatgagccaccgtgcctggcctaagccatatttctcttgtagttgttttgtctttctttctgtctgatcttgattttatgggtgacgtgatgagaatattcaacaagtagaatatgagatataggaaaaaggtcttgactgctactctcctgagttgagataattttttttttttttttttccgagatggaattctccctctgtcgcccaggctggagtgcagtggcacaatcttggctcactgcaacccctgcctcccgggttcaagtgattctgcttcagcctcctgagtagctgggtctacaggcgcgcgccaccacgcctggctaatttttgtatttttagtagaggtggggtttcaccatattggccaggctggtctcgaactcctgaccttgtgatccacgcacctcgtcctcctaaagtgctgggattacaggtgtgagccactgcgcccggtgaggtgagataatttttatacttgctgctttgactgatgtataaaaaaatgctactcccataatgcaactactttgctgcattggagagaacacaatagaaaaatagccacttcttattcaagcttttcttgatttttgtttcggctgtctctaaatttgacacttgagaatagatggtttatttgactcatagtatgacccaggtatgcttttgttaaaaagaacagttctaggaggatgactgttgggacaaaattagctactagtatggaatactctttcagtgtaaaatctcagaacaacatttaaaaatcattggagatattttattcataaacattttcttaataagatccagaaagggtttataaacctaataaacctattcgataggttctatcaaataaacctatttctatcaaataaacctatttgatatcttctatcaaataaacctatttgataggaggaaataggaataggacacattgcttttgactttctatacccatgtggaaaccaggaatctattctctccctctcaatttacatgaccatgaggaaactgaaacctagcgaagttaaatgacttgcccggggacggacagctagctagttcctgcttgaactgaggaccatctatttggttaccgggagtgtggctggtttctgttgcctgttttgatactcttctcctggtaagttttagcttcaaatggtattgtccacaccacagcccttgatctcaggtaattctccacaccactgcctttttttttttttttttttttttttccaatgcagttgcgtggtgtgaaggcgataactgcagacactcaggtgtaaacaacccagggaatcaatgggttggggggatggtaaaacaggagttcgtagacaggactgtgtacaatagcttctgaagttttggagggtattggtgtagctgttatttctgagaccggagaaaatgacggtagagtgacagtttctctaatcatcagttttcaaagagtatgtttttcgttggaaccacaaatatagtacacttaataaggggaaacgaaaccttgaatttttccttcccagactctgaaaagtaaagtaaactttaaggaacattttaagggtgacaaaaggtgaagattgcaaatcaaacttagagtgtccctgctcaagaaaatctgtgcactgcagctacaatagaggaccacttgggtttagaaatgacatgttattaataattctagtcactgtggctaattagaacaatctgttgaaggttataaattatagaagctttttaaaacatttatctaagaacctgtgtagaattctaaaaggactgaattatttgaagttattagtttctgtgtatgtaaacttaaactatttttaaagcctttgattatttttctaaaaatgtttttgcatgcttatagcctgatgccgtaaatgttttatgagtttaatgtacagcacctctaggtgctatttaaaattgttttttctggtccttttcttttgggttataagggttcttcgtaaccaagaagattacctatggttacgctgaatgcactctcccagggtgcataggcgctgctgaactgcggttataactcttgtttgcccctgggtggttgccagcagggagtaaggcattgtgggaagtactttctttaccttccacaacaggtgtctttgtcagtgcaccttattcagatatccatgtgtggaagctctgagtcactgaatagcaaagaaaaatatgaaagcaagaggaattgctttcacatctagaaaatgttgcaagataatctgaaatcttctggtgctggtgaatgcatgaagaggttcacagtatcttttaaagtacttctgaaaagataaggagtttaaaaggtatgaactgcctggacaccttataatgccttgtctcctgattatcatttaatttttacctggttagtcagagtcaggataaatgtgcaggaaaaaaatgttaacgaaaataatgcttaacagacaaagcagcactgtagaacaaaaatgaagtaaaaatgctttactgactccaacaagggtcaaacacagtttgaagctgttttaatcttgtggatttatttaaaatattgcatttttttgtttaaataagcttattagatttgcttgtttcctagcaatcaggtgcttttccctccttccttgtgctcgctcttataagctagaatgctatagcagttgtaaaactctactaattacatttaaatgggacaaggtgttatacaagtaatcatgttaatgtagatgaaaaaaatacttttggaaaacatgggaaaataacactatagatctcattctgagttttgttttctgaaaagcaaacaaatttaggtaacataatcctgctattggtaatgaagactaaacatttcaactggttgaaatgttttatttcaacttatttcttttgattttagacgaacttgccaaattaatttctagttctaacaaagaatatttctcatagtaagtactgcagtgtcatgatctagaaaaagcagggaagatactagcttaattaggaatattgaaaaacaacttcagagaagccttatctgtcttccccttatttttatttgcttaatcctttttccatgaaattagtatacattatatttcctgatcaagcaactttgtaatggtgattatgggcaactttcaaacttttcatctggaaatatggcagttcatttatggtctccagctgtaatttaaaaagcactactggtggttaagctaccaacagttaatggctatctactgatttgaataattaaaagaaacccctagccttaaagataaaagatgaagagaacttttatctatgggagcaaaacaaccagtttataaatgagactcttgtattgctttctgaataacaacacaaaactatgcttaaaatacttattttttttagtaggaaaagggagtaatgattattaattgatatcgctgtccctgtttcatttttatgttttggcatttttttctttaacagaaatactcagaggggaaaattttttttttcagacttcaggagatcacttgtactatgaattctttaaattctgagaaattaaaatggttttcatctgtttattttctaagattacgaaaaaataagcgttaagaacactaagaaaatttacttcttctccaagaacaatcttcatgtaataatactgcagtaagaagatgagctattatgaaaatttttaattaccaagaacataacacaaatcagttttttttgttgttgttattgctataggatatttctagttaggaaactttatttcttttttgaagtttaaaggtttccaaaaattgaattttccagcttctctgttataaatgcagaaggtgtttatagtgtatacttcctgcatagataagaaacctcttttagtttcctactgggggtgaattgctagccaagcctgtgatagcagccgctttttttttctttctctttctttctttctggatttttgacactccaccccctcgaactcaggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaggtggtgccttgcacactactctggttctgtattttcttttctaacatgatatctatactcctgtagcaactgaggcataacttgctgttggctttgtgttatgtctacaggttttcaaagatttatttacataattaaacactcatataacagtagcacacttaaaatgttaggctgatgctttcatatataatgaggttgagaggaattttagagtgccaaatatcactttgtcttaagtttctgccttgtaaatatgtatataattatcaggtaggggctagttatatttacatagcatacaattgaggctcatagaagtgtaacgtttctaccagtgagtaataacatcatctgagaattgagctacctaaacatcaggtaactttcagggtcttaaattattactaagaagaactattaggaaaataacagtacaattttagtttggctttaatatttgtaaaaaaaatttgccattctctcaggatcttagtgtgtgtgcatgtcctggcataatcaaaaacggaagttcttgcaagtgtttattgtttcttctcttagatgtcatcattataatggctattgagtttaagatatcaacgatctatacctctgaaaccaacttttttttgagatggagtttcgctcctattgcccaggttggagtgcaatggcatgttcttggctcaccgcagccgttgcctcctgggttcaagcaactctcctgtctcagcctccctagtagctgggattacaggcatgcgccaccatgcctggctaattttgtatttttagtagagatggggtttctccatgttggtcaggctggtctcaaactcctgacctcaggtgatccgcctgcctcacctcccaaagtgctgggattacaggcataagccaccacgcccggcccccaaaatcaactttttaactacaattgtagtaacttcttattatatttaatatgactcatcacaaacaacagaatgaaagagtatatcataacatttaaacctaactaatatgaagacctacttctctattttaaggcacaggaaccttaaaaacatggctatttcttgaaacaacaaattacaaaaaataaaaataaaaaaataaaggagaaagctatagattgattttaaaagacttaagggttatatcaaccagatgcaataaatcaacgttgtttaaatgctaatttgaacaaagtataaaaagaactgtaagataattgagaaaaatttgaatttgaccactcattaggtatttaataatgatattaagagaattatgtaattttttgtgcattgtttttttttttttttttttttttttgacatggagtctccctcttgttgcccaagctggagtacagtgacacgatttcagctcactgcaacctccgccttctcaggttcaagtgattctcctgcctcagcctcctgagtagctgggactacaggcacctgccaacacgcctggctgttttttttttttttttttaagatggagtctcgctctgtttcccaggctggagtgcaatggcacgatctcagatcactgcaacctccgcctcccatgttcaagtgattctcctgcttcagcctcccaagtagctgggactacaggtgcacaccaccatgcccagctaatttttgtattttagtagagacagggtttcaccatgttggccagggtgggctcaagctcttgatcttgtgatctacccgcctcggcctcccaaagtgctgggattacaggcgtgagtcacggtgcacagcctttttttttgtatttttagtagagacggtatttcatcatgttggccaggatggtctcaaacttctgacctcatgatccacccaccttggcctcccaaagtgctgggattgcaggtgtgagccactgcacccggctgatactatgatttttttaaatggtcatttagagatatatattgaatagttttggatgaaatgtctgcagagattcaaaatgaaccagtagattatgtgttgataattattgaaactgggtgataagtattaatacatagtgattcattatattctctccacttttgtagagatgcagtttaaaagaatcagctggaagacaaaaaaaagcaaaaagatttgcaaaaagcaaaacagatataaaactgtaatataatcaataaaactgtaatatactcagccaggtgtggtggaccactcctgtagtcccagcacttcgggaggctgaagcaggcagatcacttgaggccaggagttcaagaccaacctggccaacatggtgaaaccttgtctctactaaaaataacaaagatcagccaggcatagtggcgcatgcccataatctcagctactcaggagactgaggcatgagaaatgcttgaacccaggaggtggatgtcacggtgagctgagacagagcaagactctgtctcaaaaaaaaaaaaaggaaaaaaaaacaccataatatctttctggaagtgttaatagagaaacatctgacctgttgcatgctttccttgtataatatacataatttatgtttttataattacatatattatatgaagattattgccaaccccctagttaactacaatatacactataactgaatcaggataggataatccacggttgtagataatctttaaattttattttagtcattgattttacaatattccaacatgaaagcttatccagagaattcagaatatggccacgtgctgtgactcatgcctgtaatctcaacactttgggaggccaatgcaagaggaagaggattccttgaacccaggaattcaagaccagcgtaggcaacatagagagacctcatctctacagaaaaaaaaaagaggatcttgagaggaccatcataaataaacagaattctctttttttttcttttctttctttccttctttctccctccctccctccctctcttccttcctccctgcctctcttccttttttgagacaaggtctcaccatgtcaccaaggcctgagtgcagtggtgtgatcatagctcactgcagcctcaaagtcctgggctcaagcagtcttcccacctcagcctctcctgagtagctgggactacaagtgcacatcactgcccccggctaatttttttttaaagaggtagggtcttgctatgttgcccaagctggttttgaactcttgggctccagcaatcctcccacctcagcctcccagagtggtgggattacatgtatgaaccatcacacccagccaagagcctcttaagaggtctgagctgagtcttcaaaaactaacaggagttttctaggccaaaggagaaaagaaacaaatacagagatgtgaagcagcagagtatagaggacagtgatggctgaagaggtggacagtgaccaagtcatagggaacatcctatgctcaataagtataggacgttgtgtgtttgtatgtgtatggacgcaggcacataagagactgggagggagaaaaaaatgaatgaattaatataaatgtgcttatcaggaaacactcttccatttgtagattgtgtgtatattatggctcaatgcaaccctagctgcaccaaagggaattcccactcctaaccctgtagctcatttttaaatagaatttgttgactaatatggaaaagccttggagttctgatagaaacacataatattgttttatatatcaaacttttaaataatgcagatcttggggtattataaaactttctgaagatatttagttttatcagatttgaaatttaaaatcgtcttttggaggtaatatttgggtttggttcatctggaaaagttattctaaaattgtgcaagataaaaatatatatcatttgcttttttttttttttttttttttttaaatatggagtctcgctctgtcacctaggctggagtacagtggcacgatttgggatcattgcaaccttcgcctcctgggttcaagcaattcttctgcttaagcctccccaatagctaggattgcaggtgctagccaccatgcccagctaatttttgtatttttagtggagacaggatttcactatgttggccaggctggtcttgaacttctgacctcaagtgacccgcccgcctcagccccccaaagtgctgggattataggtgtgagccaccatacctggcctcatttgcttttaattccatgttgaattttttgctttgagatgaacattttttcatcaaacattttgtttttttgttttgagatgcagtttcgcacttgttgcccaggctggagtgcaatggcatgatctcagctcaccgctatctctgcctcccgggtccaagagattctcttgcctcagcctcctgagtatctgggattataggcatgcgccaccatgcctggctaattttgtatttttaatagagacggggtttctccatgttggtcaggctggtctcgaactcctgacttcagttgatctgcccacctcggcctcccagagtgctgagattacatcaatctgataactgcactgtgaagcaaattacactcttgctaacttataaaatcctccttaggtttgggttcattattaagggtatttagaaactttcttagtacaggcttaattaaatatctttctgtaattggactttgttgcataatgggaggtgttttgattccttgaatggtaaaaatccgattaaatacagtggttctcaggtgtggatactgcatttttttcttattcataagtaaccctgtgtctttcttatgtttttggtaggaatctgtagtaaaatataccttgcaagctgttacatacacaaaactgaaagaaaatttgactaaacaatacctgctgttgccacatgttatgtatgaaggggatttttctgttttattcaatcgtttaaaggctttaattgtttatgacccactaaattgaattcagaaatctctctatccacactttggaaaatatgattatatcctattgagtccttaaaagtaaatgttgatgcaagaaaatcacagacccctttacataaattacagataagaaaaaacaataaggaagccaagcataacttcttatgtcttccatatcatacacacatgagcaaactaagaaattacctagaccaatattgtttactgtgataacctaaacaaaagcctagtcactactagcagaacataagagcttttttttttttggagacagagtgtggctctgccacccaggctggagtgcagtggcttgatctctgctcactgcaacctccgcctcccaggttcaaacaattctgcctcgtccttttgagtaactgggactacaggcacacaccaccatgcctggctaatttttgtatctttagtagagatggggctttcaccatgttggccaagctggtcttgaactcctgacctcaggtgatccacctgcctcggcctcccaaagtgttgggattacaggtgtgagccaccacgcctggcctctactgggggttttaaagttacacagttctcagttcaagttttagattcgctacttaccagtgagctaagtaacttctctaagccttggttttctcatctgaaaactgagagacataatagtattacctcattggaataccatgaggttatttgagagcacttgtaaagtatttagcacagtgaaagctgtaactaattgtctccttttctaataagggaggaactaatcagactatttgaagaaggtctaaaggaagaagtgggatgaatagataaggcaccctggagacgcaggaggagttgggaggacaaaaggagaaaatgaactagttgggttaccctggagaattactttgcttgattagggaatcactatcaggataccagtcctacaggaaacttgaagccttctgccctgaagatggtgctgaagatcttaggtttgagctcagaagggtgggaaggcaatgtagaaccaatagaagggagtatatataggccaaaccttctgatgagtagatgagatcaaattactgcagcaggaatcttgcagtaatgaactggcagggcccacattgaccaaggaaaaaaattgtaaaggacattagagcaatgcaagtaaaaagagatgacaagtgtctggacttagacacttgacagtgggagtgtaaatagagattagtctacacatgttggttagttctcacaaagggaatatacattaatattatttaggaagaagcagcaactgatgttatgagaagagtaaatgattgagataagttgaaaattaagttccagccatacaaaagtggagattgctatagtgtcaaaagtctttgggaatgggaaagttaggttatcaagaatagaatggaggaaaaatgacccattctggctttaccatgttccacatctagaaattcaaggtcacagtatcacggtaagagaattgattgtccagtggttagaacactgccctttaacaaaagccatttaatcagactaacacatggctatactatattggcactggatagatattcttcactgacagaaaccaaaatagcagcactgtgccagcaaaggaagggagctctttcttggagctacagtttctctttctataaatgggagacgagggtaagcattctgtaattacttcctccttatcggattggcacagatttcatcaagcatgccaaattaaaaaacaaaattcagagcaattccatatgtcagagatggagaaaacaataaaatcaatactgttatttctaaatctttactagatatacatttcaaatattgattagaataaacataacaattaagattcatccatattttttaaaaatgttatctgaatattttttattctcattgttacatagcaagtgcacattttggcactatatcaatttcagttcagttcaagcatccaaccaatcatttggttgatcagttctaatgagttaaggttcttatagttgcaagtaataaaatcttgtgctatcttaaataagaaagggattttatcacgtggacagcaaagtgtgttcctttaaatgcaagggcagttcatctaggcaacagagctggtactggactgatgctggcaaccattctccctatctcttgccatctaattaaaacttctctcttgacatctactttatttctctgtctccaacttcttggcttctttatttctatggcagaatattgctgctacacagcatccagatttatagttctaccatctgaatcacaactccatatttctttggtgagaatctgaccgagtaatgttaggtgagttttgtgatagtatagagcagagcccctgagcacacactcaaactaaactgcctgggtccaatcctacctcacttgcaattagctctatgactttgggcagattacttaatctcaaacctcatttttctcatctgtaaaattggagtctgcaagagaaagtagtccggactgaaatcggccagaagtccctctcatgttatatctaaagtaaacctatctttaactgccaagctgtgtttcgtgtttctttcctctttctttaactcttacagaatcatgttagtagtacctgtaagattaaatcaaaattaagtttaaatttaaattaaatcagtaatatatgtaaagcacttaagaaaattaattgtcaatatatgtaaagcactggatacctagcacatagaaagtggcatgtgtatgttagttattattccaaattgattcttttattatttatgaatgaatgagacaaggtctgtcgctcactgctgcctcaacctcctaggatcaggtgatcctctctccttagccttccaagtagctaggtgtacaggtgcatgtcaccgtgcctggctaattttttatttttgtagagatggggtttcactgtgttgaccaggctaatctggaactcctgagctcaagtgatcctcccccctcggcctcccaaagtgctgagattacaagcgtgagctaccacacctggcctggttaacagaaatttaaaatgatgattaagaccaggcgtagttgctcacgcctgtaatcccagcactttgggaggctgaggcgagtggatcacgaggtcaggagatcgagaccatcttggctaacacagtgaaaccccgtctccactaaaaatacaaaaaattagccgggcatggtggcgggcgcctgtagtcccagctactcgggaggctgaggcaggagaatggcgtgaacctgggaggcggagcttgcagtgagccgagatcgcaccactgcactccagcctgggcgacagagcaggactccatctcaaaaaaaataaaaacaaaacgatgattaaattattagagaaaccaattttttttttttttttttgagacagagttttgctcttgttgcccacgctggagtacaatggcatgacctcagctcactgcaacctgtgcctcccaggttcaagcagttctcctacctcagcctatgggtagctgggattacaggcatgcaccaccacgcctgggtaattttgaaattttagtagagagagggtttctccctgttggtcaggctggtctcgacctcccgatcttaggtggtcttcccgccttgacctcccaaagtgctcagattacaggcgtaagccaccgcgcctggcgagaaaccaatattacatcaaaactcaccacagtgcgcaagctgaacgtgtaatcaaattgtagtactcaaactcattgcaaggacttcaagcttatttacaaacaggatttacagcaaacaaaacagtgtagccctgtaattgtaatgcccacaataggatttctggcaggctgaaatacagaagccctcttatccgacacagtcagggctgtagttggtttatagaaaaagttggttcaggagaagaaggataaaaattgctacatactaacttaaacatttgtttttacttaaaacttccattatcaattttgctttaaggcctttaatgctctttgtttgcttcggaattctgaaatccatatgccttctagtttcagtttccttaagaggggcagtaaattaataaatgtgtcaagcagtctaagggcaaatttgatagagattttcataacttttttctttacattttttatggcagcattgccaccatttaattcttttttttttctttttttttgagacagggtctcattctgtctggcgtgcaatggcgcaatctcggcttactgtaaccttcgccttccaggttcaagcaatcctcttgcctcagcctcctgattagctgggatttcaggcatgtgccaccacgcccagctaatttttgtatttttagtagagatgggatttcaccattggccaagctggtttcaaactcctgacctcaagtgatctgcccaccttggcctcccaaagtgctgggattataggcgcgagccaccacgcctggcctcacgctttggcttttgtccatgttccattgaccaaacaaatcaaaaggccacttccaacatcctggagaagaaaagggtactccacaataggagttgtgggaggggaaagtgagtatttgctgaacaatagtctaccacatatataattgacctaactgacccttcatatgatcaccatggttaggttagctgtgtaaaatatataagcactgtgtttctcaatagtacacttatataatattcacaaaaattgcacatgcacagattcatcatcaaaaaatgacatatactcattgaaaaatgagataaaattgaaaattcagacttaccagtcttttaccattattcattttactggaaactttaaagtgaattggcactcttttttccccatcccttccaaaggtaattaagaaacagaaatctcttgccaatgtttctagggtatgccaacattgttatctcaacctgatccatatttatagcccagggatttgcaaaaacttggggggggggtcatggattcctttggcagtgtagttaagtccatggaccccttatcagaaaaaaatgtttttaaatgtgtaacataaaatagataagactacaaaggaaatcaattgtatttaaatacaattactaaaataggccaggtgcggaggctcacactgtaatcccagcactttggaaggctgaggtgggctgatcacttgaagtcaggggttcaagaccagcctggccaacatagcaaaacccaatctctaccaaaaaaatacaaaaattagctgggtgtggtggcatgcgcctgtaattccagctactcgggaggctgaggcaagagaattgcttgaacctgggaggcagaggttgcagtgagctgagatcacgccactgcactccagcctgggggacagagcgagacttcatatcaaaagaaaaaaaaaatacgattacaaaaatagacagaaatcagatttatgatatggtaataagtacttctttattaaacacattaaatagcaagaaatggtagtgaggctactataaatgcaaaataattttgagatatatgtaatacatataatgtgaatgaaaatatctgtggtatctataggtggcaaaatcacaaataacacagtggattattggctacatttataatggaaggaattgataaatttcagttagaggttcaggaaaatagtttttttccatctaagttcaattcaatgaactccctccacatacccctaatataacctttatctgatactgtctgagacacaaagatttttacaagtcttttctttccttacagtgggctaggagaaatcttgatcatgccttccactttctctcttcctcttaatggtatagaaaattacttgtgtgattatttaatgaatctctcattaacctataacttccctatgtcagctttttttattttggaaacagaatctcactgtgtcgcccaggctggagttcaagtgattctcatgcctcagcctcccaagtagctgggattacaggtgtgcaccaccacgcccagctaatttttgtatttttttagtagagatgaggtttccccatgttggccagactggtctcaaactcctgacctcaagtgatccacccaccttgcctcccaaagtgctgggattacagacgtgagccaccatgcccggccagctatttctgtttttaccattgtatttccagcccagcattgtgcctgggggaattatacacactctgtacatatttaatgaatatattgggggaagatgaaatcccacatagttacaatcataatcttcaatatgtttgtgacaattaaatacattcatgtgtgtgtgtatgcataagatatggaatttatttttaaatctttttatccttagacccatatactaagttcttatgattgtggaatcaggttagagtctagctgagtacttaattagctcttttgttttctttttttgaatttttgttttattttttaattttaattttaactttttttttttttgagatggagtctcgctctgtcacccaggctggagggcagtagcatgatctcggctcacttcaacctccgcctccggggttcaagccattcttctgcctcagcctcctgggtagctgggactacagatgcctgccaccacaccaggctaatttttgtatgtttagtagagacagggtttcaccatattgggcaggctggtctcgaactgttgaccttgtggtccgcccgcctcagcctcccaaagtgctgggattacaggcgtgagccaccgcgtccggccctgttttatttttatttgagacaggttctctctctgttacccagtctggagtgcagtggcgtgataatggctcactgcagcctcgaactcctgggctcaaatgatcctcctgcttcaacctctcaagtagttgggattataggtgcatgtcaccatacctggctaatttttttgtttgtttttttttgtagagatgggggtgtctcacattgttgcttaggttggtcttgaacttctggcttcaagcaatcctcccacctcagcctctcatagtgctggggttgcaggcatgaaccactgtgaccagcctttctattcttttttgagatagtgtctcttactctgtcacccaggctggagtacagtggtgcaatcacggctcactgcggcctcaaatgcttgagtccaagtgattctccctcctcaggctcccaagtagctaggactgcaggcacataccaccatgcccagctaattttttccttttctttttctttttgtagagagggagcctcactatgttgctttggctggttttgaactgctgggctcaagtgatcctcctgccttgacttcccaaagattacaggtgtgagccaccactcccagccttaattagctcttaactgtttcaaaaatcaaacaaacgaacaaaaaaatgcagtgattatttctgttatacttttatttagtggttcatttaacatgtatacctcctacgtgcatagcactgtgttaagctttgagacatcgtcaaagagataacagtccagtttgggagacagccatgtaaacagccgtgtatgagtcagtgatgtgagcactgttagaaatgtgtaggtgctgtttgtcctatatgctcctgtcacaccttgcaccctgtgaactaactgaaatgggatattctatctgcttttctgagttgtacactgaagttcattttccttgtgggttgttttatttcttctctctctccctaccatagtacctggcacatagtgtcagcagccagtaaggttctaattattgaataaaggaatggtggagataattagagatattttcataaagatgtagacactttttaaagtacaggttttgatttttaagctcttacaattttactttataaataatacatgcacacagtatcagaatttcaacaaatatgaaatgatatccagtgaagttacctacccattcctgttttcccagcagttttagtagttttttttagaagtatccttctataaatatttttatacatgcaaacaaatttatatgtgttctcttttttcagagctcttggtggcccttttatgttctgtactttgcttttctcacttaacagtatgtgttgatttttctatgtcagttcatgaagggtgtccttgttcatttgaaagctacatagtatttcactgtatagatttctataatatgtgtaaccaactccctcccactctgtgagtgtgtaggttgttttcaatattttgctcctacaatactgcagtgagtaatcttatataacatttcacaaaagtgtgtgagtatatctgtagattaaattcctaggagtggaactgctgggttgaaggatacattcatttgtaattttgatagataaggccaaattgttttccttaaaggttatattagttaatataactaccagcagtgtatatctgtgcctatttaaaggtggaaacttttgaacaggaatctaagaaaaaataggaatttatcagattgtcaggggacgggaaagatgttccaggcagaaggaatagcactttgagaggcacgggatagaaagatggcacaagaggatttttaacttattccatctggctaaaatgtagggggtaggccaggaaatagagagtgggagttgatcatgataggttgtgtatgtaatgctgagtaactgatattttaaattctataaatgaaggttttgagtagggaaatgatataataaggttgattaatgtattttattaaaagaatagctatttgtgtgtatttatttaaattgaagtttgccaaaaaggtgtagtccctaaagatttttcttgctttttttgtttgtttatttggagacagggtcttactctgttgcccaggctcgtgtgcagtggtgatcagatcatagctcactgcagccttgaaattccaggtttgatcctcccacctcaccctcccaagtagctggtactacaggcacatgccaccatgcctggctaatttttaaaacattttttgtagagatagggtctcgctatgttgctcaggctggtcttgaacgcctggcttcaagcaatcctccagcctcagcctcccaaagtgctgggattataggtgtgagccaccacactcagccttttcttggatttaaatgaggttttctttttactaaggattcaaataatatgttgactatagaaaattttgaaaacacatagaaataaaaactgaaacacagaaagaaaatacagaagttactcataagtttactactctgaggtaatctccctatccaaataattcctgttgtctataaaacaataaaagaaaatcaatatatgtattaggtgggttagaaaatacaaagtgggccacagtccgggtgggcatggtggccgcagcggtagctggagcctctgcgactacacctccaaccggcctggagcccgtggcttccctggctcctgcaagcatctcgcgtggtggctctggccagctccagcactcgggttgggccggatgaccagaggcctgtagctaccagctgccctctcccgcctgggctcagccgccacccgtgagcgaactcagcccgggacacagcacacttatcaagtgggtcccatttttagccacttgctatttcagccattgctgaaaagtctagtgggaaggaaccaactggagagtcagagggagaaattagtttctatttccagctccaccactataatccctggttgaagaaatatgaatatcaacacgaaattgttcatcagcgttatttgtgccagctttttcaccttccagcttcttttctactttgtaagttactggttttcacaaaagtttctccaagtttcaatagtcttagctttgaaaagaagattgaatggaactcaagggtggtatttacatgccattctttggtggttggtgttcttggcctgtacattttcttatttgatgaggctgctaaagctgatccactttgggatggtccatcacttgcaaacgtgaatattgctattgcttcaggctacctcatttctttgttttctttcttttttttttttttgtgatggagttttgctcttgtcgcccaggctggagtgcaatggcatgatcttgactcactgcaacctccgcctcccaggttcaagcgattctcctgcctcaacctctcgagtagctgggattacaggcgcccgccacctcacccagctaatttttttttttttttttttttttttgtatttttagtagagacagggtttcaccatattgtcctggccccgaactcttgacctcatgtggtctgccagcctcagcctcccaaagtgctggggttacaggcatgagccaccacgcccagccaggctacctcatttctgatttgtccattatcattttgtattggaaagtgattggtgacaaattttttataatacatcattgtgcggccctgtgtgcatactgctttatactgatattagtgaataagaagtttaatttggcataatttcttcaagaatcagatatatcgaaacatctctccagaccacccatttggaatcacgatataaataattataaatgttttaaaaactgcttcagttctcttggccactgaaatcacaggcttagcctggctgtgcgtggattggcaagctgaatgtttaattatgtggggtgactattattttctctttggacttttatgcctttaaaataaaataaaataaaatagaaaatacaaagtggtttccaaagacaatcacttgttaagagattcttgtgattcctcctaggaagaaagaaaaaaacaaaagtgatgcatatacctgcataaattacagcataattgttaatgtagagctgtacaacaaatatcttctctttaaatatacgaatgtcttttaaagacagaaagaactgttttattttctttgagggcctcactacaagccttttagatagatccagataacatgttctactttccctctttgcaacacttcgctagcaggtacttcctaatcaggatcttgacaactatcagccacatagaatacttggaaggaggttaacttttcatactcaaaagctctcttctggaagaatcctaatattattaatagcaagtcttccacttgtagggcctgttggaacagtttgtgacaaatccttcccagactgttctttgagtatacaaattaatatctccaagtcactgatactctgagcacatgcatcctgctgctagggaagtgcattaaggtaccttcaaaaccttttttcctctgtaattacatcctaaaaattacactggagggtgggctggggtggagggaaggtcccaggtgcatttactgagctatctgtcaaagtccaccaagctagtagattgtgaccacaattttgataatttcggattccatatctgcaaggcagtgttaaaactacacaatacctgataaatgctagaatgaggataattcctctaaatagttaacatttaaccagaagctctacagtgctctccaacctaacagtcacacattaatttattccttcatgtaaaagaatcatttttattgctgctgcctgaaaggtacaaattgcttgggtgtaggctgctcagcttccttcttactaaagagacaggaaatatatcttccatttaaagtgttaatggcatctataaatgtgtagtccaatttgttattgacttgaactcttcaaagatttgagaaacaaggtttaactttagcactcaagattgttacacaagaattaaatgttttcaatgactaccttttgtagtgttgggaagggtgcaaaaaggaaagagaaggctggaaaataaatatattttatctaagagggcatgactgagttggctaagctttcaatttcatttttctcttaggaaagactttcacctattatgttacaatgtgtgctcacatttcctgattatggatcgaaatggagcttggagcactacatttggtgcaggagaggactgtcgagactagaaccaagttgggttttttgttgtttttgtttgtttgttttgttttgttttgttttgtgtgtgtgtttttgagacagttgctctgtcgccctggctgtagtgcagtgacacgatcttgactcactgcaacctccgcctcccaggttcaagccattctcctgcctcagcctcccgagtagctgagattacaggtgctcaccaccatgcccagataatttttgtatttttagtagagacgagatttcaccatgttggccacgctggtctcaaactcctgacctcaagtgatctgcccacctcggcctcttaaagtgctgggattacaggcgtgagccaccgtgcctggccccaagttgtttgttaacagacacctgccaaaagacgaggacttcctctgaacccttatcaggtcaaaacatggtagatattctactaaaattggtcaaataagtaaatgaaataaatgaatgaaaattattcattctttcaagtttgtttggagaaaataatggaaaccattcaacttgagaataaagtgtttaaaatatttataggctgtacaaatttgaagtgctattagtatcccactattaagtgccacttgttacattcccctagataatctagaaggggcaaacaaataaaaataatttaagacaaaagtaataattccacccagggtgaaatggcattcagcctattctaattctttttttttttttttgcttttggaagtttttttttattattatactttaagttctagggtacatgtgcacaacgtgcaggtttgttacatatgtatacatgtgccatgttgatgtgctgcaaccattaacttgtcgtttacattaggtatatctcctaatgctatccctccccactccccccaccccatgacgggccccagtatgtgatgttccccttcctgggtccaagtgttctcattgttcagttcccacctatgagtgagaacatgcggtgtttggttttttgtccttgtgatagtttgctgagaatgatggtttccagcttcatccatgtccctataaaggacatgaactcatccttttttgtggctgcatagtattccatggtatatatgtgccacattttcttaatccagtctttcattgctggacatttgggttggttccaggtctttgctattgtgaatagtgccacagtaaacatatgtgtgcatgtgtcttgatagcagcataatttctaatcctttgggtatatacccagtaatgggatgtctgggtcaaatggtatttctagttctagatccttgaggaatcgcctcattgtcttccacagtgggtgaactagtttccagtcccaccaacaatgtaaaagtgttcctatttctccacatcctctctagcacctgttgtttcctgactttttaatgatcgccattctaactggtgtgagatggtatctcattgtggttttggtttgcatttctctgatggccagtgatgatgagcattttttcatgtgtctgttggctgcataaatgtcttcttttgagaagtgtctgttcatatccttcacccactttttgatggggttgtttttttcttgtaaatttgtttgagttctttgtagattctggatattagtcctttgtcagatgagtagattgtaaaaattttctcccattctgtgggttgcctattcactctgatgatagtttcttctgctgtgcagaagctctttagtttaattagatcccatttgtcaattttggcttttgttgccattgcttttggtgttttagacatgaagtcgttgcccatgcctatgtcctgaatggtattgcctaggttttcttctagggtttttatggttttatgtctaacatttaagtctttaatccatcttgaattaatttttgtataaggtataaggaagggatccagttttagctttctatgtatggctagccagttttcccagcaccacttattaaatagggaatcctttccccatttcttgtttttgtcaggtttgtcaaagatcagatggttgtagatgtgtggtattatttctgagggctctgttctgttccattggtctatatctctgttttggtaccagtaccgtgctgttttggttactgtagccttgtagtatagtttgaagtcaggtagcatgatgcctccagctttgttcttttggcttaggattgacttggcgatgcaagctcttttttggttctgtatgaactttaaaatagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttattttgttgagcagtgatttgtagttcttgaagaggtccttcacatcccttgtaagttggattcctaggtattttattctctttgaagcaattgtgaatgggagttcactcatgatttggctctctgtttgtctgttattggtgtataagaatgcttgtgatttttgcatattgattttgtatcctgagactttgctgaagttgcttattagcttgaggagattttgggctaagacgagcctactctaattctttaatctatgtagtagttgcttatatattaaacgtgtgaaaatcgtatgaaatcattgttaattcatactgaaatattcacttacctctgatctatttaagccaagctaataggtttcagcctgtttctgacctcaggagcctggacccacctatgctaagataaaagccatgatgactgtggcaacagtgttgctgacattgtactgaccacattgctgtaagtgtctccatggcacatctgcttctgtagattcagtcttactctgcttttagagactttcccatataacactaaaatgtacttgcctgttagtatgtttgatattcttcaaagggagagaattggcctggcatggtggctcacacctgtaatcccagcactttgggaggccgaggcaggcagatcacctgaggtaagaagtttgagaccagcctggacaacatagtgaaaccctgtctctagtaaaaattagccagtttggttgcaggtgcctgtaatcccagctactcgggaggctgaggcaggagaatctcgaacccgggaagttgaggttgccgtgagctgagatcacatcactggactccagcctggatgacagagtgagactccatctcaaaaaaaaaaaaaaaaaagaaaagggagataattaatttcatttcttcattctcactgacttcaatgaggagatttagaataggaaaagaaaattagtatacgaacaagttgagacgaaacagaactgacataagaagaacataaaaagcagagtccataaatcttgcagtatggtagcctaggtttcatcttaatagcactaatacagacacaaaataaaatgatagtttgatgaggtaagtacagtttttcaggcctgtcttacaggtggtaaatctgaagcacagattaagttacttgttcaaggtcacagtgctggaaaatggtaaagtcaggatttgagcacaggctttctggctctagggctgtgctcttaataattattccaaatgcatggcgtttgtgctttgtactcccttattagatgttacatacaatattcttttgtttatatatccctttgatgatcagaatctgaacttttctaaactgtaacagtttcttaggaaggtgataagttagacgacaaatctataattagagtttcttttacttttggagcatggattttgaaagtgaatgattaacgatgattgacattcttatcagatttttatttactttcttttaactatttggataataaagtaatgatgcttgcctgaataacagcagttctctgttgggctttgtgctttatacatggaaagagggccttggtctattgcaaggatactaaacagtgactgtatagcatgttaacaatgttttaataaatatttttagcaattatgagctaacttaagcctttttaaaatggaatatttattatttactttgtgcctagtaatgtgttagtgctaagactaaaagagcaaagcaaatgccattcctgccttcagagtgcttacagtctagcaggcaagattgatattaaacacatattcaaaaaaagggtatgagttttttaaagagaggtagtgctaaatcctctgggaacatcctctgatctcatctaaatttgaaaccctaggttctctgggaatctatagcaagaactaatccaagttaggggtcagagaagatgtgaagaatgagtaggatttagtcagctgaagagaatgaggctatggggaagcgtgttctaggaagaggagaaatatattcagcctcagagatgtgcaaaaaagaacttaaactgcagagactttcgggagaaaacaaacaaacaaaaaaaccgagcagacaaaaaaaatgcttaaagaaattaaataaatggatcgtagagtgcaaggtgaggagagctcaggagctcaggaggggcttaaaattaggctggagaagacgttaggaactaaattataaagaaccctgctatttatgataaggaattgggctttatgcaaagggcagtggaaaactgttcaaaagattttaagcagggcagtcattaattttgtggctctatcaaaaacattaggccaattatttaaacttgggcaattcatttgatcttcctagttctaaattttctcatttttagagtaggggacttggattagccctttcagatcaaagatccctaatgtgagtttatgcaccctgagaggatcatgtctagaaagaagtaacagagtatcctcatccatcctgctctctgttcttttccttttcctttcagatttcaatatcaattttctcatgaggcgtattttagtcagtattttggagaaggcattctaatgactcctatgtctatttttttgaaataaaattcattttgtcattataaaggtaatatagaaaattttttaagcatagaaaatgaagaagaaagcaatcataatcatggatgtcatgctactgaaacccttgggatataactagaatggaagtcaggctggtaaagcaaatcccatgagaggagagagtgattactgggagaggggaatgtttgggggggtagaataatcttcagattcctgaaggactatagtgcagaagttggaatagaagacagaattatggttaatgagtagaagctactagagatacagattttaactcaatttgggaaaaacaaaactagcaattgcaactgtccaccagaaaattagtgaattcctctgaatgcccataggtattctagtaaattactacatgtacttcaaggttgccagtagaaggtgttcaggttcttggcatctcgaacaaagaattagacaaaatgcacacacaacgtgaggaaaccaaagcacggatttactgaaaacaaaagtacactccacagtgtgggagcgggcctgatcataagagccccgcttacagaattttctggagtttcaatactgtagaggtttcccattggttacttggcgtatattctatgtaaatgaagagaatgaagtcacagagtcatttactcagactgcgccctattttaaatggagaggatgttgcttggtgtgtgtggtctatgtaaatggagaggatgaatgtgaagttacaaagtgtaaatgttgtggagaggatgaagtggagttgcaaagccattcacattcctgtcattactgaagtgctttcacttgatataattttaggacattagtgtggatcgggcttgtgttccctgcctccaggccctattctcctgcctcagcctcctgagtagctgggattacaggtgtgagccactacacccagctaatttttctatttttagtagagacagggtttcaccatgttggccaggctagtcttgtactccttgcctcaagtgatccacctgcattggcctcccaaagtgctggggttacaggtgtgagccactgtgcccaggctgaatttgaatgttgacctgtcttgctaggttgacgaagttctcctggatgatatcctgaaggatgttttccaacctggttattttctccccatctctttcaggtaccccagtcagtcataggtttgttctctttacataatcccatatttctcggaggttttgttcattcctttttattcttttttctctattcttgtttgcctgtcttatttccgaaagatagtcttcaagctctgaaattctttcccctctttggtctattctgctatttatacttgtgattgcattgtgaagttctcatgttgtgttttacagctccattagttagttatgttcctctctaacctggctattctggctatcagctcctgtattgttttatcatgattcttagctttgttgcattgggttatgtattaattcgttctcacactgctaataaagacatactcgagactagagaattgataaaggaaagaagtttaattgactcacagttcagaatggctggggaggcctcaggaaacttacaataatggcagaaggggaagcagacacgttcttcttcacatggtggtaggagagagaatgagtgcccggtaaagggagaagccccccttataaaaccatcagatctcatgagaactgtctgtcatgagaacaggatgagggaaactacccccatgattcagttatctccacctgagccctcccatgacacctggggattatgagaactacaattcaagatgagatttgggtggggacacagccaaaccatatcaggttacaacatgctcctttagcttagtgaagttcattaccacccaccttctgaagcctacttctgtcatttcagccatctcagcctcaacctagttctgtgttcttgctggagaagtgttaacggtcatttggaagagaacagactctctggcttttttgaggttttagcatttttgcattgatcgtttctcatctttgtgggcttatctacctttgatttttgaggttgctgacctttgagtgaggtttttgtggggtcttttttgttgatattgttgtagttttctgtttgtttttctttttaacaatcaggccactctatctatcgtaggactgctgtggtttgctgggggtccaatccagaccccagttgcctcagtttttcctgtacctggaggtatcaccagtgtaggctgagaaaaagcaaaggtggcagctagctccttccactggaagctccatcctagggggatactgaccttttgccagcccacacacacctgtaggaggtggctgaagacccacattgggaattgtcacccagtcaggaggaacgggatgagggacccacccaaagaagcagtctggctgctttttggtagagcaggtatgctgtgttggaggaggtcccttccttgtttggaccacctatattctccatagctggcagactagagcagctgacttgactgaaccatagaggtggtggctgcctctcccccccaggaactcagagttgtctctgatggactctaatccactgccattggctggctgggattccacgccagtcggtcttaacttgtgaggtgctgtggaagtggggcccacagaacgtcgctgcttgactccctggattcagctcccttcctagggatatatacagatggatttcccacctttctgggaatcctggggctggtgtatttaaaactcctgggtctctgcatgtacctaagtggctactctgccgtgactccacatagctctgtgtatcagacccaaggccctgttggcatggtctcatgaggggactctcctgataggtgagttgcaaagatctgtgggagaagtgtggtttcccaggtggggttgcacaatcactgtttcccttggctgggggtggagtttcttttggctctatgccactcctgggtgggctgtcactgccctgcctgccccacactacttttctttgttctctctgggtcaggtggtttgcctagtcagtcccagtgtaaccacctggatatttcggtgctgaattcactcttcctttttcattcgtctccatgagtgtaatggaccacagctgtttctaatcggccatcttggattgatctctgaagctaatctaaaaggtgaggaaactaaggttatgggaagttaaggaaactggctaagacatcaggactcagtgacaaagctgggatttatatttcaaattcagcagctgtaattttttttccattgtgtgcatcttctaaaataaataatcctgtatattagagatatagaggcaacagaccaattcttgtttcctggagagtttgggaaacttcctagaattccaagacacacaagtaccataagtgtaaatatccttccaaagccatttgccttcacctgggtgcctaaagcttcaatgcccagatatgccatagaaatacagatcattctgtagctggagttgtcccattacaactctgggtttatgaaatgtgcatctggtgaaatacatgagcctttgtcttcagattatgagtggaatgtgataatataaagagaaacttcttttaatacagataatgcatttttctttatcacagaccttccacaaattctgctgttctatttgggtatttgacaatggactttgtaatgtatgacagtgcatatgggaaaataaaatgttcatgtggggtatggggaaagagaattctcagcaaatgaattggaattataatataaagcagtatagcattaggatttgaatataaaatcatataaagccatataacactggatataggtggttaagaagtggataaaaaaatttcatggctgagtgcggtactaacgcctgtaatcccagcactttgggaggctgaggcgggtggatcacctgaggtcgggaatttgagaccagcctgaccaacatggagaaacatcatccctactaaaaatacaaaattagctggacatggtagcgcatgcttgtaatcccagctacttgggaggctgaggcaggagaatcgcttgaagccgtgaggtggaggttttggtgagctgagatcgcgccattgcactccagcctgggcaacaagagcgaaactctgtctcaaaagaaaaaaaaaaaaaaaaaattcctagggagatttctgattttaaaatggtgacatggaagcaagctgcctccactctcccctccccccacagaaaaccaaaaacaaatatatagcgccaagatttttgctagcaacaactctgagcagtcagtaggagaactgaacttccatatccaaggttctgctctctcccccattctgcctggcaataagcttgaggaaaatctttccccaacttagagtttctacactagaaaaactgagattgaggccaggtgtggtggctcatgcctataatccctgtactttggtggctaaggtgagaggatcacttgagcctgggggttcaaggttccagtgaactatggttgtaccactgcactccagcctgggtgactgaacaagactatgtctctaaaacaaaaagagagattgagaccatcaaccatcttttcgcaccatactgggttacctggcaggagacctgttcttgccttaacccacaggaagcatcatgactgcctaaagggaggaatattcccccaaggacaggcagacaaaggggagaaatgggactatcatccctagctctgaaaactctgctttgtaactaggccaaaggagatgccacataaaagtggctgttcagtagctctattctataggaggtacatttctttctttctttttttcttttctttttttttagggaggaggggtgtcttcctctgtcacccaggctggaatgcagtggcgtgaacacagctcactgcagcctcaactccctgggttcaagcagtcctcctacctcagcctcctgagtattgggactacaggtgggtgccaccatgcccagctaatttttaaaatttgtttgtagagacgggggtctcaccatgttgccaaggctggtctcaaactcctgggcacaaggtatcctcctacctcagcctctcaacttgctgggatgacaggcatgagaagagagtggtatatttcataggttccttggacaggaacctctagccagccttctcacactgctgggataatctctttgggaactccctagtttgggacaggcagcactccaatcatgcactagcgtcaaggtgaacctgggctttaaggtgccacaagagccaaaaaggaggaagtgacctagtagtaaagatttgctaaggaactatatctaataaaaaacaaaacaagccagacagaaaatactgaaataaataactaattcttcaatgcaaatactagaataaataactaatccttcagtgcaaaaaccatgacctttccaaagagacagagcaacaattcagtcactagccttaagtgatgatttgtaagatctgtgacctagcattcaaaatggcaattttaaggaaactcagtgatcaccatcataacaaagaagagcaattcagaaatttatcagagaagtttagcaaagattgaaataacaaaaaattaaatggaaattttagaactaaagaatacctttcctgaacagaagacttcattaaaggctctcaacagtagaatggactaaacagaggaaaaaaaaaatcagtgagttcaaagactgtctgaaaatacacagagaagtctgggtgtggtggctcatgcctgtaatcccagcactttaggaggccaaggtgggtggatcacttgaggtcaggagttcgagaccagcgtggccaacgtgatgaaacctcatctctactaaaaataccaaaattagctggacatggtgccgggtgcctgaaatcccagctactcaggaggctgaggcaggagaatcacttgaccccacaaggtggaggttgtagtgagctgagatcgcgccactgtactctagcctgggtaacagagtgagactctgtctaaaaaaagaaaaagaaaaagaaaaaagaaaatacatggaggagaataaagaaaaagaatgaaaaggaataaagatagcctacaatatatagaaaattgcctcaaaagaccaaatcttagaattactggtgttcaagagggagctaagcagaacaaggaaggggaagaaagcttattcatttcctttgagacaggatctcactctatcacccaggtcggagtgcagtggccccatctccactcactgcaacctctgcctcccaggtttgagccattcttccacctcagcctcctaagtagctaggactgtaggcatgtgccaactcgcctggctaatttttttattttttggtagagacggggtttcaccatgttagccaggctggtctcgaactcctgacttcaagtgatccacccaattcaacctcccaaagggctgggaatataggtgtgtccaccatgcctagcctagaaagcttattcaaaaaataataataggctgggtgcattggctcatgcctgtaatcccagcattttgggagaccaaggcaggcggatcacatgaggtcaggagttcgagactagcctgaccaacaaggtgaaaccccatctctactaaaaatacaaaaattagcggggtgtggtggcagatgcctataatcccagctactggggagggtgaggcaggaaaattgctggaatctgggaggcagaggttgcagtgagctgagatggcgccactgcactctagcctgggtgacagaatgagattccatctcaaaaaataaaaattaatataataataatagtaatagaaaactttccaggtacaagaaagcctgagatcactaaacagattcaacccaaataagatatcccaagggatatagtaaactctcaaagatcaaagataaggagaggatttgaaaagcagcaagagaaaagaagtaaataacatatgaaagatctccagtttggctggcaatagacttctgaatggaaaaccatataggccatgaggggatgaagtgacattttcaaagtgctcaaagaaaaaaaaaaacttgcattcaagaatactgtacccagaaaaactatccttcacatatgaaggagatataaaatctttaccagacaagtaaaaactgaatcattcaccaccaccgggcttatcttacaagaaataaagggagctttcccatttgaaagaagaaagcactaatgggttaaaaaaaaaaagttttcaagatataaaacccacttgtaaaattaagtatacggataaacccaaaatactctgttactgtcatgtaacaatagctacagcagcctgttaagagatagataatgaaaaatatataaaatcagacaactgaaagtcaaaagggggaggcagagtagaattttgtcatgtttttttattttgcctgtttctgttcttttatttgtgatccaagataagttgtctttttaatttttttttaagattgggtctcatctgtcacccagactggactgcagtggcatgattatggttcactgcagccttgaccttctgggctcaggttatcctcccacctcagcctcccaagtagctgggactgcaggtgtgtgccaccacacctggctcatttttttgtattttttgtagagacatggttttgccatgttgcccaggctggtcacaaactcctggactcaaatgatccacccacctcggcctcccaaagtgctgggattacagacatgagccacaacacctggcccctatgttgtcatcttttaaaaataatttgttatatctataagatgcttttttttctcatgataagcacagtgcaaaaaacctataatagattcactaaaaataaaagcaacaaatttactacctattaggtaggaagaaagaaaggagtctcaaaacaaccacaagacaggcaacaagtggcattagtaaatccttacttatcaataataacactgagtataaatggtctcagttctccaattaaaagccatacagtggctgaatgggtaaagaaacaagacccagctatatgctgccttcaagaaacccatttcacctatcaagacacacatagacttaatgtgaaggggttgggaaaatatattctatgcaactggaaatgagcaggaatagctacaattatatcagataaaatagtacactaatcaaagaatgtaaaaagagacaaggtcactatataatgataaaagggtcaattaagcaagagaatataacaattgtatatttttgcactcagcaccagagttcccaagtatgtaaagcagatgttaaatctaaaaggagaggtaaactgcaatacagtaatagtaggggattttaagccccactctcagtaacagatgatccagacagaaaattagcaaagaaacagtagagttaaactacacactaaatctaatagacctacctgacatttatagtacatttcacccaactgctgcagaatacacattctcttcatcagcacatggaatattccccagaatagaccatatcttagaccacaaaacaaatctgaacatattttttaaaaaagaaatcatatcaagtatcttttccaaccacaatggaataaaactagaaatctgtaacatcaaaaatacacaaacacattaaataagtaagttaaacaacatattctttttttttttttttttttttttgagagggagtctcactttgttgcccaggctggagtacaatggtgcgatcttggctcactgcaacctctgcctcctgggttcaagcaattctcctgcctcagcctcctgagtggctgggattacaggtgcccaccactacacccggctaatttttgtattttttgtagagatggggtttcaccatgttggtcaggctggtctcaaactcccgaacctcaggtgatctgcccacctcggcctccccaagtgctgggattacagacgtcagccactgcgcctggccacgagatattcttgaacaaccaatgggtcaatgaaagtactaaaaaggggccgggcacagtggctcacacctgtaatcccagcactttgggaggccgaggcgggcagatcacgaggtcaggagatcgagaccatcctggctaacatggtgaaaccccatctctactaaaaatacaaaaaaaaaccattaaccaggtatggtggtatgcgcctgtagtcccagctaattgggaggctgaggcaggagaatctcttaaacccaggaagcagaggttgcagtgagccaagatcgcgccactctactccaacctgggcaacagagtgagactctatctcaaaaaaaaaaaaaaaaagtactaaaaaggaaattttttaaaaggtttttttttgtttgtttttgagagaaggtcttactctgtcacccaggcttgagtgcagtgtcatgatctcagctcactgcaagctctacctcccaggctcaagtgatcctcccacttcagcctcccaagtagctgggactataggtatgtgccaccatacacctgactgatttttttaaatatttgtggagatgaagtatcactgtgttgctcaggatggtcttgaactgctgagctcaagctatcctctcactttggcttcccaaaatgctaggattataggcatgagccactgtgcccatcctaaaaattttttgaaacaaatggaaatggaataaaataaattaaaactatgagaacaatagaaaagatcaacaaagtgaaagtggtttttatggaaagttaaaatcgaaactttagctagactgagaaaaaaatagagaagacccaataaaatcagaaacaaaaaaggaaatataacaattgaaacctcagaaatacaaagcatcgttagagactgttatgaacaacctggaaaacctagaagtggaggaattcctgaacacatacaacctaccaagactgaaccataagaaatagaaaacttcaacaaaccaataacaagtagtgagatcagccgggtgtggtggctcatgcctgtaatcccagcactttgggaggctgaggtgggcagatcacgaggtcaggagatcgaaaccatcctagctaacacggtgaaaccccgtctgtactaaaaatacaaaatattagctgggcatggtggcgggtgtctgtagtcccagctacttgggaggctgaggcaggagaatggcgtaaacctgggatgcggagcttgcagtgagctgagatttcgcgactgcactccaacctgggtgacagagtgagagtctgtctcaaaaaaaaacacaaacaaacaagtaatgagatcaaagctgtagtttaaagtctcccatcaaagagatggagatgcaaggagggctcagtatatgcaaataaataagtgtggtacatcacatggacagaaccaataacaagaaccatttgattatttcaatagatgccaaaaaagcatttggtaaaattcagcatccctttatgataaagcccctcatcaaaatggaagtagaagaaatgattatgtaccttaataataatggaattattatacctcaataataaagaccataaatgacaaacccacaggtaacattgtactgactgggaaaagttgaagcctttcctcctaggaccagaacaagacaaggatgcccacttataccactttttttcaacgtaacagtggaagtcctggccacagcaattaggcaaaggaaagaaataaaggacatccaaattggaaaggaagaagtcaaattagccttgtttgtagatgacatgatcttactcatagaaaaacctaaagacaccaccacaaaactgatagaactgataaacaaattcagtaaacttgcagcatacaaaatcaacatacaaaaatcataattgtaagtcagagacgatctgtgcaagtatctgtttgagtccctgttttcagttattttgggtatatacctaggagtggaattgcttgcttaaatcataattctatatttaactattaaggaaccaccatactgttttcacagcagctcaaccattttacattatcaccagcaatgcagaaggttctaatttctccactcttcactaacatatgttattttccattttttgattctagccatcctagtttgtgtaaagtggcatctcattgtgattctgattgcatttccttaatgactaattatgttgagtatcttttctcgtgcttattagccatttgtatatcttctttggagaaatatctattcagattttttacctatttttaaatttttttatttttattgtcaagtaaacttttttatatattatggacagcaaatccttatcagctatatgacacagatattttcttccgttttgcaggttgtcttttcactttcaagaaagtgtttttgttaaaaaagttttaaacttgcttgaagtctcactatttttgctttttttaaagaaagcaaacctttatgtaataatgagtgcaaacggctttgttgacacttacagaaataatagctaaatttaatgcaaatttgtgtgaattgaataactttgttacattttctaagctttatctttctatgaaatagggtcccattcacctataaaggatattttgggatttttcactaaaacttataaaatctgagaatgtgcttaggagactggagataaattttgtgagcctattatctagttagtaatgacaccatcttattaaatttcaaggtgttaaatatagcccattcaaatactcgtatatgtaatctaattattattgttatagaagttaaagctcccttgctgaacctatgattcttctaagctgctgaacatagagacacatgactgagcagtaggaggtgcttattgcttccagagttgcactatgcttgccttgatggcgtagaatggccataaagatgactgtggaaacagtgatttctaaactcttctcagagttttggatatgctccatatccaaatgaaacagatgactgtgttctgttctgtagattttactacttttctctgccagtagcctctcacatttgtcacgcaataggaaccaagcaagagaatctggacagatcagctcacatctattgccctgttaaagtaactcaaagatatgcccaaagaattggatacttgtttcatcattggataagctggaactgtctataagtggctaggatgtatcatgccttatcacaagaaatagcagaaaaaaaatatatagtctttgatttcattaaattcctttgtttgtttgtttgtttgtttatttttggacacagggtctctctctgtcacccaggctggagtgcagtggtggtgctaacatatctcactgcagccttgaactcttggctgaagcaatcctcctgcctcagccttctgagtagctgggactaccagtgcatgccaccatgcccagctaactttttcatttttttgtagaaatggggcctcactttgttgctcaggctgttcttgaactcctggcctcatgtgatcctctcaccttggcctcctaaagtgctgggattgcaggccagatgagccactgcacccagccaatttcacaaagtttcagtattctcagaaaagaacatactcatatctagaaatgtcttatgacttaaaaagcaaagtataaccatgtgcatattaatagggcacaaagtgaatctggtagagtgccagctgtgtctaatctgataagtttatttcatatggaaaatgtgtgtcaatcttagatgaggctaatttgttgaaaataactgaattctggtctcttttagattgtcagaaagggattcatttaacagtaaaatttaatccagatatatgtagtcatatgtttttaaactttttaaaccctgaaaattattgaaatatgtgccattttaatagtatcagcttctgattgcttttattccatcatcatgtgatatactcctcattaagcagcaccagtaaccagagtttaattattgtgtagcactgtgtgaaagcttttgtctctttatcatatatggcacagacagtactcttggttgtaagtagggatatccagcatagtttactgtctacatgcttatttctttagctttttttttttttgagatgaagtctcactctgtcgcccaggttagagtgcaatggcacaatctcagctcactgcagcctccgcctccaaggttcaagcaattcttccacctctgcctcccgagtagctgggattacaagtgtatgccaccacgcctggctaatttttgtatttttagtagagacagggtttcaccacattggccagactggtctcgaactcctgacctcaagtgatctgcccaccttggcctcccaaagtgctaggattacaggtgtgagccactgcgcccgacctctacatgcttatttctaagagctatataataaaacaatataactatacagattttgatggtttcctccagagcctttgccttgcttatcattgctgtgtgagaagggtagcagcactaaaccttgtgtttctagagatagaagtttgtccctgtgtactgtcgattaggacaggcagtttttcttgtcttgcctgaagaaaaacgtaacttttttgagatacaatctttctgataaggtaaatatgtttagcaaagccttattttgtggaaattttccaaggcttgaccctgtaacttctatagtagagaaaagggcagtgctttcaaacttttagctcttctcctggttggttgcctgccatggtcgtattttaaattgagtagcaagtaaataaatacttagcttctctctataaatgagctgtctgcaaagggtttctttgtactatatgactgttgtaaagtttcaatggagtaattataggaaaagaaaaagaacagatttttacttagtgctgtgttaatgccagtgtttgtatgcaataaaaatgactggccactcattgtttcagaaaatagatcttaacactcaaaagaaacaaattctaaaactttaataactttgaggaacactctttaaatacctagactttagatacatactattgtccaggatagatttcccagcatatttatctacaacagatcttaaatattgaaaactaacagaagttgttgcataaatttttctgcaattagataagaacatttttatggctggtctgcaaacagtccgtaaagatagttgctgcctatcatacttagagttaagggatgaactccattctttattttctaaactgtgattgcattatcctaaaatccagtggtttttctcacatacagtctaggattgagaggtccaaggccagtagggtgcctctgcctcctctcaagctgcttccattgatgggttcagggatttgttagagcttttaccatctccctgccaacaggggaaaggaagagagaatacatcccttccgttttaggggcacaagtatcaaatgacatatatcacttttatttaccaaccagacctaatcatatggccataccaagctgcagggatggctgggaatgatcatctttagatagataaccacaagcccaattgacaggaaggattattactaaaggaagaagcagagtggatactgaagtacaactttagtagtctctgccacagtaatacctctaaatgcatacatatgagtctgtaggaacagtcctacaaaggactggtgaagctttatattaatatatagtggtttccctttctttactgtctgcagaaagattctggctagattttttttttaaactttttcaacagccttataaaggtataagttatatagtataaaattcacctgtttgtgcaatttagcagagagttcacagagttatgcatccatcatcacatccagtttcagagtattttgaacacctccctaaaattccttcatgctcatttgcagtcagccctcatcctaccccccagatccattcacccctaatctgcttttatataaatggaatgtatgtataaatggaaccatacagtatttagtcttttgtacttggcttcttttacttggcataatgattttgaggttaatctctgctatagtaaataacagttatttcttcttttttgttgcataatagtagcttgttccttttcgttgcatagtgcattgtatggatagcccacattttgtttatccatttaccagttgatggactttttgcttgtttctagtttttggctactatgaataatgctcctatgaatgttccccacaagtttttctgtgaacatgtgttttcatttctcttgggttgatgcctaggagtgaaattgctgagtatagtaagtttatgtttaacttttaagaaattgccatactattttccaaagtggctataacattttatattcccaccagttatgtataaggattccagtttctccatatcctcaacaacacttgatgtcaatcatttttgtagtagtatctcatttgaggtttttatttatattttctaatggtgttgagccccttttcatgccctttatatattttctttggtaaaatgtctgttcagagtttttgcccttttttcttttgttttttagacagtcttgctctgtcaccaggctggaatgcagtggcgtgatctcagctcactgcaacctctgcctcgcaggttcaagcgattctcctgcctcagcctcccgagtagctaggactgcaggcacacgccaccacgtccagctaatttttgtatttttagtagagatggggtttcaccatgttggccaggatcatctcaatctctcgacctcatgatccgcccacctcggcctcccaaagtgctgggattataggcgtgagccaccactcccagcctttgcccatttttaaattgggttatttgtcttcctattgagtcatgagagttctttatatattatagaaataagtcctttatgacatatatgatttataaatattttttcccaatctgtggctttttaaaaattaatggtgtgttttgaaaagcaaaggttttaataacttagccatttttttcttttatggattatgcttttggtgtcatctaataaatcttggcctaatccaagactgcaaagactttctcttatgttttcttctaaatgttttatagttttcactgttatatttaagtctataataaatttttctttagttttttttttttttttggtatggtatgaggtaagggtctatgtacattttttttttgtatagggctatccaattatcccagcactatttgttgaaaagattattctttcccctattgaatttccctggcaactttgttgaaagtcagatgaccataagggtttatgtctgaactctcaattctgttctgttaatctatatgtctctctttacctggctagatttttaagactttcacagtaatgtttctgaattcaccttcttgcttttacatgcaatcttgtcaatgatgggacctgaaatgacctcacaacacttaaatatcgctgaaaagagtgatccagaagctgaacaaagttttatattcataagccagataaataaatacaagataagaagcatgtcaacccagaggggaaaagggccaaaagggaaaatatgatagtcacaaatatgaagtttttttgtattaaaatacaggttaacgaagagatctaaccagatagttgcttaaacaagaaagatcttcatttttgtcttttagtgtcagtttcagtatacacaatccaaatttgatgtggtggctgcgttgaagtcaggaaatcagactcgctctactatctcaaaggagagcatatctcgtcctttgaaggaagtttcacacattaattttattcattccattggtgaaaacttgtcactggccatacctagatgcaaacagcacttggaagcataatctttagctgaaggccgtgtgcccaactaagacttacattactaaataacaagcaggtgtcttagtcaactcggactgccataaccaaacaccgtatacaatatcacttaaacaatgaatatttatgtctgcagttttggaggctgggaaatacaagatcagtgttccagtagatttggttcctggtgagaactcttttcctggcttgcagatagccacctttttgttgtattctcacatggcagagagggagagttttggtttctcttcctcttcttgtaaggacactaataatcatgggggctccaccctcatgactttatcaaaacctagttacctctcaaaggctgcacctccaaatgccatcacattggctgttagggcttcagtatctcagtgtgggagtgggttggggaggacataaacattcggttcatatcagggaaaatgcacacttagaggaaattggcaggttatgcttccaattacatcagtattacagatttataaatatgtgttgatattatgtatacatcagaatatataatgtatgtatgtgttgatattatgtatacatcagaagacaaacattgaggacttacattggagacactgttatggcgattgcaaagactgcctttagtgagatttccagaatttaacagctggtggaaggggaggcagttatagtgttataactttataaatgttatttctaaactgaaaatgccattttaattttccaaacacaatcactgcagatctaagctgcactatttacagtttttgtagctaccttgatatagtaattcttcacttcaaaaaatatgtattgaggctgggcgtggtggctcacgcctgtaaccccagcactttgggaggctgaggtgggttgatcacctgaggtcaggagttcaagaccagcctggccaacatgacaaaaccccatctctactaaaaatacaaaaagtagccaggcatgctggcgattacccgtgatcccagctatgcaggaggctgaggcaggagaattgctggaacctgggaggcagagttgcagtgtgctgagatcgtgccactagcactccagcctgggtgacagagtgagactctgtcttaaaaaaaaaaaaaaaaaagcccaaaaaacatgtatacgtgtattgagtgcctgtcatgtgtcagggatacaggggtaagttgtctgtaaccagaaatacaattatgtttggcctcaaacagaaagcagagtcttctcatcctgaaatattgcagttttaataataatataagaggcctttataatttagaactattatgaagtaattatgttttggaaaaatcccaggactggatgcaaagagacttaagtgtatgtcccagttctgtcactcatcgggcaactgtgggctgacctgtttcctcaggtttaaattgaaggagtttattatatattttagtttctacagtctcctttgtttctatgattctgtagctctaattatctataatgtatatatttatgtgaaatatactttattatctataatctgtacatttctatgattccatagctccagttatctttaatctgtagtcctagagtatttattgcaaaccacctcaaaacagtgtcataaaacaatggcagttatgctcacagaatctgcggagcaagaattcacacagggccaggcatggtggctcacgcctgcaatcccagcattttgggtggccaaagtaggagaattgcttgagctcaggagttagagatcagcctgggcaacatagtgaaacctcgtctctagaaaaaaagtttaaaaattagccaggcatactgctgtgcacctgtagtcccagctacctgggaggctgaggttgcttgagcccaggaggtcatggctatagtgagccaaaattgtgccactgcgcttcatcctgggagacagagcaagatcttttttcaaaaaagaagaaaagaattcagagcctgggcaacaaagtgagacccacccccccgatctctacacaaaattcaaaattaaaatttaaaaatttgtctcgtacagtggcatgtgcttgtagtctcggctattcaggaggcttgaggtgggagaattgcttaagcctaggagttagaggctgcagtgagctctgatcgtgccactgcatctgcctaagcgacagagcaagaccttgtcttttttctttttttttttttttttgagacagagtcttgctctttcacccaggctggggtgcaatggcacgatctcggctcactgcaacctccgcctcccaggttcaagtgattctcccgcctcagccttccgagtagctgggattacagacatgcgccgccatgtccagctaattttgtatttttagtagagacggggtttctccatgttggtcaggctggtctcgaactcccgacctcaggcgatccgcccgccttgacctcccaaagtgctgggattacaggcgtgagccactgcgcctggccaatccgtggttctttactcttgtgtcagccacctgaagtgggatgtttcaaagacagggctcagctgggaccattaactgaaacacctacttcggcttctccgtatgtcttgagcttcttcacagcatagtgccctgaatgtcttacatggcagctcagggttctcagaactggtgttctccaagggaaagtttttgtcttataaaataattaaaaatattttagtgtaataaaaaaattaagaattatttttaagccaggcatggtggctcactcctgtaatctcagtactttgggaggccaaggtgggaggattgcttgaatccaggaattcaagaccagcctgagaaacaaagcaacacagtgtttctacaaaaaaaaattaaaaaattatctgggcacagtggttatgcctgtagtcccagctacttgggaggttgaggcaggaggatcacttgagcccaggagtttcaggctgcagtgagctatgatcatgccactgcactccagcctggacaacatagaccttgtctcaaaacaaaacaaaaaaagaattattcaaaccaaattgatgaaaagtgttaagtattaggtaagtagagttataaaagtttatttggggtcaccaggaacttaaaactggcatttattgggtgtatactatatgcttggcattggaccataagcacttttgtggattataatgtgatttattcttcacaacagccttatgcagaaaccaaggcttagagaagttaagcatcttgtccaggtcataatgctaagtggctgaactgtgactcaaaacagatctaactccaatgttagtggcctaactactgtattagtccattttcacatgctaataaagacatacctgagactgggcagtttgcaaaggcaagaggtttaatggagaagtcacagttctacctggctggggaagcctcacaatcgtggcagaaggcaaggaggagcaagtcatgtcttacatggatggcagcaggcaaagagagagctggtgcagggaaactcccatttttaaaaccattagaacttgtaagactcattcactatcaggagaacagtgcaggaaagattcacctccataattcagtcacctctgaccaggttcctctcacaacacatgggaattacaattcaagtgggagttacaactgaagatgagacttggatggggatgcagccaaaccatatcaactactgttacgagttgaattgtctttaccgcatccctaattcatatgttgaatatgactatatttggagtatagtcagcatctcagaatatgactatatttagaggtagggtctttaaagtggtaattaaggtaaaaggaggtcattggggaaggttctaatccaatatgattagtgtccttgtaagaagaggaaatttggacacagacacacacaaaggaaagatcatgtgaggatacagggagaagatggccatctacaagccacgaattgagccctcagaagatacaaccattgccaacaacctttatcttggatttctagcctccaaaactgttaggaaagaaatttctattggttaagcccttcagtctgtggtactttgtttttttgttgttgtttgagacggagtcttgctctgtcgcccaggctggagtacagtggagcgatcttggctcactgcagcctccgcctcccgggttcaagcaattctcctgcctcagcttcctaagtggctgggattacaggcacatgccaccatgcccagctaatttttgtatttttttagtagaaacggggttttaccatgttggccaggctggtctcaaactcctgaccttgtgatccacctgccgcggcctcccagtgtgctgggattacaggcatgagccactgcgcccggcccagtctgtggtactttgttatggcagccctagcgaactaataacgtcactaatagcacattactaatgtgcatacctgggttttgttttgtttttttaaacctgttttaatcagcctactttagtgctgtccttcccattgccctctctcttacaaagatattgtggacagatacatttgttttttatagacctacaaactttcttaccattatcacatgctgagacatataataaaggtgtacaattcttcaaggtaaaaatacctccacatgggcatactctttcctataggataaaattagagttcttccctcttttgagatgtgagcatcaattaatagcccctaaggagtttattttctgcaaagatcaagattaattacaattgtttcaaagtaatccggaaatcaatgtggaaatctctggttttataaagctagttatcagctgctaacgaactgtctaaatatgccaaaaattgaactttatcatgtagcatttaccttctgaaccatgtatttatttattatggtctgtcatgtttgaattttttgtcttgtgttatatatataaatcttgcctccctaataatgagcttcctaaagatgcacatttttgaatcctctttagttagtaaaatgtaatgaatgcatttgtaggtgagcactaaatgctattaaactgaattgtaattttcagatttaggtattttgtgtacagtttccctctaaactccacttttgaaacactattgaaatcaatatgggggatgctgttttgatacattcactctgcccttcaatttttttaagtataatttccattttatttttctccagaagatagcttttcttcagtccttaaaaactcagcttcttacacaggcttggtagtggttgtagggcagcacccggaggcctaaaaatgggtgtttagtcattcccagcttcataagaacaattcctgtctaccttgctatgggtggcaccactcacacagtaacgcagttttacatacatcttgggaagcgcatagacatcaaagacactccagaaataatccctgacagctgtagcctctactatgtttcaaatgatgaacttcttaaaatggccttgtccttgggcacgcatcaggcgcagtttatgcagcaaatagacagcatgtggctgcagctctttttggcatgaccattgttccttctttatttgtcatcttggaagcaaggactgaagagctgcctttcaatttttaaaaccacagtcttctttcctgacatgttccttagacagtggctctctctcgcagcactgttttctcaccctggggcttaagaacataacctatcaatgtattggaagagaaatgtttctgaataaggaccaggcctttgatcattttgtgagatattcatggtctcctctatctgaaagagcaatgataacattatttccaaaactggaactcatgcatattcacatctcaagtatactaaaacttttcattttctggtgaagaaattcaatgtagtggttaaaagtgtgggctctgtcttagttcaaatcccttctgtgccaactaccagctgtgtgattttaggcaaatcaacttaatcttgttgaaccttgatttcctgttctataaaatgtagccaattatagaggataggccaggcacagtggctcatgcctagaatcccagcactttgggaggcccaggtagaaggatcacttgagcccaggaatttgagaccagcccgggcaacagagggagaccttgtctctacagaaatatcaaacagccaagtatggtggcacatgcctgtggtcccagctacttggggggtcaaggagattgaggctgcagaactacggacacatcactgtactccagattgtgtgacagaacaagaccctatctcagaaaaaaaaaaaaaagtagagcatatctatagagttgtagaaataaataaggtaaggtgtgttatatgcttataatagcacatgggacataggaaatcttcagtaaatgttagtcattattatcattaccattatttattggctatccagatattggagaaaactgaaatcgaccttaagactgatttgtgtaaagcacagtaagtattcagtgaatgtttattgggtaataaagacatgtcaagtgtatatggaggctttattgaatagattaccatttttcaaaaacaatgaaaggttttaaacagtttatttcagcacctcctcaatgaactggagctcaaagccttaccctagtgccctgtctggatgagtgacacatagccaaattatataataatgttaattatttgaggatattgtatataaacaaacatttagaagtcagtttgctgaccaagtacggaggcttatgcctgtaatcccagcactttgggagcccaggcgggtggatcacttgaggtcaggagtttgagacagcctggccaacatgttgaaaccccatctctactaaaaatacaaaaattagctgagtgtggtggcacgtgcctgtaatcccagctacttgggaggctgaggcaggagaatcgcgtcaacctgggaggtggaggttgcagtgagctgagattgtgccactgcattccagcctgggcgactgagcgagactgtctcaaaaaaaaaaaaaaaaagaaaaaagaaaaagtcggtttgtttaattgtagcttttgtcacctctaagatttaatcaggaaagtatttagtcaaaacttacactgctgagtagtttcattaggagatgcaaatatgactaagctattacacctggttcagggcttgtaagcattcactttcaaactactggacagtctagaaagcttcataagaaagatacaaagtactgactgggcacagtggctcacacctgtaatcccagcactttgggagggcaaggtgtgtggatcacgaggtcgagagattgagactatcctggccaacatggtgaaaccacatctttactaaaaatacaaaaatcagccgggcatgatagtgtatgcctgtagtcccagctacttgggaggctgaggcaggagaatctcttgaacccgggaggcagaggttgaagtgagccgagattgcgccactgcactccaatgtggtgacagagcaagactctgtctcaaaaaaaaaaaaaaaaaaaaagagagagatacaaagtactactgaaatctagaaaaggggaaagagcatctcttactgcagaatcagaagggaggacttcatgaaataaatggcatttatggagaactctaaaggatgactttgcttcctacttcgcagagcatttagggtaattggattctgctcagatgtattacttttccccaggcccagaaaagattttgtccccctgctattcaacattaatctattcaaccttgctttagatctggtccttcccatcttcctcagagccttgcatggaaggataatctcaacgggcacgatggtggcaacttatgatgaccttccttaagcctggaacatgttaactctcgaattaagaaaaatcagtcactattacagaccccgagaattccctacttagtagagcttaagtttaagtagagacaggcaataaacacaatacctaagtaaaaatccatagtactgtatattagaagataactaatgtggaaaaaataggacaaggtcaggaagatcagtagtgctggaagagtgcagtgttaaatagggtagtaagggtagatttcactgaaaaggtacatttgcgcaaggacttgactgaagcaagggagtgatccatccacatggctagatagagggaagaattttcaaaagagaaaagacagcgggtgggccgggcctggtggctcatgcctgtaatcccagcactttgggaggctgaggcgggcgtatcacaaggtcagtagattgagaccatcctggctaacacggtgaaaccccgtctctactaaaaatacaaaaaattagccgggcgtggtggcgggcgcctggaggttgaggcaggagaatggcgtgaacccaggaggcggagcttgcagtgagccgagatcacgccactgcactccagcctgggagacagagcgagactcgagactccgtctcaaaaaaaaaaaaaaaaaaaaaaaaacagcaaaaaacaacaacaaaaaaaacagctggtgaaaaaaccttggcaggagcatgtctggtgtaccggaggaaccacaaggaggctagagcatgatgagataagaggagagtggaggagaccagacgtagaatagccggggagaaagcgagccaggtaggggagggctttgtaggccatggcaaggcatttggtctgtaattcttttatgatttgtgcttttggtcttgatttcttccttatgaatcatagatgatgaggacttagaggaggaaaagaagaattgttaattatcctctttttaaaaacggaatttatagattttcataaagatgaaaatgttctatatgtaaatttttttgaatatttgtttttcttttttcagtttttagttttttgtgcaattaaaaaaatataatgtgagatagagaacctgatttttctcattttgttattttggttttttgggtttgttgttggttttttttttgtttttgttttttttttgtgtttttttttttttttttgataccaggctgcagtggtgtgatcttggctgactgcaacctctcctcccaggttcaagtgattctcatgcctcagcctcccaagtagctgggtctacaggtgtgcgccaccataccctgcctatttttctcattttgatcgccagttgtctgaccaacatttattaaataacttatcttttccccacctatttgtaataatactgccttaattttgtgtctgggctctttaatactgatttgttgatctgttcctgagctagtatgtcacagtttcaattagtaaaacttattataaatctttgatgtctagtagagcaaatgccttttcctttattattgtttcactattcttggtccttttctcttcagtaagaattttttgatcactttgtcaaggctcatattttaaaaatcctttgagatattgaatagaagtgtgttacatttatgaattgattatggaagaattgatatcttcatatagttcagtctccccatccgttttatttaaaccctcttttatgttaacaaaagtttttagaaaattctgcatagaggttttatcattagatttatttccaaagaccttaagtttttgtagtaagaatgaatgggctctgtttttattacattttaaattggttgttgctagtgtatagacatactattaactttgtaaattaatctcgtatgtaacaaacttgttaatgtctttctaagtggttttattgttttatcaatatgttgttttagatttttctaattaaatgactacaatcgtctgtaaaaaatgaagatttttgccttttctaatttttaactttatatttattacatcatcttacggcatcaacagtaacttctctgttaaaagggccatgacagctggacatggtggctcacacctgtaatcccagcactttgggaggcctaggcaggtggatcacaaggtcaggagtttgagaccagcctggccaatatggtgaaaccctgtctctactaaaaatacaaaaattagccaggcgtggtggcacacacctgtaattccagttactccagaggctgaggcagaagaattgcttgaacccaggaggcagaggttgcagtgagctgagattgcaccactgcactccagcctgggtgacagaataagactccgtctcaaaaaaaaaaaaaagtgggggggccatgacaataagcatccttatgttgttcctgattttaaagggaacatttttaagatttcactgttaaagattttgtgtgctttaggttcagattgatcatttatgttgggttaatagttaatagtctattctattctgttcaaattctaatttgccaagatttttaattattaaaactgcaattacttttgcaccaacctagtattaataggtatttaattttattaagtgttgtttgtatatctgttgatgaatttgtgatttttatcctgtaatatgtgaattatagtaatatttcttcttctttttttaaattagagatagggtctcgctgcattgcccaggctggtctcgaactcctgagctcatgcagtcctcctgccttggtctcccaaagtgctgtgattacaggaatgagacaacacaccaagccatatttcctctctttttaaagacgttttagagacatggttttgctatgttgatcagactggagtgcaatggctagtcacaggtgtgatcatagtgcactatagcactgaaatcctaggttcaagcgattttcctgccttggcatcccgagtagctaggactataggtgcacaccaccacagctggatgatgtttcttcttttaaaataatattttaaatagtaaaaatgaagctgttaaaaaatctgaaatgtaaatttgaacccctctaaagctactctttcatttcacttccctgtttcaaagaacagtaccattcagcctaaaatcttaggagctaatctaggcattgctcacagctgcttggtgaccagatcctgtcattttcaatattgtcgttgcctctctattctttctttgttgcctaattattctccatgtacctgcaagagcagaaaattcctttgattaaaatctttcagtgattccctaatctgtagccttcacaaatttgaactccttactgtgccctataaggcccttcaagatctggcccttccttctccagccttgcaggcccttcttgttgcactctacttcccactgattcgccagcaaatcagtcattccttggggcctttatttagcattcctctctttgtctagctgtctagcagttactcatttttccaggcccagccaagccttatctacctccataatatatgtcctaacttccagatagagtagaccgttgaatctttgtacatcctcctatgccatacaaaccttaatcttttgaaattgtgtatggtctttattcatttatgtatttatttcatctactagacttgtatctagtatcttgaagtttgtgactattttattcaccattgtattcctaacacagtgaaggtattcagttcacgtataatgatgaataaacaaaagaacaagcagacaggcaatgattgagataaaagagaaagggattattccaaaaggaaaataatgaaagcaaaagccttgttaactgttaatttcattatctacattgagtcctgggtggagccttagggaactcgggaaatgattctaatgattgtctactgattgagggaaaagattccctgacctgcaatcttttgcaaatttgttgcctttttttctctctttatgaagaagctttttctattttcctctctttggggattttctttcttttgaattcatttagtcagttaatatttattgattacttgctatataccaggctcagtgctagtgctgggaactagttagatagagcctgtctctaccctggagtatctctctggctggctggggtacaaacatgtaaacaaacaaatatagcagtgattttcaaatatctttcctaattgtcttgtcatgtttttccaccatgaaacccaccttgtaaagaagattggctgttatgttctcactcataggtgggaattgaacaatgataacacttggacacaggaaggggaacatcacacactggggcctgtcgtggggtggggctggggggagggatagcattaggagatatacctaatgtaaatgacgagttaatgggtgcagcacaccaacatggcaaatgtatacatatgtaacaaacctgaacactgtgcacatgtaccctagaacttaaaatacaataataataaaaaagaagattggctgtttattggggttttaacagttgtatttggcaaacaaaagaataactggaagtaactgagaataggatgctggaaggaaattgtctgagatgccactctcctggtttatttactactgtcttcctcactttcaactgtcagcattgaaggattgtattcctcagttaggtaaaaaatatgaccaatttatctgctttaattagttagaaattagaaatttaggggccagacacagtggctcatgcctgtaatcccagcactttgggaggccaagctgggaggatcacttgaggccagagtttgagaccagcctgggcaacataacgagatcctatctccagaagcaaattttaaaaatcagccaggtgtagtggcatgcgcctgtagtcccaactacgaggcagctgaggcaggattatggcttgagcccaagaggtcgaggctacagtgagctatgatcatatcactgcgctatattccagcctgggtgacagagggagacactgtctctacaaaaaataaataaataaataaataaataaataaataaataaataaataagaaatttaggaagtatattcatctctactgattttaaagcaaaatttaattttttttttttttttttttgagatagggtcttgctctgtctcccaggctggagtgcagtgatgcaatctcagctcactgcagcctcagcctcctgggctcaagtgatcctcccacctcagcctcctgagtacctgggactacagacaagtgccaccatgccagattttttttttttttttgtaaagacagagttttgccatgttgctctggctggtctcaaactcctgggctcatgcaatccactcaccttgtgctcccaaagtgttgggattacaggtgtgaactaccatggctggctgctaaaagtaatttctttaactcctttaaaaatttttattttatgtatttacttatgagatggggactcagtttgttgaccagactggccttgaactcctggcctctagcaatcctcctgcctcagcctctcaagtagctgggattacaagtgtatataccaccacacctagatcaaacttcttttttttttttttgagacaggatcttgctgtgttacccaggctggagtacagtgtcagatggcaggatcttggcttcctgggctcaagcagtcctcctacctcagtctctctggtagctgtgcctgcagtcacatgccaccatgcctggctaattttttattttttgtagagatagggtttcactgtgttctccaggctggtattaaactcctggactccagcaatcctcccaccttggccttccaaagtgctgggattataggcatgagccactgcgcccagcatacgaacccatttttaagttgtcaaacatacacaaaagtagagagaagagcaccgtgaacatccacgtagtcatcacccagcttcagtaaccttcagcctcatgcttttcttgttttatatctcccccatctttttttgcaagagtattaggtaaaaatttcagacatatcattttactcataaatatttaagtatatatcttaacacataaggactttaaaatcataaccataatattgatatcagacccactgaaattaatattctaatagtgggtgcatttttaaaattcaaatgaatatgaaacaaccagagtccaagtaaaggaacttataccatgttctaatttaccaagtaggggatagtttggcttttaaccccaaatgtagtgggatttttttttgttattttagccagaaacatttaaaaatcatcccatcattgtcccctcttttaaaacagagtaacaaagtaagcagagtgaatgctcttaatttataattttattttcagggtattttacaatatactgtgggtgatgggaatgaatatgtgtccagcaaaacttgatattttcttatatgatgaatatttcccattttatttaaaaggcaaagctgatgggatattctttgcattatattctgaaaataaaaatcagaatccctgctgctaatggtgagactgatattctaataccctagttctaagcctagctttgaatgctttgaataagggaagtcattccttatgacttccaatagataatgctttgtttcactgatcctctttcagggattttctttgtgaggcttttcaagctaaatagaagccagtacttctgagccaaattaaaccttgcttcagccctggaaagacttgcatgtttttttaaaaagagactagggaagaaacagttattgtcatatgttttactaggctatattagtcatctcagccacgtagttctattttgctctttgcctaaaggtattaaaaattttaattaatttgtaagctgtagccatctcaagttcagttataaaataaactgatggtactttagatgtgcatttaccacttgccatcggtcttctgtgcactaaagaaagcaaaagatgacttatattttataccagaggtctttgttaatatttcacctaaaaaaattaaatatattgccttttattacttcctgtttgaacctacaatcaagtggagaaataccatgtgaaagattgtacatgttggcttctctggtagaagacattgtttgccttccattttgtacctaggggtagatttttgaggcttgcctgcttaccattaaaataagatttaaattataaaatttctttagactgcttttttggttttttttttttttttttttttttgcctgtccagtgaagttttgagctatacttgctcaaaacactgactataccttgagctctgaatgatagataagcagttagatagtaaacagagtagaattggtaaattagaaaggacccagaggaatcatctggtacttttccttcatataggatgaaggaaaccgctccaggaagtgatccttttctctaaggttttcaaagagggatgtttattcatttatttaatacttctttgtttttttttttttaaaagaagaatgctgagcctgatgctgtgtttaactctctccttagtcaccctcagcctggaatagtttctcagtctttgacttttataatgttgatacttttgaagatgacaagctagttatttagtagaatgtttctccatttgagtttgtctggtggttccttaagattagatttaggatatgtatcatgagcaagaatattatagaagtgatgctgtttttctcatcccattcattctatcagatggagtatgattttaatttgtctcattggctggtgatgcttactctgatcatttgaccaaggtgatttctgcaaggttctttatgtaaagttgctctattccccttcctgacaaataagaattttgtggcgaagtactttgaaattatataaatatccaattcctaataaaactttcaatttatttcatttatatatagaatcatgatttcctgtttattcagtattatatcttattctaccattatttattttaatgctgaaattatcccctacttggccactgggagctccttcaggatggcttttgtgtccttttgacatgtttccattattcttcaagcgtaacttgcttttggaaaagcaagatattccaggctctttttgtactttgctggcactagccctagaatcaggtatttctccaagtagccctggttctttttggtagacactgatatatagcaaccaagatctgtgcagtagatttgctcattgtttctggatatgtattgttgcttctatatcttctcagcagacagaactagggactaaacacacacacacttacatacatacatgcatacatacatacatacatacatttatacatacatacatacatacatacaaacatacatacatttatatgcatttgcacctgtatttcttcaaccccacagagctcattctagtttttcatctttctggatcctgaacttcctgataaatcccccagtatttgccaagtagccacctctttaattgtgtggttaccctcttcaccctgttaaaatgctgcatgccagattgcacccttccatggatgcctttctgacattctgcttgggctccaacacatctgtgtcaggctgccactcttcataaatgcccttattacgatgcttgggccaggtctccccaagcacatgaaaaactgcactgttttcgtgggtttggataccaaagaaaattgaatgactgaaaagtactgaagagtttaccttaaagggaggaaactagagcagaagttctccaaatgtgatctctagactcagaacatcagcaccccctgggaacttcttggaaatgcagattcttaggctccatctcagatctgaatcagaaactctggttatggggcccagcaatttgtgctttaacaagctttctagggaattctggcacatactagtgtttgagaccctctatccaaaggagagatagagtctcaacttagtattctatcctgcatctaggttatctctggcataatgaagactccctggttgtcaaggtcttggtacaattttttagggctttggagccatcctagaaatgaagtcctcccatatggatcaagactggaataattatccagttcaacccaccatccgtggaaaacccaatcctctagggaaaatcaaggaattatactcgaattaaactgtgctttgtctttttggtatagaaacattttaattaaagccttacagttaataaatatttaaaggaaggaccagaaattagtatcaaagaaataaaagttttgcagttttcatttttgtttttttgttgttgttgttgttattttgagatggagtctcactctgttgcccaggctggagtacaatggcacaatctcagctcactgcaacctccacctcctgggttcaagcaattctcctgcctcagcctcccaagtagctggggttacaggcatgcaccaccacacccagctaattttgtatttttagtagagacggggtttcaccatgtaggtcaggctggtctcgaactcctgacctcaggtgatccacctgcctcggcctcccaggtgctgggattacaggcatgagccaccacgcccggccgaaagttgtacagtttttacttattttaagctcacatctgatgtaagaatgtacagttaatgaactgttactctcccgtactggctgtgttttctacagtatcaaaaatatacttcaaggccaggcatggtggctcgcgtgtgtaatcccagcactttgggaggctgaggcaggtggatcagttgcttgagcccaggagtttgagaccagttgggcagcacagcaaaacctcatctccccaaaaaaatacaaaaaatagctgctagtggtggcatgcacctgtggtcccagctactcaggagggtaagatggtagaatggcttgagcccaggaggtcatgccttcagtaaactgagataataccactgcacgccagcctaggcaccagagtgataccctatctcattcatatatgtgtgtgtgtatgtgtgtgtatacacatatatatgcttcacaaattttacttatatatagacatagaggcttacatttcaggtaaataagataggctccgtataaagcaatttgagaataagaaagttttatctctttttcttgagtggcatgaaaagataaacaaaatactttatttacagtagagaacacagcatattcaaattcagtattgtgaccttcacctcaactggattagccaggtagtatgttacttgcttagattcctgggtcagatgtgtcctgtatcctttagcttttctgtcagcaaaaagggataattaggacacagaacctgaattttaaaatggtttcagtttaaattaaagattcccttgaattaaagctgattcccttcttaaaggtgattgatatttatgatttttcattgtctttgttctcaaggagacttttattgtcttactgcaaaatttttgtaaatatctttgagttctgttttttctgagtttatgtgattaaggttttgagaatatctagatatagtacttctgactttttccagacaagaaacaagacatataaacatatacccactcacatttacaaagcctaggagatgaagtttcacgtaatatggactttggcttaattttgtctcgttcttataaataatcctttgaaaatgtgtctcagaaaatcattaacactgaaaaaggaaatatgaaagacttagaattctgaaaattataacatagtagactttttaatttattatcatttgtgatttcaacatttttgtgggattaccttaagagccatgacactgtaacactttgtaattttgtaaaagtcctgattgtcaatatatgcccagtgagggttggtaaagaataaatcttggccaggcacagtggctcacgcctgtaatcccagcactttgggaggccgaggcgggcggatcacctgagatcaggagttcgagatcagcctgggcaacacagtgaaaccccgtctctactaaaaataaaaaattagctgagcgtggtggcacatgcctgtaatcccagctactcagaaggctgaggcaggagaatcgcttgaacctggaaggcagaggaggtggtgagccaagattgcaccattgcactccagcctggacaacaagagtaaacctccatctcaccaaaaaaaaaaaaaaaaaaaaaaaaagagtaagtcttgataagcacacttgtttttgcagtatgtagatttaaatttaactttgtttctgggtagaaaatatatccagaaaaaaagccaaccactagtgctgatattagaattgatgagaacacaaagtccaaggacatgatgatatttaccaaggaaagagcagcttctgctgggtgtagtagctcacgctggtaatctcacaactttgaaaggctgaggtaagagaatcacttgattctcttagtagttcgagaccagcctgggcaatgtggcaagacctggtctctactaaaaataagaaaattagctgggagtgctggcatagacctgtggtgccagctacacagaaggctgaggcaggcagattgcttgagcccaggaattcaagaccagcctgggcaacatggcgaaaccctgtctccacaaaaaatacaaaaattagcttggtatggtggcacatgtctgtagtcccagctcctgtggtgggaggatcacctgagcctgggaggtcaaggctgcagtgagccatgagcatgtcactgtagcactccagcctgggcaacagagcaagaccctttctcaaaaaataaataaatacattgaagcattctttgaattggcagatatatgttttgaacctaaatgactggacaccttatagagacaacaaagtgctccctaacactaacttaatcaagatgttagccagtaaatatttgcttatgaaaagatgaaactttactaagaattagaaagtagcagagcttattactttgatcccatgtttatataaatcactttctttttttaattattaatttgcattttatagcttcaattatataattacatgttacactataagtgacatttgaaaaaattgtcttaggacaactgtcatatacatcaaggtctgtagtgagaatgaggaaggaccataatttttataagattaattttttttttttttttttttttttgtgagatggagccttgctctgttgcccaggctggagtgcagtggtatgatctcggctcactgcaacctccacctctgagttcaagcgattcttctgcctcagcctcctgagcagctgtgactacaggctcctgccaccacgcccgggtaatttttgtatttttagtagagatagggtttcaccgtgttggccaggctggcctcaaactcctgacctcaggtgatctacccgcttcggcctcccaaagtgctgggattacaggcgtgagctaccaagcccagccaagattaatttttttttctttttgagacagagttttgctcttgttgcccaggctggagtgcaatggtgtgatctcgactcactgcaacctctgcctccctggttcaggcaatttccttgcctcagcctcacaagtagctgggataataggtgcccgccaccacaccccgctgatttttttcatttttagtagagatggggtttcaccatgttggccaggctggtctcaaactcctaacctcaggcgatccacctgcctcggcctcccaaagtgctgggattacaggcatgagccaccgcatccagcccaagattaatttttaaatagcaatacttcattaaatatatatatatatatcttgcagttagaaactgtcataaatgtattacagtgcttggtgctggtttgttttgttttgttgtttgtttgtttgtttgagatggagtcttgctttatcacccaggctggagtgcagtggcacgatctcagctccctgcaaccttcacctcccgggttcaagtgattctcctgcctcagcctcccaagtagctgggattacaggcgcccgccaccaagcccagctaatttttttttctttcttttttttgtattttagtagagatggggtttcatcatgttggtcaggctggtctcaaactcctgacctcgtgatctgcccgcctcagcctcccaaagtgctaggattacaggcatgagccaccgtgcctgtcacatttcaggttattaatgagtatatttcccttgagctaaaagcatataacacagatttccatctataaataattttacatatgtattccaaagcccttggatgtagaggggaaatgggtaatatttagcaaattccagcctgtccttttcaattactaaagaaatacaggtatacctcactacttgaattcaggtgatttggatagcaatactgtatgtctgtagatttctctgctaaggcttatgtctagattttaccacattcaccaggcttagtgttcccaccctgtgggtagctgacatcttcacatagtttcttgtaataaaatataattaaatagtgtttaaatgttaaattagattcttcctccctctctttccctttctccatccatcctcagtttaattagttacccagtactttttccacacccaccatttggaggaagtttgtgacagagtgagttgatgagggtacttttgatttcactgtgtttcctattgcagtcattctctgaaaaatgatcaaagacattggaattatgaaagacagcaacagactcggcttcagaagatcccattgagtgtttttccttgcgctagttatatagtcagtttcccccttgtaaattattacagtgggggatttattagggaaaacatcatttaaaaattttaacggccgtgataaactgtcatttgcagttctcagctgacagtcaaacagctgcaatctgttagtgagcttttactttcagctgccagaggtctttcaactcctgttcccctggaaatgaggagggctgggctggacgcatagaagggaagtgagggttgaaatacacattttcccataccatatttttcatgcctccccacagtttccatagaaatgggaacataaataacaccccaccccagactttgaagagcaatcgtttatgtgtaaactgcagtagatggaccttaaagaggcacacaaaataagctaatcttagggtctttcctttacttgtgtttggccaagcctaatttcagatagattctcatttgatttactctgtacttaaaaaatgattcgatttttttaaatcaatttttagaaagtttgatattacctttttttctgaaatgagaattatcttgaacatactttgattgataggtatatatctgttgtttatgtgttaaaaatctagcaagcttggtgttctaactttcctctcatgtttgttctatccaagattaaagaaatgaattttgggccaggtgtagtggctcatgcctgtaatcccagcactttgggagactgaggcaggcaaatcacttcagatgaggaatttgagaccagcctggccaacatggcgaaaccccgtctctactaaaaaagtacaaaaattagctgggtgtggtggtgcgtgcctgttaccatctacttgggaggctgaggcagaagaattgcttgaacccaagaagcggaggttgcagtaagctgagattgcgccagcctgggtgatacagcgagactctgtctcacaaaaaaaaaaaaaaagaaaaaaagaaatgagttttgatttagggaatgctccaattgcatagtataaaaggtcttctcaaatagtcttattcttatgcattattttagaaattgccccacagaacagaggtaattattggctctgtcaaacatatcagagaaaacttccaaatttaattggttatcacaattttctcatttaggtaacaagaatatcctatgttaaatgcatttctatgtttttccacttatcagctctgtgtcatcacatatttcctgtaacacccgtacttgaggaaaatgtatgggcatagtctttatctgtttcttttattccaacatttaactaattaacaaattccatttgaatcatgagacagtaagaatatgtgtaattgagtaaatctgctttaggcatctactaagtattcagctttatgttaggttgcagtagataccaactgtaagtaaggcagaattttttccttaaggcatcccaatggagtttggaaaattcataccccaggaatagctcataacagccatatgtgattattacatgagtgacatagactgattcccatgactaggaaaacttgtttcctttccctttctactgtcacctttttcacaaagtccctttctcctgatttattttcataacttcctaaatgtcctttcaattgctacctttctccttttgtttgtttgtttgtttcttttttttttttttctgagacaggatcctgctctgtcacccaggctggaatgcagttgcacgatcaatcatagctcactgcaacctcaaacttatgggcttaagggattcttctgcctcagcctctggagtagctgggactacaggcacataccactgaccatgcctggctaatttttttttaaaattttttgtagagatggggtctcgctttgttgcccaggctggtcttgaactcttgagctcaagtgatcctttcatctcagcctcccaaaatactagaatcacaagcgtgagccactgcacctaaccctttcttcttttctttatcttcccttctactttagcatatacatgatttccagattcatatttgtaaaaccagtcttgatccttttactattttaaaacctcagtgatctcttcacatcattgtgacaagatttttcttttaaaagacagttctaacgtcagatattctgcctcataagcctggctaccaaaacaatccaaaaacttttattattttaggttctttcatattccaaattgcttctcatatccagaatggatgcaaacatctgttaagaccatctgcctggtttttatttcagaaaatatggtcactgagctagcaactaccaaaataggttcatgctttcagcgattggcagcaacctagacagtcttcattctggcttcagtgtattccttccggcctgctctgcaggtaccttatgccaggtcatctagctcctcacccaaacagaactgcttagcacattcagtaggcccacattttgtagctccatgcctttgcttacagaagtttcctttaggtatgaggaaagatagaagcaataacaagttgttccttccatctggaacttcttgtccctccctatacccctctcatagccctatcctactgtaatacaatctgtaatttacattaaaacaccccagtctacacagcgtgttagttagtctacaccttggatgtgagtgattaacatttgaaacactgataagggaatacatagtgtaagggtagttgtttggcattggaaataccctaatgaggagataactactgtaaatttaacctgcttatctttaaatctacaccagagagttttctagttagcataaaggatgtcagaaataatttcaaattggattgattagaaataccatacaggttcctctggcacatgaattgctcataagattctggcaagccaggtagcctaatgcctgcacagtgtcacccgaggcagagcactgttcgggcctgttgactatcacctaacagaagatgcttcctacctggtagaaaggtagtgaggagacctatggccatgcctgtcttcagtctttggaggcactgatatataccctcctcctcccccaccaaaacgaaacaaaacaaaacaaaacaaaacaaaacaaaaccctgacacttcggaatggtcaatagcaaaacctccctccaggacgatgcttacatgctatctcttccttaaagtctatcctaaatttcctgatggatttgtgaactcattctcctctacaccatcatagaatgaggcttatatttctgttatggcattaataaaattttaaaatttattgtaagtttcttgatgaaaggactgtgtcataactttctttgtatcccacatagcatgtggcatagtgtcttgtacacagtagatatttattataatgagcacatgcatgtacttaccaattctgtaaggaacagatccagctttgggtcatagggacactgggagccaatgtgtgagttcttagagttccattaattcactgttcatagttctaagggagtcaggagtaattgtccataactacatggctctagttagccattagtgcaaagacacactgggactgatgtcaacagcagaggaaagtagtgctgtctatgttgtcttctttcagaaactcatacctaaatgtatttcatactgctgttcggccaaatctggctctagataataaagaaggacaaatatttagggcagttatttctcttgttctatatttcctagccaatttgaagcagtatatataactaaccaagtacaccaggagaaaagtaaaggaggtgcaattatagcacacagatttaaaaaacaaagcaaaataaaacatttaatgttagtaagatgatagtatagtataatagttcaaagcaaggatattaaacccagactgcctgggttcaaattaatccccactttactagctgtgtggccttgggcaagctatttaacctttctgtgcctttgttcttcttctgtaaaatgaagatgatagaacagcacctacttcagagatgtgaggctaaaatgaattcatacatgtaaagcatatagcactcagtgcctggcacataggaagtgctggatgtgtttgctgttcctgcagtgatatggttaaatcatagctccaaaggcagaagtatgctaatttcagtcagtgtgcagtccttctgtctgtgtgctttgcagttctccgcctccaactgagtaatcttaatgccttgaagcccccaaatattggtgcttatacctttcttgtggaacctgtcacattctaccctaaattatataattatttgtaagctccttaaaagcagaaactatcttctttgtcttcctctcagcacccagcagaatgattacataacagccttgcttacacaatagctctttgctaactatttggggaaactatgaacctctgtgaggttggtccctggaggccctgcaccttggactggttcctgtgtacctctcgtactcttcagctagcaatccctctcctcactgtgctccagcaactggccttaagtcccttaaacatgcatccttttccaaaactggcttgatgtgtgtgtgacctgtgcagtcacataggtcctcatacttggttgaatgctctatcactagcttgaaattcttagtttttgtgttcaatttttatcttgcactgagcctgcaaattatgtagccggtcttgctcttggtcatcctgtgctcattgttccctgtgcctggaacaccctttctccctaatcctcactggctaacctactcttcaaggctcagcttcattgtcattcctcagagaagcaataaaaattagagccatgtattagtatccctccacattttcttctccctcagagcacttaacttactttgtaaatacagtatttatttatattgtgattatttcttttaagactttatcccaggctgggtgcggtggctcatgcctgtaatcccagcactttgggaggctgaggtaggcggatcacgaggtcaggagttcgagaccagcctggccaacatggtgaaacctggtctctactaaaaatacaaaattagccagatgtggtggcgggcacctgtaatcccagctgctcaggaggctgagacaggagaaacccttgaacccaggaggtggaggttgcagtgagccgagatcacgccactgcactccagccggcgcgacagtgcgagactccatctcaaaaaaaaagactttctccccaccagactgtaaactcctccaggggatagactgtgcctttgttccaggacggctttacctgctacatagtaaatagtaaataaatatttgttgagtgagtgaatgaataaatcatttttagaaatgccaagttgtggccagatgcaatggctcacgcctataatcccagcactatggaaggcttaggtgggcggatcacttggggtcaagagttcaagaccagcctggccaacatggcgaaaccctgtctctactaaaagtataaaaaaattagccaggtgtggtggtgtgcacctgtaatcctagctacttactcgggaggctgaggccggagaatcgcttgaacccaggaggtggagcttgcagtgagccaagattactccactgcattccagcctgggcaacagaacaagactgtctcaaaaaaaaaaaaaaaaaaaaagcaaagttgtatggataagcttttcttcccaagctaaaaagttgatgtataaaaatagcaattcaaggccaggtgtagtggcttacacctgtaatgccagcactttgggaggccaaagtgtacagatcacttgagcccaggagttcaagaccagctggggcaacacagtgaaaccccacctctacaaagaaatcagccaggcttggtgacttacacctgtggtcccaactactcaggaggctgaggtgagaggatttcttgagcctggaaagtcaaggctgaagtgagctgtgattgcaccactgcactccagcctgagcaacagagtgagaccctgtctcaaaaaattaaaaaaaaaaaaaaaaaaaagtcagtgcaatcttcatgcaatttaatattgctagtgatgacttttaaccagttctacttactgtctttatagatggatgaatacagtaaaattccccatttttcttttccactgtttgttcttctcatataatctggtatagtaaagttgaatctctctaaagtcagatttactcaggttgtcttatacattagtttcaaattaaatttcttagagcataaatgtctacagccttctgtctcttgtatttttagcaagcgacatgtatttacttttgatctaattgccagcgacaattgacataaaagtaatgcttcaggtttcttagcattttatggtggaaaggccagtactatgataatgaagttaacacttgataataatagagaacagtgtcctacttggttttcccatcattctttctctcctctcttattgtctgtgttcaaatagtttaattaactcactctgaatgcacagctgtatcagctttctgtggtccaattttggaactatatctgtttattctactccctggaatcacaccaatacaattcaacatgtaaccagatttaatgcttgccatcttactgtctcaatttttagtgcttggtagtcattccattactctccaaatactgtactaaaatttttaagtgataaatttctaaccaaaaacttatttacaaatggatttctacttgagatttacaatggattttgagcacctcccccaaaagaaataaaaaacatccaacatggtatactaacttgatattattgcttcttaatttttgcaaagaggaaaagaatcagaatttgcataatttagccccacattgagaataatcaatacagtgagagaagaatttttattgcttaaaagaaaaacaggctaaatgtcctttttttttttccttcaagtgtaaggaatctgagaaaaacagattttaaaaccaatagaaggaatggttatgatccagcagcaactgctgcatgtgggtgaagaaaagaacccagcattatttgtacaaatccataagggatgcagtgggaacagaaagaaacaaggaagtataggaaatagagaagaagggcactcagtgaagatgtaggcctcaaaaaatgttccatctaagcactgactgattccagtaccttaaggtgatctgctttaagctataaatcttctgagtggtttatgctctcaatgcttttttttcagaaggctgtgagaggaggaaaaatatattattttcagtctgccccctcttaagactttatggaattttaagcaggcttctcctagagttaaattcctgattcaaccaccccagagtctatttggctatctgtctctctctctctctcttttttttttttcctagcttgcccagaaagattaaagtaaaggtattctttctttttcttttttctttttaatctcctacgttatgcctggtaatgtggcagatatcttaggttcattacctctcagttatgcattaacagcacctccatccttgagctgattagctcagttaactgctgcaggctactgacgaggcttatcaaaggtcctaggtttgagagctatgcatgttggctagatgacaggcaatgtagatgatagtcatgtaacatagtgtatgactaaggctttaactttggtgtcaaaaagaccttttgggtagctgggtgcaggggcatgttcctgtagtcccagctacttgggaggttgagtcaggaggacttcttgagcccaggagttcatagccagcctggcaacatagtgagacccaatctcttaaaacaaaagcctatagggtctgtcattattatagggcctgtgtgtgttacttagtctttcttggtttactcaatttataaaacggatatagtaacacccagtttctttgtgaggcttaagaaatataaaaaatgctaaatgatggctgggcactgtggctcacgcctgtcatcctagcactttgagaggccgaggcaggtggatcacctgaggtcaggagtttgagaccagcctagccaacatggtaaaaccccatctctactaaaaatacaaaaattagccaagtgtggtggcaggcgcttgtaatcccagttactcgggaggctgaggcaggagaatcgcttgaactcagtgggcagaggttgcagtgagccgagatcatgccacttcactccagcctgggcaaaagagcgagactccatctcaaaaaaaaaaaaaaaaaatatatatatatatatatatatatgtgtgtgtgtgtgtgtgtgtgtgtgtgtgtgtgtgtgtgtatatatatgtatatatatatgtatgtatgtgttcagtgcttaggtcagtgctgcagcatgcattttgtgctcaattaaaggagatggtcatcgtagttgtttgtgttaccctattacaaaacataaacaattcaagttctgagtaagaggtttaagtaaattgctcataaaattatatagctagtatttggcagagaaagttttcaaatgcaagcgtgtttaatttttttctttttttttttttcagacagtttcactgagctaatttttgtatttttagtagagacagggtttcaccatgttgatcaggctggtctcaaactctcaaactcctgacctcaggtgatccacctgcctcagcctcccaaagtgctgggattatgggattacaggcgtgagctaccatgcccagccaagcctgtttaatttctttctttctttcgtttttttgttgagatggagtttcgctcctgtcacccaggctggagtacaatgccgcgatcttggctcactgcagcctcagcctcctgggttcaagcgattctcctgcctcagcctcccgagtagctgggattataggcatgagccactgtgcctggctaatgtttttgtatttttagtagagatggggttccaccatgttggccaggctggtctcaaactcccgacctcaggtgacctacttgcctcagcttcccaaagtgctgggattacaggtgtaagccaccgcacccagccagcctgtttaatttctaaaccacctcaaataaagtatcaaagagaaactgctgttcaaataattgtgctcgaagaatatggtttttctcttctttaaaacttgattttattcttatatccaagctgcttatataaatagattcttgaaatattttgggacactaaaatagtccttcctgatcttacaaatttcttctctcctaaaatttatgtataaattggttgtttgaaactcagaatggatattcccttaggaagtggtggttgtgttctcaggccaattcataaaagcttctctagcctgtctcttctccctttctagtgcttaatgtttagttcagtggttttcagatggacagtatatcaaaactgcctgagtagctttgtaaagataaaggtacttgaacaaaaaaaaaatgagaaagaatgagtaagacctcgtgtatgatagcgcagcaggatgactatagtcaataataattaattgtacatttaaaaataactaaaagagtataattgggctgggtgcagtggctcacatctgtaatcccagcactttgggaggctgaggaggtcagatcacttgagcccagggtttcaagaccagcctggtcaacatagcgagaccctgtctttacaaaaaatacaaaaaattagccaggtatggtggcgggtgcttgtagtcccagctacaggctaagaggtgggactatcacttgagcccaggaggtcgaggctacagtgagcggcactgcacttcagccgcagccacagagcgagaccctgcctcaaaaaaaaaaaaaaaaaaaaaaaggagtgtaactggcttctttgtaacacaaaggatcaatgcttgaggggatcgctaccccattttacctgatttgattatgacacattacatgccagtttcaaactatctcttgtaccccatatatagattaaattactatgtatccacaaatattaagattaaaaaaaagataaaggtgactgatcatacctcagatcttctgaatcagaattttagggtgaatgtgctcgatccatcccagcagaagcctgaggcaggggaggcatgatgtagtaaaggtactagaagaagtcctgtgtggctggagcagagaccggttgtctttaaactcttgattgtgatccttgtgaatgaaagtcatatgagccgataccaccaatatatgtatattcatttttaaataaattagccacctgtactacaataagcacaaatattttttaaaagatgaaataaaaatagtccttcctgactattttcatattctaaaaacagaacatgaaattctaataatcaccttttgctttctgtacctatttggatagttttatgtactttctgggatggacaaaccacacttttgcaaaatataggcaaagagagtgaagggaaggtagatagagactagattctgtaggaccagcagagccaagtatttctctatcctaagtgcaataggaagcaattggaaaatgttaggaaggaaaatgatgtcagatttgcatcctggaaaaaattactttggctgcccaatagcaaaaagatttagtacagcaactatgaacatggggagtccactttggaatttatggcactagttctgatgaaaggtgattatgccttgaattgggcattgccagtgaagtttaaaagaaaaacaagatagatatttttgaggcgtacagtatagaatctagtgatggattgcctgagcattggttgggggagcagacaatggtgacttgtgggtttctggcttgagcttctggatggaagatgaacagtgggagaagaacaaattgggggtagaaggtggggtattagtccaggtttaaatatcttgaatgttaaccatccaaatgatgataggaagttcacaattggatatgcaggctaagcttagtagaagttctgggcagaaaactataaatttaggagttgtcaacacatagtacagaaattcctctacctccagatattatttattgataggaaatatctaaagcagaagtgccaaggagttccacaaaaatattatacaagattagacttacaggactgaagatgaggaattaaaaatgaacaggtaagcagattctataaaatgcaagtctcccaaaattgctacagcattgggaccacagcttatactagaatgtggcaaataaagtacaaatcagtatttcagaagctctcaaagatactttgatgagcatgctacattctggagtaagccacaaacattggaaagtggctcatgtcatataagtattcatgaataaaggtccaggtacatgtcacaagtgtgcacaccactaggattgagtaattgggaaagctagacatgtcagatgagattaaaacaagtacagcaccatagattgtatgttagtatgaattcaggaggagaatgcctgggaatttgatgtctgtaagaagccttggaaattatgttagagttgcaagagagaagtatgtcctttgtccccacccccttaaaccattatgttccttaagtattagaatacaactaataatcatttacaggctctaacattctctgaaggtttcctcctgcacccaagacacatggggcaaaatatcattgtttaatatgttccctctcctcctagtgctaaaagcttaaaaggagtcaaagtgacttcttttgctgaccactatgaagaggattaagtgaagcctatagggcgtgttcctcctcttgatggatgccttctcctgattccttttcatctgtttcttctcgagtgcattatactactgcaaactgttagaattttggttgccactgatccactttatgtccagatcttgataagtccttgcaaaaataactgtgactctgacttggaaactctcagtaacccccaaatttccaaggaaagtgatactatattacatttctattttttctctgtccattgattaatatattaaatgagataatttatattcatcctaagaaactgtctgaagtgagcaagagtagcacataatggctagcacctttggcctattaattttctaggcacctgaactgagcaccaggaatcttcacttctgaaaatgttaacttgggtcatatcagcctttaaaaaagaaaaacacagtgatgtactttaccagtatttgcatccataaattaatatttttgtatctttcatttctgaattacagaagcagattcatcaaaccctgaatgatagctcttacaagtgactggcccaatgttaaaactgagcacaggagaaatgctctgtgttttaactgggcaaggaagcttgcataaaccagtcatcatgaaaatcctcctcactgaggtgcttctccctctccaaccctctgtcccacaaatttcttcttgatcatctttgtaccttttataaatatctgttattgcgcttatgaaactagatgataactagacacatatttggcactacgtctagactgtcagcttcttgagcagctttactttaatcatctggtcccaggcagtagagcaaagtggttaaagagggcaggctctggaggccaactggatttcatttctgtatgatcttgggcaagttacctatcctcaacttatttgtaaaatccaaataatacttccctcatggagttgctggcaggattaaatatagatttttctaaattaataggcttaaaactgttaggaaattttttgacttgaaggaattacatacttagtggcaattactgctaaccaataacaaagcagagggaagtggacatctgaatacatcaatgcagtgctaaaaaccttgcacactggtccaggcctctcttcttgtctttattgatagtttagctcagaggcttttagtatgaatcccacatcttctcaagcatgtacccctcaaacctaccagcccccaacatccacacctggtttagaaaggtttgtaggcatcctgtttgtcacagtgacaggcagccgctactgacatttaataggtgaaatcataaatgggcccagggatgccatgggctcagaaatggagagcggagtctacaccaaaaattattccacccaaaatgccaataatatcttaccttgagaaacactggtagtgcccagggtcttttctctactaaaatgcaaaaccaacttttcacaaaattaatatactatttcataaagtcagaatatgccaaagatcatgccatatatattacagagcatagatcaacttgaaaaatctttacgtatgtattctgttatttctcttttctgtgtgtaagttcttttcaagttactacagtgagtttcaaatttgttatttaagagttctattattctgttcattatgatccgaagtttaagatctgcggtgttgaaaagcactcctaaatatacaaagcccttgaactcctaaataaacaaagcccttgaactcctaaatgtacaaagatcttgtttgggccaggcctggtggctcacacctgtaatcccagcactttgggaggctgaggtgggaagattgcttgagccttggattttgagaccagcctgggcaacatagtgagaccctggctctaccaaaaaaaaaaaaaaaaaaaaaaaaagctaggcatggtggtgtgcccctatagtcccagctactcaggaagctaaggtgggaggatcacctgagtccaggaatttggggctgcagtgtgctgtgattgcgccactgcactccagcctgagcaacagaacaagaccctgtctcttaaaaaaaaaaatgatgattgagtttgataatcaggaaacttaaccaaatcttatatgtaagcaaataaatatgtttttatttgtttgttttattttgagacagggtctcactctgtcacctaggctggagtgcagtggcatgattttacctcattgcaacccagcctcccaggctcaggtgatcctcccacctcagcctcccaagtagctgggtctacaggcatgtgccacgatgctcagctaatttttgtatgttttgtaaacacaggttttcaccattttgtccaggctggtcttgaactcctgaactcaagtgatccacccaccttgacttcccacagggctgggattataggcatgagccaccacacctggccaaaataagttttattagaaataactcactttgggaggctgaggagggcagatcacttgaggttaggagttcaagagcagcctggccaacatggggaaactccatctcaaataaaatacaaaaattagctaggcatgggtggcatgcaaaaaaaaaaaaaaaaagaactaatgcatgtgaaattcaaatattagtaagtattcaaaataagatatgaaagtaagaatacaaaatagggtgatatcactggttgatatgattagtgagatgaacattattaaggcaaattcttccgataattattgttatacaacatgattaatatatattcagtctgaaagagtcatatatacaaatatgaaataaacacctcaaatgagaagaagagagaaaacatggagaatgaagaaagttgggtgtattcttttcagtcttcccctcccatatctccgtctgaggccagcatggctaatattgagaaagagtaaggcaaatgagtaattattgtgctctgtcttttactgttattgaaggtcactgtttaacactccctcgccattcccctaaccactcccctttgccttaaattcattaagctgtattctttgtatttcctgataacagctgacaaggacccactctcatctgtaatgacaggtgagggtattgatgataagtagagttaataaagcttctccagtgatttagaattataacgctctgagtattatcatcaggggaatagatgaaaaagcccatttcattttgtgcagtgtccttcaaactgctggttatgaaatcattttagagggtctgtgaaatcactgtggaatacgatgaaacgtaatagaaagtatcagcagacactgtgggagatcggtcagagcggtggggaaaaactatagggaaaggacgcaaaccttctgaaaggtcagaaggttctgcagagccccaggggagaatagctgaaggcagctgttctgtaaccctgaggcattgggcaaggagtaggtacaaggcagtgtaggggaatttatcttaaacaaacttgtttacttatgttgaccaggaactgacctttgatcatccgtggggacggtccccctgaaaggggaacaataaatgttaattacctaagaggtttttaaatttctttctccagaaagaaaaatttcaagcgtctgaatcccattcagtattctctaaaataaaatcaagtttgtcctgaaagatggtttaaaaactgaaaatctattttctttgattacctcataaataacaagagtttcatatcagctctcctgtctcttcctcctccactcttttcccctctttcacattgtgccaatcacacaggtggatgctcagtatcaccccacagcacaagataaataagcttggaaggtttcctagcaacatattgttctgggaacctgctctgtttccctgaacaagatgaagccaaatatcctagaatctcagccagatgggaaaggattagcttattgagagtgttattgccttttttaaaaaaatgtttcactttgaaatgaacctcttaatataagtagcaaaagtgacttttaaaaggacatgtaaaaatatccctttaaaaggacatttttttctcttacatgtaaaaaaaaattgataatagtttgaagtttaaaaatatggtttcagaattctctaggcacaagcttccagtatgtaattcagtcactggtgagtggatccattttagaaccatgtagaaaatacttccacatggaactaattctcagcctggtgtccagtggtatggtattcctgctgtaaaaatactgaaatacttccgatctggtgggaaaatggctcctggagtaggctctctcctcacaatacctttagctgctccccttggcccttgtttctgctcctagggaaacattggagacaccttgttactgcttaaaaccctgaagcttcccctttttctatagctccagggctattttagtgctagtgatttgcaacttcatcttcagagtctatttttggttttctcagtgtatgattaatgtatatagagaaaataaaagaaattgagactgctatcaaagccaagaaaaataatgttgtcgttttgttaacacatgattgtgtatatttcccttgtttatctaatgatctgtgaggctacacagttggcaggtggtgctttcctttctattgcactctagttggtcacagtatacttgttagaggtctctggagatggagtaataaaggattcgtgtttctcataacaatattcagcagtggctttgcaattcagttacaccctggaaaatgtcctcactccttgtttggctggggagacattcccccatcagccagatgaatattctcataatgtggttgttgactggtttctatcatctatcaggtttggactgagtttgtgaaacttcccaattgtggtgagaagcagataattctagtacttcatagtgttcctggataagaagaacaaagtaattagaataagatggggaatgacacctggagtctttgttttttatgtaacaaattatctggccagatgccagagaattagtactgtcctcattttaatgaaaataaggaaattgtgagataattttatattcatgctagatgctttccattctcttttgctctctcactcatatgtatatgttttctaaataccatattttaaactcaacaaggaacaatctgttgagggcctagtatgagccaaatactgctaggtattatggcagatactgagggcaacacatcatccttgccttctcagagtacgcaagaagtttgcaacatagcacgtttgtaatcttaaaccaaacaaaaacattaaggaaaggtgttgctgtgtaaaggaatcataggctaggcacagtggctcaggcctgtaatcccaatgctttgggaggctgaggaaggaggatcgcttcagcccaggagtttgagaccagcctaggcaacatagccagaccccatctctacaaaagttaaaataaaataatataagtaagggaattctataactttgattgtccaaagaaaggctaaaagtagatttaatatgtattatggaacagaataagttctaatacgttaattttgattgaatacttattttaaaaaaaattttaaaaatgtccataaaccaggcattgttttagatacctctctgttaactcatttaattctcctgacaccattatgaggtagaaattttgtttacctgctattttatagatgaagaaactgaggctaagagagtttttttgtttgtttgttttaaaagacagggtctcattctgttgcccaggctggagtaagtggccgtcatagtgcactgcagcctggaacttgtgcgctcaagcaattcttctgtctcaacctccaagtagctgggactatagatgtgcaccactgtcccctaagagaggttaaatatctgtttactgagggcttttatactacgctgtgcttatttgtttatttttaaaattctaagagtccataggaatctagtcttttttcagaaaatagtaaactactgtcttttgtggatgacataattttagcaagaaataaatgggttgtttagatgactttctattatctcatacagcataatgattctatatttgagttttcattgtcaaacactaaaacctcctttgttttcagtgtactaactccattttagaatatttttctcttctcttctttttttttttttttgagactgagtctcgctctatcacccaggctggagtgcagtggtacaatcttggttcaccgcaacctcagcttcccaggttcaagccaggctcatgcctcagcctccagagtagctgggattacagatgcccaccaccatgccccgctaatttttgtaattttagtagagaccgggtttcaccatgttggccaggctggtctcgaactcctgacctcaagtgatccgcccacctcagcctcccaaagtgctgggattacaggcatgagccaccacgcccaggccattttagaatatttcttgtagctcaattttttacttatataaaataataattttcattttcaacataatagaaggatatgagtgaattatatttaagaaagttaaaattaatagcactattaaatacattaacaagagaaggttgtgacatcagcaatattatttataacagaggtggacaaactgtagcctgtttctgtaaattaagttttcttggaacacagccaggctcatttgtttaggtatcacccatggcaggttttgtataataatgacagagttgaatctttgcaacttagactatatggcccacaaggcctaaaatatatactgtctggacctttacaggaaaagtttgccaacctctactctggaatctctatttttctcctaactttgagttgagcatgttcccttagaatgccagaaatttaactagcaaacacacctgaattttttttcataaatggtgtccttgtctaacatggttttcctcaaatccctgcaggtaccaaccaagaagctgaagaaatatgagaaagaatatcagacaatgcgagagagtcagctgcaacaggaagacccaatggatagatacaaggtatgagaaatatgttgcacctatcaaagtaccttcttttttgttttaaatgagactgagtcttgccgtgttgcccaggctggtcttgaacacctggcctcaagcaatcctcccactccagtctcccaagtagctgggattacaggcacgagccaccattcccagcaaagtacctttttttttttttttttttttttcttaaagcagcagttgtggcaagttcaattccctctgttcttccttgattgatttagatgctctctgatcatgctaactgtccaggtatgttttcatttcaggagactcccaaatagccaaccataatatttcttttctttcagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtagtggtgtttgttgcaacatttatttccacaaatgaatttatgaacaacagtgatatttgagttaaagtatgaagtttcagaatcaaaataatttcattttaatacgttcgttaattgtgaatctcttcaatggtaattagcaacactgttcccaggatgcaaagttgggaaacacttatttccaacttatttttttccaagtaaaatattatctctcttcaacatgctttaacttttcagactcacacagatacgtaacagctccttctccctccatatcaatacactaagataaaagaatactgtattttcagcactgagcagcagtgccaaaatctcctgccaagaaatggactgtgtggcattattaattaaatcacccacattgggatgacttccacttttgtaactagagttatctttatgtggtcagagctggacataggcagcatagtcacacagaacatcttatctctgttgctgaattgaatagcatgggatgtgtgcagaggaacatggtgggagtatgtaggttttgtagtcagacagacctgaactcaaatcttgctcattttttagagcacaggatttggactccaaattgagggttttaatccccatgccaccattcagcatcttcgactagttattgaacctcttcctcatctataaaagatatagtgtttctgattccttgatggattgttacaaggatgagggatgctgtatgttaaggactcagctcatagttgtgttcaataaatggctgttattttatgaagcctactactacagattatgcaattattactagaataatgccaccttatgtgggtcttcccctctagtcccttattgattgttcttatttctctcaagtattgccaaccaataatctccccttgcttatagaagtggttcaagatctgattataaaatcccacatacttctatagcagataactattaacagataatgtttgaagctaattttcaccaccaacatcccctcaataaaaccagcttttaatgtaaatcacatagcatgctgctttagaaaggcttgaaggtagtaattataaactattattaagcatccaaaatgaaggtctccttttgctaatatcattcagattttcttattactacaattattatgaataaattctgtgaagagtgctttaaaataagagagaaatggaagaccaaacttgtacatttaaaatcaggctggaattgaacttgttattgtgtcttaaatccttttttgtgccaaagcaggtatgtatacattaatagtaagatgtacattatttttaaagtacttataacatgtaagattatcaatatgtatagtttttattgagagatcaaagtaggattaaacttcttgttttgaaagcaggcattactttttaagttcaagtattgttgattcttatttacacatatcggataccctctattgctatttcttttagattattgtgataacttgtcagtacattcatctaatgtctctatactcttaataatgtctaggcatttgtcctggtaatacacttggtgaatttatagttcttagattataattacatcttcaaggtggcagtcaacaacataagtttctaaccatcaacatatttggtttgtaagatgatcaatatgcagtttaagaagccatattataattatcttaattaaagtagcaaagttagaaaataccttttacatcttctaaatttaatcctatgaagaataagatctctgtcctgggaatgagcactttgtaattcatagatcttggactgggaacccagttaatgtaaactcttaaaagactgacttgggaagatctttgagggcattgagtgagaacttgcaccagttcagtaacaacccctcctcaacattagaatctatattgcttaaaaagtcatttccacaccctagcttgccatatgacaagagagttagaaggttgtgggaaatttattttttaaagcccacatatgttatataataagatattttaagaggtatttcagttcagtgctatttcttttggacatggtggcatatgtaaaagggctatcacagggaacctagaggtgggaatacagatccagcaatgtgaggtagctctcaacagtcatacttcttgctacatctatgtaaacatgtgttttatgtctatttttatgacatatgcagatatcttcatggttaggttatatcgctgtagtcacctttattcaacacttaaatctcaaccacaaagagatgaaataatgttagtataaatttaaattttaaaactcgacatatcttgaaaatcttctggaattaggaagtagtgatgattgcacaactttgtgaatatactaaaatcattacattgcacattttaaaaacatgaattttatggtatgtgaattacatctccaaagaaaaaaaaaagcagaatattccaggaggattgtcatttagcctacccttttcctttcatgaaccctaaatcacaccagaggtacctgtttagaagcaggagggagagcttcctgttgaaattagagctaattagtgactattgatcttatatgtgtccatatttgcagaataaaagccaacacagtgggtggtacattaatttttagtgatgcccattaatttccaggtagaacatatgttgtacattatatgtatacacacatataaacatatataagtaggtaatacacacacatatatgcactgcctgtgctacctggtcttggcatcagtttatattttaaactcagtgaacaccataatgactgctttatagcctttactctttctgtttttcttcatgactagattccaagagacagaaaggaaacttttttgaaagaacaatgtagaatgtttatttcaaatctcttttatcctctttcttaacttgcacctgaccaggtttgtgtaaaattctttgtctactctaacattttggtttgtaaatttagtgattgatttctaatgaagtgaaattaggataaagatttgactgtagaataagcatgttttcatttttatacaggttcccagaagacacacatttatcaatatgtgtagctgttttagtatattttagaaactagtaactaagcccttaataagcaaagttaccaatttcagaaattaaaatactttctatcttaaagagatgaattgtttctgttgtgaggaaagttttctagtgatggtatcagttgctggtactttttggagatctgtagccttcatctacctttggagaacgatatgcttttctggtttaattaaataactatttgcacaaatgtgagttaaggcttaaaaacacagctaattggccgggcatggtggctcttgcctgtaatcccagcactttgggaggccgaggtgggtggatcacttgaggtcaggagttccagaccagcctggccaacatggtgaaatgctgcttctactaaaaaatataaaaattagctgggtgtgctggcaagcacctgtagtcccagctactcgagaggctgaggcatgagaatcgcttgagcctgggagggggaggttgcagtgagccaagatcatgccactgcactccagcgtgggcaatagagccagactctgtctcaaaaaaaaaaaaaaaaaaaaaaaagaaacgaccaggtgcagcagctcacgcctgtaatcccagcactttgggaggcagaggtgggcagatcacaaggtcaggagaatcgagaccatcctggctaacatggtgaaaccccatctctactaaaaaataaataaataaaaatataaaaaaaaattagccaggcgtggtggtgggcacctgtagtcccagctacttgggaggctgaggcaggagaatggtgtgaacccaagaggcggagtttacagtgagccaggatcacgccactgcgctccagcctgggcgacagagtgagactccgtctcaaaaaataaaaataaaaatacaccccccccccacacacacacacagctagttaattaaattcagtgaatctcccaaagcataataaaggttacctgttctagatgggaaaatactaaaagaatctggaatgcttaaactctcttgggtttgggacacagacattattataaatacataatttctaattgaagtgtcttatccatgttcagtacaattaaatttagaatgtttaacctcattcttgagattaaacaaagtaatttttaaaatcaaaatgtaatttaaacaaagaaaatgattcctctatgtttccacagagttttttcttgcacatactggtttttgtagagcaattgctcctacatgtaatttcaaattaagctattatgcatagtaaaaataatacaaatgaaatatttgaaataaagcttaattgtacttttttgccatccttaaatatctaatgcaatagtttagagtaattttcacatttcttttaaacttgacaaataaaagtttaaattagtatacatttcttacctataaaaaagagggagtagactttttaaaaaaactgttggaccctttcttactcaggggagtcaagataagtgaatccatctttgaaaaatgtttttctggctgggtgtggtggctcacacctgtaatcccagcactttgggaggccaaggcaggtggatcacttgaggtcaggagttcaagaccaacctggccaacatggtaaaaccctgtctctactaaaaatacaaaaattagctgggtgtggtggcacataacctgtagtcccagctactcagtaggctgaggcaggagaacctcttgaacctgggaggcagaggttgcagtgggcagagatcgtgccactggactcctgcctgggtgacagagcaagactccgtctcaaaaaaaaaaaaaattttttttctgccatagcaaataaacttacattttattattttttcatatcccaaaaactgtgttggcttttggaaatagtatgttatgaaataatgtgcttttaaggaatagtaatagacacaaggatggtttatatatgcctatgataacttaatgataaacttcagaagtcttccactttctctttgagcttggataatccagagagttcattgttataggatggtgaagatgcaaaactaaatccttttggcttctcaagcaatatagctaataaggagtgggcgatttctaacaatgctggtctgctagagtcccttatacttaacccttgggggaagaatatgctttaggaacactaagaatttctagtatgtttactggtgatcttcagagttttcaagaaactttcattaatttttagaaagttttcttttctgtttaagtattactgagaaaattacctgacactaatatgtttctatatcatctagaatgcatctgctttttgaaaatttgatttgtgtactagagtagagcaaggatctgcagactgtggtttataggccaaatctggctcactgccagtttttgtaaaccaagttttattggaacacaaccacacctgtttatttatttatagtgtatggctggttttgtatgacatttgtagagttgagaaatttcaacatagaccatgcgacctgcaaagcctaatatagttactttctggcaatttacactagaagtttgctgacccctgtgcaagagtataacctaagatagttttttaagcgctgaaagaaatgcagtctgtttggccagctgtcatttatcactgacaagattttgtttttagtttgacatttaaaaatttgaaattttccactacaaagataaaattggatgtgatgagtaaaggagggaagcacaaaaccttcaaatatccatattttctttctcagatcttcattatggacaacatagatatttaaacattttatctgtaggcatttgaaaacttgaatatgatagctgtcaactcttttaaaagaggtatccaaaagaaaatatgtgagagttgagtgtgttgttgctaataaatttgcactgagtcttttaggaaaacattttctcctgacccttaaaagtctttaaaagcatgtgccaagaattcatcatagcagcagacaacacccaaaatattgagctagggtttataaagccgcctccctcctcgtcattttttcctttaaagcttagtttctttacttttaattaacagttcacatttctctggtttctcatcttgaaataaatgacgttcacaatcccttgaaccgcttcacccagacttcagcccccaggtacacatgagatccaggatccatttttcttttgcattgccctgcccagcaatttcattcttttgtctgaagatgaactattttgcaagatttctgaccttgtcatataaggaagttccttccacccagctttaacaacacagtatcaacacctcacaccgtagttccttaatagtcccacatacagcattttagtcattcatgcaaactgtaaacagcaatgtggagagggaggagtttgaagatatgagtcttcctgagttgagacttgcccactggctacctcaagtatctttgttccattgaatgtttgcggtcacagagagaacttagagttatatgacactcaaaggaaaagcaaaagagcattaagaagtgtctgtttttgttattgccatttcataaatattttagtaggtgttcaatttcattggatattctttttttttaattgtctttgtacctatgattgaaaacagtagttggtctatgacttttgaggaggtaagttttttttttaatctatgtatgtctgtaacatcagtgtctgtctctttgaaaaatgcagtatcctcctcccaaaagttactaaccaaactttcccagctgtacatctcctatccataaggggtgaaactatgaggacagttgttatctgctttttgttcaaacggtgtcagttgtgtgagatggggagtatatgtttcagacagtgtgatgtgagttttaagagttatgtaagcagtgtctcctgtaatcttttctgaaaggcaagagggagccagtttgcctgttttgtttacaggctttgagcatttagcacatctgcttgtgcaaacttacagcatgtgaatttctctgggctgactgaggttattggggctgactttaagtctgtcttccatgggcaacccttgtcaacatttcaaaatgaaccaagcagggttactgccttttccaagaccatcaaaaccaaactctcttctccattctagtatacaggcaaactttttctagaattggtcagtattgaaaacagttttggctccttgagaagaactgtaaaagacagccacgttaatataagctctgtttagccctcagtaggtaagtgtgggcaagttctttgtagaaaatctccatctcagtagcagggtctcactgtagtgctcagtagcactcaccctgggttcatactttggaggatgatactgcatttttggccccgtagcttgctttcccacttgtctgtgagtgcagagcaggagtctgacacttcccactgtgctgcttgctttgcagacactaaattgaagcttcttgctaaagcaaaagccagtaggcgtgccctctaggctattttgctttgcagggactctgagacactcagtttctcccaaatcttttcccacccttgcccttgcccctttagctgtgtgtctgtaaggaagggtttcagttgcaacagtcattgtaatgagaagttactagtcagaatttcagctgaactcacacctctttcttatataacagataatccatcagacatttatctctaatcaacagtgaagtagctacctggtatgatttctaaatacttgaacaaagtacttttccatgaacatcctatgactttacttggaggttactttaactcaattctaagcatgtaattgtaacctgaaaaactggtagtggcaacattttcacttgtgccaaatgaatgtaatgtacataatagtcgagggagctttttgtactttggggttatacaagtacaatttcaatagcaataggatacttaactcaggaatacctattgaagtagtcttatcttagtttcttgaagatatttatcaagaaatgagaaaaatctcttccctggctaagcagcctgcattgtgaaatatgtcatgttgaaattgtgctggtattgttactctttcctggctgggaggaaatttattgaaaaagcttctcaaatctttttttttaatctaagtttcctatatgttttttttccatgaaaaggagtaatagatatatcagaaataaaggctaactctccagcccctgctagaaattgtgttgcttaggcaaagattcaaagatttcattgtagaagctctggctttttagaaatttgttttttagtctccacatttattatgcttctgtgggagggtgtaacttctgtagattgaggggaacagacagaatctgatgagtacaagttgcctctacaagagcattcacagtcttctcaggaacatctagggaaagagttcctcacaaggcaccacttctgaggggttacattatatcttggtcaaaaaggaggatccaatatggttttgtgtagaatatgaccttctaacagaagtggacttaaatttttttttctcattttggcatcttatcccttccaatggaattaaaattctgaattcctttttttcttaataaaactattttttaaatcctattacaaatatatattcattgtagaaaacttgaaaacatttttaaaagaacaaggacaacaataaagaaaattcactacctacagttaatattggttgtttatattgttacaatgagattctccaattatttattggggtttttttcccccctacaaggaaggcagcgtaagcatttcctgttattatattttctttctttcttttttttttttttgacacaggttctcactctgtcacccaggctagagtgcagtggcatgatcatagttcactgcagccttgacttcctgggttcaagtgattctccaacctcagcctccccagtagctgggatcatgtgtgcacaccacaccacccagctaatttttttttttttttttttttgagatggagtctcactaactctgtcacctaggctgaagtgcagtggtgcaattctggctcactgcaagctctgcctttcaggttcaagcaattctcctgcctcagcctcccgagtagctgagattacaggtgtgtatcaccacacccatctaatttttgtgttttgttttagtggagatgaggtttcaccatgttggccaggctggtcttgaactgacctcaagtggtccacccacctcagccacccaaagtgctgggattacagacatgagccactgtgcccagctgtacccagctaatttttaaaaatttttttgtagagatggggtattgccatgttgctgaggctggtcttgaattcctgggctcaagcaatcctccggtctcaggctcccaaagtattgagattacagtcatgagccactgcacccagccttctccagtattttaacactgagtagaattctattgtgaatttatttaaagtattaaagtgatttgggattgtttttatcttttttagtcgatatgtttttcaataatgttttaacattctccaactattcttatttttttccaaaaaaaaaaaaaaagacagaaatgggccctggtggctggtataatcaaggtgcggttttgtcctttaacttctctgacagccttccctgtttatggatcctctgcctctgtgaaagcctcagactttgcccttaccatgtgtttcttagcccttgttttaaaaaacaggaaaaagaaagaaattgtcttctctttcaatataacaaacaccaggttgttatatagaagatacaattaacttcacattacctggtatgctatgataaactatcttccaaaacatatatttgtcttctagttttttgtcactgctttgtctgagtttttgccacctttgcagaaaacactgttagacgtgtaaatctgaaaaacaggaaggtctcatgacattagtctttcctgtcagctctcttttgaatctcctataactgttaacagtagcaaagaaagcaattttgatactttggaatggaagacatgaaatagctattctgaaaatagttgtgaacataccaagttcatagtgtttagttaaggaaaggccttgcttcataagaattagtgacttggttttttttttttctttctttttgtttgtttgtttgtttcgtttttttgtttgtttttttatcatgtaactttgtttcagatttttcaaggttgggagcagaaatcctcagtaatttattttacccagaatgttttaatctgaaattttttaaaaaacaaaaaaactagatatcttatgactgttgctctcacacaaaaataggtgttcagaaaagtaaatatattcttactcaaagaataaaaatgtcagctgttagcaaagtcatgaacccatgtgtcatgattcttgatttagagctcttaaatatactcaatatgaaccctgtcttagaaaaacaatttgaagaaatgtctggtggttttcccctgtttcattcctactgtgtcttgtggtttctcttgaggtcaagggtgagactaccgtgcatgtttcaaataaagaattgtttgtgtctgtgttctagatctatgtaaaaacctcacaggattgggggggatatgctcagaaagtttgttctttgtggcacattttttataatgaagttccatcttgagagtttaagggaccagtttcaccgggtagagaaccgcatctgcattgctagctaaactcactgttgtttcccagacagcaatcctgccttcctgtgccacttgcgccttctcctttttacacctttgaaagttcactttgttgcttgtttttcctcaccagttctgttcgtttctgtatgtccagacactaatgcccacctctggctattgttcttctgcagagggagaaccgaagattacaggaggccagcatgaggttggaacaagagaatgatgaccttgcccatgaactagtaacaagcaaaattgctctacggaatgacttggatcaggtaatccttagaaatgagactgtgatgacttcctcagggcaaagaccgatttgccctcatcaccgcccccacaaacttgctttgttcttgactttgttcttgaggaatggacaagtggcagggacagtctgttaattggagaccatggaaaacataagcctttgagaaaggtttgggtcatttctaaatagcatgtgtgacatactttctttatacctctaaactctgttatgtctttgttgatacctttcctgaaccaatggctgtcagcataattatctgagaacatcagtcaccaagaatatgcctgtactaatgccactctaacagtagatgccttactttttgttccagtaagaattattctccataataaatgtgaacttttacatgaagtacctacattaagagttggattgttagattgataggcatctgagtggctgagagccagactgcctgattgtgaatgctggcaccaccactgtgaaccatatgaccctggacagttcttaagctgtctataggtataaaaaggtgtctatctcatagagatgatataacaattaaataagtaaaacacttcgatagtatgtgttcattaaatgttagatgtagctgagagagctggcactaaagggaattcaaaaacaaaaacaaaaactgtgttgtttgggacacaggatatggaaggtagaaaaagctgcccagagaatggttttttaaaaagttgtggccctgttaaccacaaacctcattcagcccacccatttggaagctgtgagaagtggtatgagaaatatgtgactaggagagtcagaaccaaagaaggtagccggatctccattcaatcagggtcaattcagccttacctcagtggtcatatttttgtattcatgagactgttgagataagtcagtgctataatgaaagtcttggttctatgttaactttccaaatggtcttgattcacacttgattctgccattttgaatcttttatccattaataattttcttatgatggctgactaaatgaaacaatttttaaacagttggattcagtggggatgcagtgaaatgagctaaggagagtttcaaagttgtttggcaaatgtagttggtaatatgtgttaagacgttaaaaggtttaagcaataataaaattaaattttactatgtacccactatgtgccaagcactaaataaagcaatttataaacatcatctcatttaatctccctaatgactccaggaagcagttattattttaatcctccatttcatgaatgaggaaactatatagatgaggaaactagagatcctctgacttgtaaagctatcctaaaaaaaaaagatctgtttaaaaaaaatgtatatacaaggttgtttactgcagtgttacttataagaatgaaaaatagaaatattattttatctatgttcactagtaggggagaatgacagtttgactgtaaaatgtctttctggaataatttttgttaatgggaaaataatgataaagtatttttttaaaaaatacttttttttttctgtaaacagtaaacatttataatgtttgcatctaaatttcaagggctactggctggcattgggtcatcctatagggaaggggaccatagtatacctagatagggaagaagcccacaaggaaatacatcaaaatgttactgctaggtatctctgggtgataagattaaatataatttttatattcatctttatagttttttcccatttagaatttatagaaagaccctaaattacttaaccaccataggttaactaaaaatgagcattggaacttttaaaaatcagaaaaataatgaacattataatatgcatattatatatgaatataatactaaataatatatataactttaataatcagaaaaaaattattatcttaaaaatcatttcttcaccaagagaaccctttatgtgagtcagtctggagtgactgccattataggtattcctgaagtaattgattattgagtaccagggtagctcatgatgtgagtgctagaacagcccctgaagaaaaggttccatcagaccttcattcttcctctgccttctctcttccctccttgactctctttccctctcttttaagaaaagtaaatatgacctggaccctccctttgggagctttttatctagatgaaagaatctagatgaaagaataaaaactgctgtttcatgcatatttcctcctaacttctgattttgcagtttcctcctcattggggtttatttgcttaccaaaaagctgtccctgcagttgaagtgacctgccccaccagtcttctaggaagggccctagcctgagagtgaaaagtactggctttgcaggccttcacctagtttgcccagtactttcccattcccagttcatgaaaatcagatctcttaattaaaatagcaaaacactggcaaactttaaacaaatataaaagtagattgtatttaagacaatatgtaagcaaacaaacactaattaggaaattaggttctttgcaaaaataaatcatttcttactctgaccattttagtgctaatttcaggcttcctgggcaccaaaggctcttcagcttttccctctggcagagccttcctctcttgagaactcgccctctctcggattccttaaataaagatttctcagtgattagaagtgaaaaaaaggtgcaacatctccatttcagtttctgtttgctatctgctttcaggcctttcctgtccttccctatttgcaaggaacaaaagagaagagacatgattagtactgtcctgctgaggaccaggggtctaggttccctctcaccatagcaagttctgttagaccagaagctacatggactaagtggaaaattattttgttttattttaagttgaacaactggcctggttagttctttcagaaatcatttatcagagatcctcatttctgatattagggctgagtcttttctgaggttattggttgattcatgattaaatcacacattgcaatgcttgtttctctcatacatatatagcagaagccttagattgcaattagaactttcagtatcaatgagacattataagatattgttaagtatttagacttgataatgacagtgtttcaatcttatcaaattatggtgaaggctgtctggtgcagtggctcacgcctgtaatcctagcactttgggaggccgaggcaggtggattgcctgagcttaggagttcgagaccagcctggggaacacggtgaaaccgagtctctattaaaaatacaaaaaattagccaggtgtggcggcatgcgcccgtaatcccagctactagggaggctgagacaggagaatctcttgaacctgggaggtggaggttgcagtgagccaagatcgcaccattgtactccagcctgggtgacagagcgagactctgtctcaaaaaaaaaaaaaaaaaaaaaaaaattatggtgaaggctttataatttgggctcaaaggtagaatttgaaaggctttataatttgggctcaaaggtagaatttgtgtttagcatttcattcattaacattaaaattaattcctacttaagtgaggtatagtggttggctgtacaaaaattcaaaagaccactgttagagggatactcaagttatttcagatctggccctactttgatgaacagaacaattgctcctacttttctgtttaacataagaggagaaactgtgaattaagcttcctggaaaactggactcttccctataggacccacaacaattgctgcagatgttgtatatggtaacagtagaaataagtgaagttgccttaatcttgacctaatgaagactgttcagcagaaaatgtgcaaataaaaataataggtcttcttagcataaacatttaggtgtttttgaaaaaaattcctcggggaagtgtttttcccccttttcttttctttttctttcatttcttttttttttttttttctttgagacagtctagccctgtagtccaggctggagtgcaatagtgcgatcttggctcactgcaacctctatctcctggtttcgagcaattctcctgcctctgtctcctgagtagctggaattacaggtgcccaaaaccatgcctggctgatttttgtatttttaatagagacggggtttcaccatgttggccaggctgatcccgaactcctggcttcaggtgacccacccacctcagcctcccaaagtgctgggattacaggcgtgagccaccgcgcctggccagcatttactttaaaacattttcataaaatgttaaaattttagatggctctccaagagaccaaactgaaaaaaaaacatttatttcagtatcatgatgaacattatgaaaggatcagtctgttcacaaagtggaaattgctgtgggtcctgtaagaggaaggcttagttgcagtcttctttattagcagggctcaaacattctggggtagaacttgaaccagtgggctgcagttacagggagagagttggttcagtttttaagaacactgaaatgagcagtacaattgttttttgtttttttttttttttttttttttttttgagacggagtctcgctctgtcgcccaggctggaatgcagtggcaagatctcggctcactgcaagctccgcctcctggtttcacgccattctcctgcctcagcctcctgagtagctgggactacaggcacctgccaccatgcccggctaattttttttgtatttttagtagagacagggtttcaccgtgttagccaggatggcctcgatctcctgacctcgtgatcagcctgcctcggcctcccagggtgctgggattacagatgtgagccaccgcacccggctgtacagctgctctcaaagtgccactctgtgcctatctgtcagagactttggggagggtctccctgctttgtgagtaacctcagtcagtcatctggcttggggctctagaatggaagctttgtgcttccatggtttatttatttttctctttttgttttcttttaaaatgccgtactttatgccacatcctttcatgatgtacatcaggtgacttacaacttatgaaaacttgacttgcagtgttcatattgcattctcaaggtctacctctcattttagttgttaatttgctgttagattttcccccctaaaatctaatgcatcagagcaatttttagagtcttaaagacttttaagggactttttcgccttaactacccaacggtttcaaatgatctgcaaacaaagctctaaccactgggctatgagccatcaggagccagaagacagggcaagcagagcagctggaatgcagtttctctacagtcaccagcagactgtgctggcctggccatctggacatgcaggagatatggcagaaaacagacagaaggccgcttggccagtcctcagcagactgggctggcctggcccatctggacatgtgggagatatggcagaagacggacagaaggccacctggccagttttcaccattatttggataacattttgctgctgtcagccagggatagcttcttcacataatcacctctcctctgtgtctgggttctctctgctgaactcatcctgtggccttctgccatctccactgcatgcagtctgcatctgcaatgatttagccacacctcttcattcaccaagtacttagggagcacctattctgtacttggcattgggcttggtgcttgggatagagtgatgagcaaaagagatatagttcttgtctcctggagcttaaagcctagtgggcaagacaaataaatcccatgtgtaagttgtcattacagtcctattaagggaaatatgagagatttagataggggagctaacttagatgagggtgagtgggccagggctgagggcatgcttcattgccatgtgaacttgaagccgaggcctaaaaggtgagagcctgacgtgttaaatagacatcatcattctagaaatatgatcttttcttcctgggttcctggtccatatttccattttcttcatggctctctctatcatgggtttttggtcttgatttctccttactagactcactgccctgtgtgagtggccatgtgggcaggtttacctcagctagtctttgaatttgccacctaactgttgtcctcagaccaccctgtctgctcccctctctgagtcaacccccattctccaccagttggaagtttctgtgtgaggctctaccccttcatcagatccatctacacagagtgagtgctgctgtaacatctaaaaatctgtaagaagcatttagaaggaggatggactttgatgttattcaaatctgaattcagatcatgactctattagatgtgtgaccccagacagtttgttggatctttccaaacctcactgtcataatctgtaaaattattgttggtgtgtggattagaaataatgtgtgccaactagatggcacatagttggcattcagtgaaagcagccatcgcttggttgagctaggagggaaaataatgacttgcaataattttggaacagcaactgaagattgggtttggagaagatttccacacactttctttaccctctgtatgactgtgatgtatgactgtgatgcaccatgatttgcaggcagaagacaaggcagatgtgttgaataaagagctccttttgaccaaacagaggctggtggagactgaagaggagaagaggaagcaagaggaagagactgcccaggtaaaaggaataatatgtaggcttttctttacaaaggtatgttggtagggaattaacactataaaaaagaaggaaaattaaatttcttctaaatcaaaggtgatgttaaagcagtaatgtaagtagttgagtgtacttactcaacatttttgttcaacatttctgacattttttttttgaagggtgttaaaagaggaggcagtatttctacccttgaacagcttttaggaatttgcctttactgagatatttagcaagagtgttgagttttctctaagtttagtaacttggaattatgatccaagagctttgacaaatctgcaaattttgtgttgtatctccaagataattgacttctctgaagtagtttatgagcattgttaaaccgaaagcctacagagatctctgctgggagttgccacacagcccctgccgcaatcagtcacacttcattttcctgattcacaccttaagcagcatcagtattcctggctaagctttcaaacctatttcctgggggaatataaagaaacattttgggaaccagccttgaagttagcaccctacactcttcatgggagctgtaaggctaattagccagaaaatgccaccagtgcaaagcagtataggataggggcagagaggcctatgggcccaaggaattggagctttccgcttccccaaggaagaacatgctgcttcatcagtgttttctacccctgtcagtcccagccaggggcctgacacagattagattatgagtcagagtttcatcacaaacaattgaagtcttctgccaagagtgtgtttgaattttactaatgtagctaacttataaagtgaggaagcatctcaaatcgtgattagcttattttaatgagtttcattctgagacatcagtaatactaaacttaaagcacagcataaagcatttcaaggatctacatccaagcaaccagaaaaaaagttccactaaagttacatgtggaggaatgtgtcatttagcaccttccagactttataaaaagtgttccatggtttctttttccttggaatctgatttaatgagtctttggcatttacagcggcccaggatatatatttcttacctactcaaaaattttcaggggctgattacccagttttagattatttaggctccttaatgggttttgttttttctttacttcctgccatctttgggccacttaagctactctagatgaggcataaggctcttggcaagtaaatttaacccaggttctacctgctccgtggttccatagacatatatactagcctgtaagcaattgatacctaaaatgggaaggaatatgacacttgaatactcacctagtatgttgcaagaacaatgcaagatgctttgcacccttcctcccctccatgtgcatctgtgtgtgtgtaactgttttaatcattatggtacccttgtaaaatagggattattctcattttcagatgaggaaactatggcttagataaatttagtgacccttgctcaaagactctcagccagccaagtctgtcctaacatctatggggccttatcgtggaaggcgagaaggttattgtttatgtccttaaattatgtcagatagagaataaagatcaatataaacaactgagtgtagatcactataacttaccaattgcttttagaattttagaatctaacagatatgaagaaattcagaaatctaatgagtgctattataaattgcaataatttatgaactagcaattacagagtatacgccattaataatttgggatgctttagtgcagaacgcatctctttattctgattatgtacttaaagtttaagcagagttgttttttgtttgtttcattacttgtttgttcaacaacttgcagaatttaattctttcctttgtatctggtagcacctgagcttttccatcaccttaattttcccctatacctagaattctagagctgctgggccacaaaaataactgtggttataactatagcattcataatttaacatttcagtgactgtaacaggtacctgccattatgtgtcactttagctccttctaaagtcagtttctttagtccctgaatctcctgtccttctcaaaactcttatcttcccccgtcttttctaactctagtccccaaagcctcttgtttctgcctccagagaggtaacagcagtaaaggtagactataaataaggaggcctacaatgatttttttcagtaatttataacatcaagagtaacaaatttagcatgcagtattgccttgatgttttgttttagactcttataaggataaagatagcttctgaatggatacttatttagcaatatgtttagaagtagcaagcataagcaattttataatggtgttgttcatatgtctcatattttacagaaaagaaagtaaggtttctgcatctctggagatgattgactttttcagattatcaagatgcagcttccatgaagataatttatatagttaacattgttaccattgttactgactatgaatcagacagacttgaatatagatgtttgtgaaaatttaagattttggctaaatcctgatatttctcattctattctttctagctaaaagaagtcttcaggaaacagctagagaaggcagaatatgaaataaagaagactacagctatcattgctgagtataaacaggtaatgtacttctgtggcacatagagctagttatagtttgctgctataaaagtaatttttttttttttgcttgaggccaggagtttgagactagcctgagcaacatagcaggaccccatatctacaaggaaaaaaaattttttagttagccaggcacagtggcatgtgccggtagtcccagctacccgggaggctgaggcaggaggatcagttgtacccaggagtttgaggctgcagtgaactatgattgcaccactgtactccagcctgggcaacagagcaagaccctgtctctaaaaaaataaaaataaaaaagtaattattttgttgttgtttttctttgggggaagaaatatttttgtttttaaagtttccagaatagttttccagatttattaaatttggtgactcactgtctcctttgaagcagacactggttggacatacttataacttattacttatagcttattacttataactgataacttgggaggtctaactgaccaaaacaatctattggttgtttacagtgttgggtagatttagaggaatagaaaaaccttttgatgactactgagatcctgtttctgccttagtcagaagctaatttccagtagatcacacttggaacatttgcctctttgtgaagtttagttattgtattaaatggcagtagctaggggatcagtgtgccctttgctaccatggtacagaatgtggtaggcactctttttcctacatggctatgtggccttcccctctgcaggccaatgctagcaggaagctttctattgtgaaccttaaaatgcttttaacaaagggctcatcttcttgaggatgtttctggccccatcaccatagtggtctcagaaagccctctttcctggtatctactggtatcttcctgtccttcctgttggctggacatggcaaggactcctctcattgctgagaccctgagttatctgttcaaattccaggtttctagaattaattaaagtaccatatgccatcttttgatctaaagatttccctggggtcttctacttcacataggactctgaagtctgatacttactttttaaaaaaatgtgtttttttgcttataaattaaatttgtgttcttgtggaaaattagaatagtgcagagaagcacaaagaaaacaaatctccctcagtctttctagctaatcattgtaatatattgaatatgcattgttgctatacaaatgctttataaataaatttaaaatatatataaacaggatgaattgtattgtttatcctttttttttgtaactagctttagttcactaatacattatgaacatctttccataaggaatccgcatattcacggacgattgataaataaaactttagagctattttactcttctatgataatcaacatatgtttatttaatgcctgctctctgtgaggcttaatactttgacagacaaaaagatgaatgaattcaagttttcttctctagaagcttatcatataatgtggaggtaatacctacgtagaaataagaggaaaggaaacttattacatgtgggaaatgaaaccttttgagctgtgcttcaaaggcgatgtaagacttggatctgtagagataaagaagataaagaagaggatggaaatggtagaaaagagagaacaggatgtgcaaaggcatggaagtagattagtgaagagaaaaataattcatttggtaagagattccggtacaaaagagaagcaaagggacgttagggtccagatcaaggaaagtcttcagggctaggcttgggaccttggattttattttgtttgtggtaggatctttttgagcaggaaagtggcataatcaaagacatattattggcactaatctgtcccagtaagaaatgtggaaccaaggagacagaccgcgaataccagagtccaactgtaagaagaaccaggtccctgaactaaataactaacgaaaatagagaaaagggagacacaaaagacagttttttttgttttttttttttgctagatgagaaaaccttgaaggtgatctgagatgccgaatgtgggcatctaggagaagaggtggtagacattaaccaatacaaggaacattaaagactatgtgctgtggaatttcccattgctacaaatgcatgtttttcattgccagattatgccatgggtggccaccaaatgcagcactcttcaaatagtaatcctggggactattcttgaatattatctggcaagcccttgaaataatgcaaaaggcaacagacccatctgtttgaagataaggatataagacacaatctaaatgcattctatagttggaattggctattactggctctatgcataatgttttggcttatttaaaagggtttaaggtttgcagaatctaccatggtgatctcttctttttaacatcagtcaataccgtcctactaatggttcctcaggcttggatctggagaaattggaatgaaactcaacaaactaaactcagcaagcaagccctcatcaccagagctatttttgagtagactgggtgggattttttaaatgtctgttttgataatagaggtagaccatatatgtttttatccaaaattatactttaaaatttcacatcccctgtttttccatctttttttttttttttttttttttttttttttgtgaggcaaggtcttgctctgtcacccaggctggaatgcagtggtctgaacacagctcactgcagccttgacctcctgggctcaagcgatcctcccacctttcatccacttttctaaaataaaagattcttatttcagacaatggatttgaacatccaatacttatttatctagattttttcctttgaaagcacctatttctaccatttctaatacttgttagcaccttatttcagaatcaataagaagaatatattttatttaatgtacacttactattggccaagtgctatgctaacccctttgcatacttttttttccacttgattgctatagcacagcacttttcaatcatgaggaaactgagtcttagaaagattaatgactttgcccaagctcacaaagctataaagaaatggagctggcctgccttaaactcacatttaactccagcagctaagtttttaatttctatgctatgttgccaaacctacttaataagagttttagtctgtattattttctggtcattttaactttgttttatccactctgccacctttttttaataccttaaattctggggtacacatgcagaacatgcagttttgttacataggtatacacgtgccgtggtggtttgctgaacccatcaacccgtcacctacattaggtatttctcctaatgttatgcctcccctagtcccctacccctccaccaggccgcggtgtgtgatgttcccctccctatgaccatgtgttctcattgttcaattcccacttatgagtgagaacatcactctgccacttcttaaggaaacttttgtgattgaaaacaggttctttctgtgacagtagaaaggagatatttctgtctagaattcttttcatcaagattttctcagcatactaacttgtacaaagtgaatactcagcaaagattctataggttaattccaaaagtgaggccaggaattcacttgaaccagtcacagaaggctagtgacagaaagaaaccaaatctactctccgtatgtttctactaattaaggtagagtgtgctttacatatggaacgctccagctttctgctgctcatttccgaaatgactggcatttgcagtgctattcatttgtaaaattccttctaggatcagatgtgctagcataacacatgaattgataagtagttatgtgtacatgctgcaagagttgttctgttttctagtaaaagactcttttctcatccttagatctgttcgcagttgagtaccaggctggagaaacagcaagcagccagcaaggaggagctggaagtggtaaaggtaaggagtgaaatcgtgctgtgataaaatttatttcaaagtcacacaggcttgtaagtacctgaaagaaccccaaacaccaccattttgtattaaaggatttattaataggaattatggagactaggatacctctcttctgaccaggtgtgattgtcttccctaccaggtgaaaggttatgatgctcccataaatcatatggactgtcagaggcagctaacatgaaaggaagtaggatttgacattgtcacaagaagccccagagcttgagatgagagtggtatgaacctgagaaccctcagcagcccacatctgactgagcctgcattgatgtggcttcagtatgggactcagtaggatcatcccatcactctctttataagtaaacaccatgggcaatatagaacttagctggaaaaacatgtgttgggtaactgattcttgcactaagtttttagaggtttatttttaaagaaaacctgtggcatttgtttacttgctgccccctggtggtaaaatgcattatgttgatgctctatttgaaaaaaacagattgcttattccatagaaacaacagtaaaccaatggattggtattcttaagaggcaatattgtcatagtcaacttttgggaccagtgttacagaaacctgacatcatcttatttgaatatgttcaggtttcatactagtaaataaatgtgtagtaagtaatttagcaatcttgaaaagtgatttaacctttttaagcttcattttgtgttctataaaatggagataacattacctgcctcaaaaaatcattctgaatgttaaataagataatgaatataaagtacatagtgtatataaagtgcttatattagtacctgacatacaagaccttgtattccaaaagtattttcttcttactcatgttacaaaatgtcaatgagagatttagtgagtataaggtttggtgttctccctctctgatgtgctaaaatttgatgtttgtatcttccctttctggtctacttttgcacttctttctagttagcacttaccactctttgtacattataggcatactgaccaagattcagttgatgaagttgaatggcataaaggggttaactctcctgaagtgaattttttttgtatttcttctaacaaaaaaaaaaaaaaaaaaaaagggatacatgtgcagaaggtgcaggtttgttacataggtatacgtgtgccatggtggtttgctgtgcctgttaacccatcctctaagttccctcccctcagtccccacccccaacaacaggccctggtgagtgttgttcccctcttctgtgtccatgtgttctcagtgctaaactgaaatctttatggaaataacaaaatgagaatttatattgattattcagcaaaggttttattgagcatatactatgtgcatagctattagactgccattttgttatagaaattacacatgaaaaggagcttaaaattttcctgtaggacaagttatgtatacatgcaaattaagaacttcggaagcagttcaagggagctaagttgggccaggtgtggtggctcacgcctgtaatcccaacactttgggaggctgaggtgggcagatcacctgaggtcaggcgttcaagaccagcctggccatcatggtgaaaccctgtctctgctaaaaataacaaaaattagccaggcatagtggctcacacctgtaatctcagctactctggaggctgaggcacaagaatcacttgaacccaggaggcagaggttgcagtgagccgacattgtgccactgtactccagcctgagcagcagagtgagattccatctcaaaaaaacaaaaaacaaacaaaaaaagtgctaagttggatcacaatgacaatcagcattgtagagaaaacaaaatcatgagaactatagaccaaaaaaggctttatggagattggactaaagcagggtggatagaaattagttagagagaagtgtttaaacagaacattatagaagaaatgatgtgagtgaagacgcaaacacaggaatgagtatttcagtgtctcattacagagactgatgtgattagaatatgtattaaggaacagaggaaaatattggctaagtaggtgagactacctaatgaaaggccatgacattcaggaagaggaatgtaaacttgtcttagccagaataaagaagaacaactaggctcacgcctgtcattccaacactttggggaggctgaggtgggcggatcacttgagtccaggagttcaacttggtgaaactcctggactgggaaacttggtgaaaccctgtctctacaaaaaatacaaaaattagccggatgtggtggcatgcacctgtagtcccagctcctcaggaggctgaagtgggaggatcgcttgagcccaggaggctgaagctgcagtgaactgtgagcatgccatggcactccagcctgggtgacagtaagagcctggtacaaaattaaaaaagaaaaagacagtaaagcttcttttttattgatgataaggtcgcaaacaggtaattcatttgatcaaggttacacagctagtagaaccaggatttaagcctggaagtcagactctaaagtcaataacattagctgttagactatactacctcccctttctctagtgcttcctcctatctcatttggtatgataaatagcttttggttttttcagtttcctgtaataaccttcttttgtcatgatcaccccccagttcatcctttacactataatcagaatgagtgttcccaaatataaagtgatatttgactatcactctgtgtatcaatgcagaattagattggccacatatagggaacccaaaatagcattggcttaaacataaaaggtgttgattattttacataaaagcagcctaggactagaaaggtatatctttggtgtcattagtaacccaagctaatcagtcattagtgacctacatcgtcatgtggacttctatcctcaaggtcacctaaaaaccaatccttcctttctttttttcttttttttttgagacggggtctcgccctgtcgcccaggctggagtgcaatggcacaatcttggctcactgcaacttctgcctcccaaattcaagctattctcctgcctcagcctcccaagtacatgggattacagtcacgcgcctccacacccggctaatttttgtatttttagtagaaaaatacaaaatacatggtttcaccatgttggccaggctggtctcgaactcctgacctcatgttctacccacctcggcctcccaaagtgctgggattaacgggcatgagccgccgtgcccagcacaaaaccaatcctttcaactagagctcccaccatcacacccatactctatggcagaattttagtccaaaaggagatgcaggatataaaggcctcattctcctgggtgagctctttctaagcagcctttttagaagctcccctctaaacttctgcttacatagcagctttgagggaatttagggagtgtcaccttttatctagacacactgccagctgaaataaactcagggtctgttagtaaggaagaaggagaaatggatattgggtgagaatcagcagtatccaccacattttagcaggtctgccagactgcagctctgtcaaacttattgctctatctttgacatgtagcacgaggctcggtagagtaaatgaatacattttctgtaggataaaatcagaattcagcaacatggtatttaaggacctttatgacctggccacagggatctctcatctcgctcattgttgaatcgctttctgcttaagccattttaaattctttgaagttatctgaaggtgctatgtctttgcacatggtggtgttctctttgctgaaatgtcatcctccctcttaagtgatcaatctatttcttcaggtggttcaacctaataaaattacttagccagcttggtaaacttttaatcatttaagactcagatcaaaactatttctttaacatttttagtcaacagtaaatacacaacaaatatttacaatatgcctatactgggctaattattctcagaggttcttaagagagtgacaagttttgtttttacatgtctaattaatattaatgaaaaggaatacgaagagtggtttatggatgggatgagaaggaagccagtgagtactgagaaggtgacccctagggatttggcctggaatggcaagagctcagacatgtcagaggaagaaatttttttttttttgagacggagtcttgctctgtcgccaggctggagtgcagtggcgcgatctcggcacactgcaagctccgcctcccgggttcacgccattcttctgcctcagccgcctgagtagctgggactataggtgcccgccaccatgcccagctaatttttgtatttttactagagacggggtttcaccatgttggccaggatggtctcgctctcttgacctcgtgatccacccaccttagcctcccaaagttgtggtattacaggcatgagccactgcacctggcccaagaggaagaaattaatggtcagctggacatgggatgaaagaggagctaatgaaaagatgatccaaagtcgtcaggcccaaatggtggagacatgcccagtggcacaaaagtgtggtggagagttgctttttgtgtgtgtgaagagaggaggatgggcacggtgatggacacattgagcttgtagcagtagggcatcaaagtagaaatagcatgtaatatcttttatctctattgaattatttttgaaaataagtaaacaacagtactattgtctggaaaacagttgctgttgtttagtgctgtgtgcccgattggcaatgcgggcatgtggtagagttattttattttatttttattttttgagatggagtctcattctctcgcccaggctggagtgcagtggcgcgatctcggctcactgcaagctccgcctcccgggttcaagcgattctcctgcctcagcctcccgagtagctgggactataggcgtgtgccaccatgcctggctaattttttgtatttttagtagagacgaggtttcaccgtgttagccaggctggtctcaatctcctgaccttgtgatctgcctgccttggactcccaaagtgctgggattacaggcgtgagccaccaggcccggccggagttacttttattaagcaacaggggtcctctttgcttaaaattcaacaacaggacatgtgctttgttgcaagggtagatttaggttagtcatgatgaccttcctcagtctactacaggcaagttctttaaactctgagtttctttatgaaatgaggatgatgatagtgcttacttatacagttgctctaggattaagtgaaatactacaagtaaagcatttggtgtggggcttggcatctagtaagaataatgatagcataaaatttctagaacagatttcaaagagatgctacaataccttctatttctagggtatttctagagatacttcaggaaaaaggagcacccgtcttggatagttgggttcgggctaatgattttgattgcagcacaagaaaaataattaaccttcagaaatgggcctgcatctatgacaataagcagcatctaaaaaagtcataaattgtttcagaaggtgatttagcctatggaatagtttgatgttggttatctcttttggatactttagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggttggtgatttgataaaagaacaagaagaaagaataaacaattaatggtccaggatactctagtacttcagaatacacctatctaggtcagaattgtatgatgaatacattttctgtctgctaatgtgtcctgcataatcacattttatatcatgtattcttaacgctgatataaacaaatatataattttaaatgaaattttaataattaaaattatatcttatgggaatttaattaagcatatgcttgttttttttaccctgagattttttgcttacatcctttctcacagaatgtggtcacttcagtggctgatcctgaaaatgaaaaaccaaaccccctctgctgtgtctaccctgagagtcacacattggctgacacccgttctttcctttagagcttctttttatctttagctcattttgtcaaacctctttccccattatctttctccatattggcgcataatataattagaaatagtcctggcttctgatggactcttcttcatttcattttcccagtgatccctaccagcaccatggctgccatgtcaccagcctccaccacaccagccagcttccaccatgtgtctgctctgaccttggacattcttagggcaaagcctatttctttggaactggaattcattcatgcttctactatcagtaaaaattcatccatatgtttacatttatttgtggtttttaaacctgttatatcggattgcaacctaaacctaaatttggacctaacttgcagggaaaaaaagaataaaatgagcttttctttcactgtttaaagaaagcacagattctagatttttgataagtcttttagctcttaactttatccttgtactaagaagccaattcaatctctcctgggttttgtgggaggaaaattggcagcacataccttgagactccaaaaagctgcacacttttatttatttattggcaaagagaaaacatttatttaactcagatgattttcttgctttaattaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcacttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtcc

SEQ ID NO: 37963 - DNA, 20544 bp, Homo sapiens; identical to SEQ ID NO: 36418

SEQ ID NO: 37964 - DNA, 283882 bp, Homo sapiens; identical to SEQ ID NO: 37514

SEQ ID NO: 37965 - DNA, 305113 bp, Homo sapiens; identical to SEQ ID NO: 37240

SEQ ID NO: 37966 - DNA, 305113 bp, Homo sapiens; identical to SEQ ID NO: 37240

SEQ ID NO: 37967 - DNA, 1656406 bp, Homo sapiens
  misc_feature (1480641)..(1530640): n is a, c, g, or t
caggcggcccgcggggcggcggcgggaggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgtgagtacgggcgggcctggctgcagctgcgcgggcggttactttgtggccacccaaggatactgtggctgcgggcgggcccgggaagcacctgttgggcgtccgggcgggcgggggcgcgagcagggcgggcctgtgacttttttgttccgttttggattttgatttgttgatattgggctcactccgttttggcacagacaacaacgcctaatctttgattcccccgccgtttcttctctccacctcccccgctgtccctcttctcccgccccgccgtgaaaagatagggaaaatggacaagatccctgatttttggattttccttccttaaaaaatacagcctcaactgggcaaggaaatgagggcaaaagaggtctcctaggaatgtttatcagaaaggcggaaaagcttttcaagtagccacataaagatcatgactaaaatggagcgtcctcggtatttaccacttgtggcataggtttcgttaacagagattgcaaaagcctgagcttcagagatctaaacagggtccgcctcccccatgcttggctctgattgacatctttgatgtccaaattatgtgctgaattctaaggatggaaaaaaggctgagattctattttaggcagataatgaacatggaagacatcaatttccccgccccacgctttttctgttccgttgcatttcttcttcctctatctaaaacatacccaccttaacctgatgtttcctttgctaagaatgttattcttcccacccaccagcccctgacactcctaattccctactcaggtcccaagactaggtttaccaccactggggagactttccaggcacctcacctgagcaagctatagatgtgacaaatgtttgctgagcccctgccaggtgccaggagctgtgcttaatcctgatgtcattttgtcttacaatcatgcactggtccccctcagggctcttgcgaggcaatggtagtggcatgtttgaggaataagaggatctccaggaccttcatggtgtttcctcttgggccctacagggtagagtctcatctacttgtgggaacccctacgggttgggcccatattgagcatttatataataactgagcgctcttaattaccaatctgagcaatagtcttcttttaaaataacttcttattttggaaaaactttaaatttacataaaggttgcaaagatagtacagacaatcccaatatatcctacacccagtgctccctatccttaccccatcctacactgctgtggtacacttgccaatatgaaaaacacctgggtgcattcttgtcactaaactgtgggtattaagccttttcacctttgaatcactgtaatttataaagccatttctctgtttgtttctttgtttgagacagggtctcactcttgctcaggatggagtgcagtggcacaaacacgactcactgcaacctccacatcctgagcccaagtgatcctcttgcctcagcctcccatgtagctaggactacaggtgcacaccaccatgactggttaactttacatttttttttgtagagactggggtctcacttaatgtttcccaggctggtcttgaactcctaggctcaagtgatccacctgcctcagcctcctgaagtgttgggattacaggcttgagctgctatacctcaccataaagctattttctttaggttgagagcagtgttcctctaacatctgttcttgattcttgcctgtcttcactaagttccaccagcacctgtgtcaaggggcagggatgcaggaaaagggaaagaggctaccctataggttttttccttttttctttctttttttgttggtttgttttggtttgtttatttcaacaaacaaattggttttttgagacaaggtctcattctgtcacccaggctggagtataatggcactgtctccactcactgcagcctcaacctcctaggttcaagccatccacctgccttctgagtagctggaaacacaggcacacaccaccatacccagctaattttttgatttttctgtagagacaggatctcactctgttgctggtctcaaactcctgagctgaagcgatcctccccccttgcctcccaaagtgctgagattataggtgtgagccaccacccccagttagttttgttttgttactttatttgtttattttttgagacagagtctcgctctgtctcacccaggctggagtgcagtggcatgatctcggctcactgcagcctccacctccagggttaagcgattctcctgtctcagcctcccgagtagctgggattacaggcatgtgccaccacacccagctaattttgtatttttagtagagacagggtttcaccatgttgcccaggctggtctcaaactcttgacctcagatgatctgccacccctcagcctcccaaagtggtgggattacaggtgtaagccacagtgcccagccttgttttgttatattagagagacagagtcttgctttgtcactcaagcctggggtacagtggcacaatcatagctcactgcagcctcaacctcttgggctcaagcaatcctacagcctcagccttctgagtagctgggactgtgggtgtgcaccaccatgcccagctatataaaaaaaaaattttttttggtagatatgaggtttggggttctcactgtgttgcccaggttgatctcaaactcctggcctcaagtgatcctccagtctcagcctcccgatgtgttgggatttacaggtgtgagcccagcctaccttgcagtttgtttgtttgtttttgttgttgttgttatttttgagacagagtcccactctgtcgccaggctggagtgcagtggcgtgatctcggctcagtgcagcctccgcctcccgggttcaagcgattctcctgtctcagcctcctgagtagctgggactacaggcacccgccacaacagccagctaatttttgtatttttaatagagacggggtttcaccaggttggccaggatggcctcaatctcctgacctcaagtgatccgcctgcctcggcctcccaaagtgctgggattacaggcgtgagccaccgcgcctggccaaccctgtagttttaacatatttgtctccatggaagactaataaacaaaattgttttgaatatgaagaagcaatagaagcccccctgctttcaaactgttctgtgatgcttttcattagagttaaatgaagttgacgtaaatgtttttaagtagttagatctaataatcagtgaaagctctagggagtgggaattttgacaagagatttgagcggaggttgaagaaagttctcaatagccaagacatagagggctaagggtttttggagcaagcagtgcgagatagattcaggaaagaagtcaagagggtgaaatcgattccgccagcaaatgccaggacgttacacctgctatacagatgctgagtaccaaaaacctgttggcaggtgagagtaaaatggaaatcctggagccaaccactgttgcccacaccccagaaaggggttaggagccgttattcaccccattgctcagtaggccctctggcacctgcagggccttgggccggggccgggattcctggtggggcttgtgaggtgcttgctgagcccctgccgtcctgtaacagtgacacatgctcctgccgtaaggccctggtcagacacctaaactgtgcccaaggatcatcccccttaacatctcatgtgactctgactgccctgtaaattgcacgttaccccactttacaaagaaggtagcagaacttggcttcaggtcccagagccaacaaacacgtggcacattttgcatcaaagcctgggaagcctctcaaagcaagtcagaccctctttcacctttgtcctgggggtgatgacatccctgttgccaaacctcacctactccctccctcgtggtgccacctgccttctcagcagcattggcatatacccccgccacccaaacgcttccccctcaccttttctggttcctctttgtgtatctgtttttttttttttttttccccccttctcttgccccaagacagggcctttaatgtctgatgagactttatttagcatgagggtaaataaagtagtttttaagattctcaacctcttttcttctatctcaatccagtcttctgggtgtggtacccactctttcaacctaacaaggctagtgttgcacatagttcctacacctccccttttctttcttttttttttttgacacagggtctcactctgtcatccaggctggagtgcagtggcgatcacctcagcctcccgagtagctgggacgacaggcacgtgccaccacacctggttaatttttaaatttttttttagagacgggttttcgccatgttgcccaggctggtctcgaactcctgacctcagatgatcctcccaccttggcctcttaaagtgctgggattacaggcatgagtcaccatgcacagccccctcttcttgttgttagcaagaaagcacctctactgggatgtgtcccagggccttggttgtgggaaactttgttactaatggtagaaaaaaaaatgtagtacaggttctttgaaaagaagcgctcagtacaagcacattatcagtagtctcaggagaggtggtagaggtagtacttgagcacaggtgggaggagagatggaggagagagcctggagggccgaggcacctggggccactgggcaatggaggagccaggccccttgggttccccagagagcaggggctggtggggagtctacagagggccatggagctttgtctcagggcagccatataggtggtttgatgctgtcagtgagtcccattgtgcacctaggctgcagttcctgaaatgtggaggggagcttttcctcctgtaatgcaagtagggaggaagtggatgtgtgtggatggaagctggaattgccaaaggcaaattgtacccatgctgttgccctttgttgtaaatttttccagacctttccacacctgtgacttcatgtactatgtgagagtttgaatagtcagtgtgggccagatgctgtagctcacgcctgtaatcccaacactttgggaggccaaggcgggtggatcacttgaggtcaggagttcaaggcaagcctggccaacatggtgaaaccccatctctactaaaaatacaaacttagccaggcatggtgggaggtgcctgtagtcccagctatttgggagactgaggcacaagaattgcttgaatccaggaggcggaggctgcagtgagccaagatcgtgctactgcactccagcctgggagacagagcgagactctggaagccccatgatggaaatgtccctgatgtgtgtttatcagtgcatttggccagtctcttttggttaaactttgttgttgttgttgcttttgttgagaaggagtctcgctctgttgcccaggctggagtacagtggcacaatcttggctcaccacaacctctgcctcccgggttcaagcagttctcccgcctcagcctccctagtagctgagactaaaggtgcccaccaccacaccgagctaatttttgtatttttagtagagacgaggtttcaccatgttggttggccaggctggtctcgatctccagacctcaggtgatctgcccatctcggcctcctaaagtgctgggattacagatgtgagccaccgtgctagcctctattggttaaacttgaggtggtttctaatcttttattacaggcagtattattataggatgatattttgttatttcaggtaataactgcttttatccagttattttgcacatgtgcatcagccaaaggtgaactccccagatgaacccccatccagggctgtgctcctaggaatgttgtgggtgttgccaaatggctggatcacagagcaccttcaccagtggtgttgtcaacttcttaaatttttaaatttaatttattatttgtagagactgtctcgctctgtcgcccagcctggagtgcagtggtgtgatcatggctcacagcaaccttgacctcctggcctcaagtgatcctcccatctcagcctcccaagtagctgggactacaggtgcacacccagctcatttttttttttttttttagagatgggggtcttgctgtgttggccaggctgatcttgaactcctggcctcaagtaatcttcccaccttggcctcccaaaacactgggattacaggcatgggccacccctgaccttatcaactttttttttgagataagatcgtactctgtcaccaatgctggagtgcagtggtgtgatctcggctcactgcaacctctccctcctgggcctaagtgattctcctgccttagccttccaagtagctggcaccacagtcatgcaccaccatgcccggctaattttttttttttttcttcaggatggagttttgctcttgttgcccaggctggagtacaatggcgcaatctcagctaactgcaatctctgcctcctgggttcaagcaattctcctgcctcagcctcccaagtagctggcattacaggcacacaccaccatgcccggctaatttttgtatttttagtagagatggggtttcaccatgttggccaggctggtctagaactcctgacttcaggtgatccacccgcctcggcctcccaaagtgctgggattacaggcgtgagccagtgtgcctgggcttttgtatttttttgtagagacggggtttcaccatgttgcccaagctggtctcaaactcctggactcaagcgatgcacccaccttgggttcccaaagtgctgggattacaggtgtgagccaccacgcctggcctaacttttaaaaaaatcattgccaacctgctaagtgttagacagtatgagtgtgccttcagagttgaacatctacttgcatgttccaccttggacaccgtggtccaaggtggggagactctggctttgaatccagcttcacaggtcactggctgtgcaaccttgggtgctcaggtaacctttttggacttcggtttccccatgtgcatcgtggggctaataaggacacgcatctcttagaactgctgttaatcgtgcgattcttgtatggtgagcagtgtaggacagggctggtgttggcttgccaaggctctgggagccgctgcacgtccttttccaggagctggtggttttatccgttgtccattccctccgtgatggcggtggccttttcatctttctaatcccaaggacggtgccttgccagtgaggggtgggagaggcaaagctaaaagcagggaggcctcctccatggagaggaggggaaggaaggggtggccgagtgggagcggaggtggagaagctgtggggacggctggccgggcaggtgacaccaccacctctcaccgctcatccctctcctccctaaagaggtggaccatgatatcctggttccactttctttatgaatcctggctgaacatggcggggccacatgagcactgttccttccccgctctccctggcattctgtccacctggcacaccagccccttcatcgccacgcccagcagacgccccagttctcctccagctttgcagcctctgaccctgacgcactggcttccgtatctgcctgaggcctcctttccatctcgggacaccctggagggctccccggggaagtaatggggatgggacccacactcacctgccaggtggtggcagtgccagggggtaggtggagcagcctggggattgaggggaacaggctgtcctctacacaggtgccccagggatggggcgacgacccagtggggtggttgaaaaagtgaagggggcaccccagtctgcactccatcccatgaagtgtcagaagctgcttggttttgtttgcttcctcagtgtgtttgtctttagaagtgtgctaccggcaccatatggacatgggcctgattcacattctcttaaaataattttacaggcttattttaggagagaaatttctggattccagaaaattgtttttgctctaaaaacataccccacattaatgtctatttggggggatggatggcagctgccctccaaacgtggggacacacagtgtccgagagtggagatgattttcctggtgaattgcccagcattttcctttcagttacttacttcagggtggttccttatttgccaatagatcttgtaaaagcccatttacattggttgtttccaaacttggccatgggttccccagtgcaacagtggatctgtcatttaaagccaagttaaaacttaacatgacatgcctctcagtgaccacaaatacagccctggccactactgccaggacccctttgagggctagtgacaagggttgccatcaggactgagaccacatgaagcgcacgggaggcatctgtgcagtgaccagactcaaggcaggagacagggacagggacttgggggacatttgggacccagggcagcaggctcttcaggtaagattgccttgggggcggggctgtataatgaaggtctccaaataaagcccatgcgaagtgtgcttgggaaacagcaagcctgttttggttggaaacaaggctttttgtaattagcggtgccctcagtgtttactctgcagagccctaggcactctggtccaggaagagttagtagcgtcctctgcatcccactggggatgtgtgacactcagagaaaccacaaggtggaggcgagagctgagatctgagcttgtcgctgcatctgtctgcctcacagctgggaggctcagccagtggcacttgctgtggggacagcccaggtgcaggaaggggccagcaagggagggcagcaggctgggctacagccaccaggggtggtatctccactgagagttacaggctttgagcaaatagagaacagttacagcatggaggaccctggggtaacacaggaccctgatggggacgcaccgcttcctcctgcctggaacactggtggtcagagggtcccctccctcctggggactggactgtcctccgctgatgctcctccctctcaggccaggtgggaccgagagcggagagcacctgtgctctggattgagtacccgcctgtgggactgtggtggccgctagcgggcagggatgcctatttctcaggatgttgtgagaattcaacggcctgagaatttgccgaccctaaggtgcagatgcatgatgtaaagggcaaacgcctgtctttggcaacattcttgtcattctgggggccttgcgcctgaatagatgagattccttcctggaaccttctgggaccagcttggggccacagcaggctgcggctggtccttcctggacagcgctggcagggccctggcttgtgcactgctctttggggaccatggtcctagaccctggggacatgtgggtctgggtgaggtgaatctgcagctgcccgcaccccacggcccctgcccgcagagactccttggtgcccatgggtccatgtttttaacaagcttaccagtgtttagtggccatttctcatatcaagtactgatgtttctttttttggacacggtctcggtctgttgcccaggctggagtgcaggggcaccatcacggctcaccatagcctcgacctccccggcttaagcaatcctccagtttcagcctctggagtagctgggaccacaggcatgtgccaccgtgcccggctatttttttttttttttcctttggtagagacagggtctcactatcttgcctgggctggtctcgaactcctgggctcaagtgatcctcctgccctggcttccaaaagtgctgggatgacaggcgtgagctgctgcacccggccgcagtagtgatgtttcaacccccatttacttttgctgtctccgtgtgaggattcccctgatacatattcattccctagatatttaagtgcctttcaggggccaggacactagtcagtgattttttttctaccatctagatttaataaaaccacccaagtgactttaaaattttatcattttaggctgggcacagtggctcacacctgtaatcccagcactttgggaggccgaggcaggcggataatgaggtcaggagatcgagaccagccgaggcaagatagtgagaccctgtctctaccaaagaatacaaaaaatacaaaaaattagccgggtgtggtggcgggtgcctgtagtcccagctacttgggaggctgaggcaggagaatggcatgaacccgggagatggagcttgcattgagccgagattgcaccactgcactccagcctgggcgacagagtgagactccgtctcaaaaaaaaaaaaaaaaattaccattttagggccaggtatggtggctcatgcctgtaatcccaacactttgtgaggctgaggcaggtgggtcacttgaggtcaggaggtcgagaccagcctggacaacatggtgaaagcccatctttactaaaaaaatataaaattagccgggcatgatggcacatgcctgtaatcccagctacttgggaggctgaggcaggagaatcacttgaacccgggaggcagaggttgcagtgagccgagattgcaccattgcactcgagcctgggcggaaagagcgaaagtccatttcaaaaaaaaaaaagaaagaaaaagtaaaataaaattttattttcttaggctggtgcaatggttcatgcctctaatcccagcactttgggaggccaaggtgggtggatggcccgagccaggagtttgagaccagtctgggcaacatagtgaaaccttgtctctacaaaaaatacagaaatgaaccaagtgtggtggcgcacacctgtcatcccagctacttgggaggctgaggtacaagaatcacttgaacccggaaggcagaggttgcagtgagctgagattatgccactgcactccagcctgggcaacagagtgagaccctgtctcaaaacaaaaacaaaaaaaaaaaaaaagaaaaaaattttttaatgaactatttttttccccccaggatgaggtcttgctttgttacccatgctggagtgcagtggtgcgatcatggctcacagcaacctccatctcccgagttcaagctattctcctgcctcagcctcctgagtagctgggattgcaggtgcccgccaccacgcatggctaattttagtatttttagtagagatggggtttcaccacgttggccaggccggtctcaaactcctgacctcatgatttgcctgccttggcctcccaaagtgctgagattataggtgtgagccaccatgcccagccttaatgaactatttcataattacaaaatactaaattatttaagcagagtgtgatgaggtttgaaggaggtacacggagcctgtgcctgtggaatgttcctgaggtcaagaggaactgctgctgtgctgtccctggagtgggactggggctctgggatgggagactcacttttcactcaatggaagatccttttgccatctcaagacatacatggtacgtacagatgagaaatgaagattaataaaatggacatgtgtatacccaacagcagcttaaaaaataaaatcccaggccaggcgtggtggctcacacctgtaatcccagcactttgggaggccaaggcgggtggatcacctgaggtcaggagttggagaccagcctggccaacatggtgaaaccctgtctctactaaaaatacaaaaaatcagctgggcgtgatgacgtgcacctgtagacccagctactcaggaggcttaggcaggagaatcgtttgaacctgggaggcagaggttgcagtgagtccagcctggggaacagaatgagactccgtctcaaaaaaaaaaaaattaattaaaataaaataaaattccagctaggcacagtggctcacacctgtaatcctagcactttgggaggctgaggtggtggatcacctgaggtcaggagtttgagaccaacctggctaacatggcaaaaccctgtctctcctaaaaatgcaaaaattagctgaatgtaatggcctgcacctgtaatcccagctactctggaggctgaggcaggagaatggcttgaacccaggaggcagagactgcagtgaaccgagatcgcgccactgcactccagcctggatgacagagtgagtgagactctgtttcaaaaaatattaactaaaatcccccaccaggtgcagtgtgcacttctgtagtcccagctacttgggaggttgaggcaggagaatcgcttgaacacaggaggcagaggctgcagtgagccgagatcacgccactgcactccagcctggatgacagagtgagactctgtctcaaaaaaacaattaattaaataaaatcccctgccaggcgcaccactcactgctgtagtcccagcaactcgggaggctgaggtggggagatcgcttgaacccaggagttctgggctgtaatgtgctatgcagttcagttgtccacactaagttaggcatcaatatggtgacctcccaggagcaggggaccaccaggttgcctaaagaggggtgaacaggcctaagttgaaaacaaagcaggtcaaaactcccatgttgatcagtagtggcatcgtgcctgtaaatagccactgcactccagcctgggcagcatatttaaaaaaaaattaattaaaaaaaaataatcccccagaagtcgttgccaccccttcctgcccagggtcctcacttcctgtgctcttactcctaacacaggtgtcctttgtggaaggacaagcgatgtgcaccagtgttggccccagaggttacggactgtggggtgggggcttgcgttttctcccaaaagatgatctgcagttaggcattcatggcatttagaaattcaaaataaacaaaacccttggcaaatggccacttgttttgttttttttttgcccccgagacagagtctcactctgttgcctaggctggaatgcagtggcacgatgtcggctcactgcaatctccgtctcccaggttcgagtgattctcctggctcagccccctgaagtagctgggattacaggcatgcaccaccatgcctggctatttttttgtatttttagtagagacaggtgttttttggttttggggtttttttgagaacgagtctcactctgttgcccaggctggagtgcagtggcgtgatctcggcttactgcaacctccatctccagggttcaagcatttcttctgcctcagcctcccaagtagctgggactacaggcacgtgccaccacatctggctaattttgtatttttagtagagatggggtttcaccatattggccaggctggtcttgaactcctgaccttgtgatctgcctgccttggcctccgaaagtgctgggattacaagcatgagccaccgcgctggccaaatggccactttttgaagtgctttccctgtatgtgtataccatgttctctttatggactactatttagccttaaaaaaagacaagggaattctgtagtaggcaacaacatggatgtaccttgaagacattatgtgctcagtgaaataagccaggtatggacaaacactgcatgattctgcttacatgaggtatctagagaagtcaaattcatggaatcaaacatcaggatggtagctgccaggggcttggtggaggaggaaatgggaatttattaatccacaggcataaagtttcaggtaaggaagatgaacgagccctagagatctgctgtccattgtaccgagagtctacaatgttctgtccacttaaaatgtgttcaggacaaacagcaattaaagaaaaaaaaatgttgggccgggcacagtggctcaggcctgtaatcccagccctttggaaggccaaagcaggtggatcacttgaggtcaggagttggagaccggcctagccaacatggcgaaacctcttctctactaaaaatataaaaattagccagtcatggtgatgtgcacctgtaatccaaactactcaggaggctgaggcaggagaatcgcttgaacccaggaggtggaggttgcagtgagccaagatcacgccactgtactccagcctgagtgacagaacgagactctgtctcaaaaaaaaaaaaaaaagaaaaaaaggctgggcatggtggctcactgctgtaatctcagcactttgggaggctgcggcgggcagatcacgaggtcaggagatttagaccatcctggctaacatggtgaaacctcatctctactaaaaatacacacaaaaaaaattagccgggcgtggtggcacacgcctgtaatcccagctactcaggaggctgaggcttgaacccaggaggcggaggttgcactgagctgagattgtgccactgcactccagcctgggcaacagtgcgagactctgtcctcccctcccccccccaaaaaacccaaaatgttggccaggtacagtggctcacacctgtaatcccagcactttgggaggctgaggcagacagatcacttgaggccaggagtttgagaccagcctggccaacatggtgaaacaccatctctactaaaaatacaaaaaaattagctgggtgtggtggtgtgcacctgtagtcccagctactctggtggctgaggcaggagaattgcttgaacccagaaggcagggtttgcagtaagctgagatcacaccactgcactccagtctgagtgacagagcaagactctcaaaaaaaaaaaaaaaaacaaaatcggccaggcatggtggctcatgcctataatcccagcactttgggaagccgtggtgggtgggaggccaaggcgggtggatcatgtgaggtcaggagtttgagaccagcctggccaacatggtgaagccccatctctactaaaaatacaaaattagctgggcatggtggtgcatgcctgtaggcccagctactcaggaggctgaggcaggaaaattgcttgaacccaggaggtggaggctgcagtgagtcgaaatcatgccattgcactccagcctgggtgacagagtgagactgtctcaaaaaatcgcagtcaggtgtggtggctgatgcctgtaatcccagcactttgggaggctggggcggttagatcacttgaacccaggcgtttgagaccagcttgggtaacaaagtgagaccccatctctacaacaaaaaaattagccaggcgtggtggcatgggcctgtagtgtcagctacttgggaggctgagctgggaggattgcttgagcccaggaggtcaaggctgcagtgagctgtgtgaccatgccactgcactccggcctcggcaacagactgagaccttgtctcacacacaaaaaagtgatactgctttttttttttttttttttttgatacagagtctcgctctgtcacccaggctagagtgcattggtgctatgtcagttcactgcaacctctgcctcccaggttcaagtgattctcctgcctcagcctcccaagtagctgggattacaggcactcaccaccacgcctggctaatttttttttttttttttgagatggagtctcgctctgtcacccacgctggagtgcagtggtgcgatcttggctccctgcaacctccgccccccaggttcaaacgattctcccacctcagcctcctgagtagctgggattacaggtgcgctgtaatttttgtatttttagtagagacgggtttcaccatcttggccaggctggtcttgaactcctgacctcatgatccacccgcctgggcctcccaaagtgctgggattccaggcgtgagccaccgcgtccggccgcctggctaatttttgtattttcaatagagacggggtttcgccatgttgtccagactggtctcgagctcctgacctcaagtgatcctcctgcctcaccctcccaaagtgttgggattacaggcataagtcaccgcccctggctgatactacttattttaaaatgatgaacaaagtgaagggcagtttctgtagctctctacttgagtcacttggagcagggattctgaacgctagagacctgaatacccagtttgtgaataagtttcctgtctctctcttagctgcttcacttcatattcttagtatctttgttaaagggaagtccagggaaagaagagagaaatgaaagtttattaatttaagtctcattttagtaacaagaaacttagttgaaaatatcacagagattgaacatgagttcagtaagaagtgaagtcagaacgcttccttccatgaactggtgcaacatgcatggatttgaatgagctactgacaagttgtcacatgacatcctcgtgcaccgtgtgggacatgtggacaggagagcagaggtggaagtggtgctgggctcctggagggtggtggccgagctgatacctgtccccatgacctccccagggcatgtcagcaagtttcatggaagagatgccagatggaagagatggcagggttcagattcatgaagggcccagtagttcagggcaatagataagatctaataaaatgtactgtgttaacgctaaatgtgaggtcttcttgattctaagaaacccaagagaaaatttcaggattggcacaagatgacttaatagcagctagtaagaaaaagagtttaaggtttggggaaatcacccatcaggaatatccaatataggcagactttttcagaaattctttaacataatattggagaaagaaatggacttcatttagaagatggtgtgtgtgtgtgtgtgtgtgtatttacacgtgtatacctttgtacagaaatttcctccacaaaattcctgctagatgaagtcatctctgttgataaatgtgatgaactgttgattttgttaatgaaatcggattcagcttggtttctcttctcctgcagatgtgcttggtccagcagtattcccctgggaactgttctccaggcgctgcagagctcctctgtgctgtctgtatccacctgtggtctgtttccgggctctctttcatgtcacattgacctgtttttgtatcttatgccagtcttttttcttttatttatttatttatattattatttttttttgatggagcctcgctctgttgcccaggctggagtgcagtggtgcgatctcagctcactgcaagctccacctcctgagttcacgccattctcctgcctcagcctcccaagtagctgggactacaggtgcccaccaccacgccccactaattttttttgtatttttagtagagatggggtttcattgtgttagccaggatggtctccatctcctgacctcatgatccacccgccttggcctcccaaagtgctgggattacaggcatgagccactgcacccagactcagactctttgttgttgttgttgttgttttgtttttgtttttttttttttttgagacagagtctcactcattacctaggctaagtccagtggcacaatctctgctcattgcagcctcgaccccttgggctcaagcaatcctcccacttcagcctccctagtagctgggaccacagacacgtgacgccacacttggctaattgaaaaacactttttttgcgtagagacagggtctcactgttgcacaggctggtctcaaactcctgggctcaagcaatcctcctgccttggcctcccaaagtgctgggatgacaagtgtgagccactatgtccagcctttgccccacttcttgaaagatattttcactgaatgtaaaatctgagatatcagttattatctttcagaatcataattgtccctttctctgctgccttttgggctcttgttttacctgggagcttgttctgttgaacaggtcatttttccttcctctggacacttttaagacttttttcccctttatctttggtgttttgcagtttcattatttgtctagctgtggctttatttttatttatcctgctttaggactgttgggctttttaagtctgtggattagtagcttttccttaattctggagaatccacaatcatcaattattcacaaagcgcctctaccccattttcttcttgcctcaaccttctgaaatccaaataaatgtcatctctccctgcttcacatctcttagtttaagactcatatttccaccttcctcactgtttttttgttttttttttttttttgagacggactattgctctgttacccaaggctggagtgcagtggcgcaatctcagctcactgcaacctccgcctcccgggttcaagcaactctcctgcctcagcctcctgagtagctgagactacaggcagacaccaccacgcccggctaatttttgtatttttagtagagacggggtttcaccgtgttggccaggctggtctcgaactcctgaccttgtgatccgccccccgcccccccagccccggcctcccaaagtgctgggattacaggcgtgagccagcgcgcccggcctctcgctcttctttattcagcataatttattctgacgtatcttcagtgtaggtattctctttttattctcctattcctgttaaacccattgggctgaatgctgtttatttctagaatgtctacacctgtttttctgcaaggtcattttttttctcgtttgctgttggttacatatactctcaagctcatcggttccctccgtgagtacaggtaagtggaggagcctcatggtctgcctcaggtctttgagatgttgagtctctggatctggtcctgctgctggccttttctgtccttgctcatggggcattgtttctgtgaatgtgtggttacttttgactgcattactcattgtcctggaaaaatgactttgtgggaatttttcagatctaggataaagatgcttcctccaaactaggtttacgcttccttctgccaggtacctcagggcgctgtcagcctaaagccaatttaaactaaatccatcaactgtgagcttttggaatcttctcactggtgtgaatttgggccataagtcctgtgagggctgtcctatgatcactgctctgtggggtggggaccagccttagagttctcatcggaagcccggggtggctggatgggggcagatgttttcagggcaagagcggcttggctcgcctctctggtttctggtttccccagatggtgcctggcggctcctcactgtcttgtcagcccctggatgcctttaagaaaacatccttttattttgtcagcatttttggtacttctcagtgggagggctggtccaagtatttggcttatcatagttttacaaaaagttggtttctatgaaatcttaagtcacctcttttttaaaaatgtaacttttagtctgggcgcggtggctcactcctgtaatcccagcactctgggaagccggggcaggcagatcacttgaggccaggaatttgagaccagcctggacaacatggtgaaaccccatctctactaaaaatacaaaaattagtcaggtgtagggccaggcgcagtggctcacgcctgtaatcccagcactttgggaggccaaggcaggtggatcaactcaggttgggagtttgagaccagcctgaccaacatggagaaaccccgtctttactaaaaatacaaaattagctgggtgtggtggcgcatgcctgtaatcccagtgctcgtgaggctgagacaggagaatcacttgaacccgggaggtggaggttgtggtgagccaagatcgtgccattgcactccagcctgggcaataagagcgaaactctgtctcaaaaaaaaaaaaaaaaaaagaaaagaaaaagaaaaattaggtgtggtggcacgtgccagtagtcccagctactcaggaggctgaggcaggagaatcacttgaacccgggaggcggaggttgcagtgagcgcagatggtgccatcgcactccagcctgggcgacagagattccatctcaaaaaaataaaaaaaataaaaaatctaccttttatgttttttatttgaactatacatagtaagcagcgtggggtttttttgtttgtttgtttgttgttgttgttttttcttgagatggagtctcactctgtctccaggctggagtgcagtggtgcaatctcggctcactgcagcctccgcctcccgggttcaagtgattctcctgcttcagcctcccgagtagctggtactacaggcgcacgccaccacgcccagctaatatttgtatttttaatagagacggggttttcaccatgttggccaggatggtctcgaactcctgacctggcgatctgcccgcctcagcctcccaaagtgctgggattacagatgtgagccaccacacccagccttaatagtttttttgtctagttacactttttcttttagagaacttgaaacccattaatgcacatgtacatacataatccacacatatatgtatatgtatgtgtgtgtgtgtatatggcatatccatttatccacatactatacatacatgccttacactatagtttcctgaagcttacatcacaggcacagtcatgtccacattccagtaatgcttatcattccacgaccgatatggcttaatgtatgctttagttttcagaatatatcacttactcctacgaatcagtaaggaaaggaccagcagctaatagaaaatgtgacaaagatttgaaaaggaggaatcataaaaggtgcccacctgtatggtcaggttgaagcaaattaaagccacaatgagatgctgctgccttatacctgccaggcagcagaagtgttaaaatttgaccatatcaagttggcgggataaagatcagcagggactcatgttcgctgctggcaggatgaccttgtcaccggcacttgggaggtgctgctgtgtgcacgggcatctgctcctgggattgttccaacgaaacacctgcctgtgcggctcaggagaggtgacagcgacagcagcaccatttagtagccagcctgggagccgatacacatccacaccccgtcagtggctgcatgcagtgtatctgacgggacaccaggtgaagggggcccagctgcacatggggacagaggcagacttggctgcacgtcagcagagaagtctcacagcatcgtcggtgtcaagttcaaaacacggaacacgcagcagtgtggctcagggccacacacggggcacagccatcaggacaagcaaagaccaagaagcaccaagtccaagttaggcagcatctcaggccggggcaccaaggaagggcacagcagcgccgtggtgaccgggtcccagtaccatcctgggtggccgccaccggccgtttgtgtcttccgttcacacgattacaaacgctgcgttctgcccacacacatcttcagtcccagatgtgagaaggtgaccctctaatgcaggcgtgcctgcgcaggtggggggcagacgccgtcctgggtgtcatcccatggaagggcacaggacaggctgctgccggagcagaggtcacatggggtggggggcggtggggggtgcatctcaggaggagcaggtgtgaggacactgctggcgcttggctcttcttcccagccccgtgctctcgaatttggggaaacccttgctcttctgtttggcctgaaagaaaatccggtgtgcctgactctctgcaggccccttgtcacaggccaggctggggtggtgccaccaggaaaacttggcgcacgtcctgttgctgatgatggcagcatcagtcatggacttaaccttcttttgttaatgagaccttagaaatgtaaaaatgatacactcttctttaaaataattgtagtcagtacacataactcttaccatcttaaccatttctaagtgtacagttcagtgacattaaatatattcacatttttgtacagccatcgccaccctccaacctccagaattcttcatgttgcaaaactgaaacactgcacccatgaagcggggactcccctgcccctggcagctctttctgtctctgagtcccactactctaagtacctcatacaatatttgtcctttgtgactggcttacttcactgagcatagtgtcctcagggttcctccatgctgtagctgtgacaggagccccctcctgttaaaggctggataacattccactgtatgcagacgccacattttgatcatgagaatgcccgtttgtggagggacacactgttgcttccccctcgtggctgttgtggataatgtcgctgtgagcatgggtgtgcagacatggctttgagaccctgttttcagttctcgtggatttatacccagcagtggaattgctggagcccatggtaattctatatttcgttttttgaggaattaccatactgtttcccatagtgcctccagcattttacatttttaccctcaatgcacaaggctccaattcctccacatcctcaccaacgcttattttccgtgtgtgcgcgttgatagtagccgtcctagagggtgtgtggtggtgtctcaacgtggtccttgtctgcctccctcaggatcagtgacatggagcaccttttcacgtgcttgtgggccatctgtatatcttcttcggagaaatgtttatataagtcctttgtccatttttaatcagattggggttgttttgttgagttgtaggagtttcttaaatatattctaataactatatagaatatagatatataggtcctttgtccattttttaatcagattgtgtttctttttgctgagttttttttaacatattctaacaactagaatatatagagaatatagatacataggtcctttatccattttccttttttttttttttttgagatgtagtctcactctgtcgcccaggctggagtgcagtgatatggtctcggctcactgcaaccgctgcctcctgggttcaagcaattctgctgcctcggcctcccaagtagctgggactacaagcacccgccaccacgcccggctaattttttgtatttttagtagagacggggtttcgccatgttgactagggtggtctcgatctcctgacctagtgatccaccttcttcggcctcccataatgctgggattacaggcgtgagccaccacgccgggcccatacccggccctttatccattttttaacctgtttgtttgatttgctgagttgtagttgttttttttttttttttttacatattccaataactaggatatatagagaatatggatatatagagaatatgtatagagagaatatagaatatatgtattctagatattaacaccttatcaggtatatgatttaaaaatattttccctcattctctgggttgcctctgttgatagtatcctttgaagcacaaaagtttttatttatttatttagagacagggtttcactctgttgctcaggctggagtgcagttggacgatctcagctcacttgagcctcaacttcccaggctcaagccatcctcccacctcagctatcccaagtagctgggaccacaggcacagggaccacacccagctaattttgtgtatttttagttgagatgaggtattgctttgttgcccaggctggttttgagttcctgggctcaagtggtccacccacctcagcctcccaaagtgctgggaccacaggcgtgagcactgcaccgagccagaagttttgaatttttacgaagtctaatgtgtctgtttttcttttgctgcccatgcttttggtatcgtatccaagagatgattgccacatccaatgtcatgaagcttttcccctgtgtttccttctaagagttttatagtcttagctctcacatttaggtcttttattttgagttaatttgtatacggtgttaggtaagagtccaactttatatttttgcaggtggatatccagttgttgtgacaccatttgttgaaagactgtcctttccccattgaatggtcttgacaccctgttgaagatcatgtgaccatacataagggtttatttcaggactggaatttcttaaagattaaataatactggatccatcactcacattcctcaatgtcctggtgctctgcgtggtgaattcccggattcggggtggggtgcatccagccctgccaccgggcccactcaccgggcgtcttggttctgcctctcctttcatgtttccaaagccaaacctggtataagaagaatttgaatcaatgtttttctcaaattatttgcatgtaaaaggagttcattttttcacttccaactaaatgtaaagtggttaagcagtggcatggtgtcagtgttcattttgtctacaattgatactaaagagttggatcttggtcaggcgcagtggtgcttgtaatcccagcactttgggaggccaggcttggtggcgtgttcctgtaatcccagctactcagaggctgaggtagaagaatcgcttgaacccaggaggaggaggttgcagcgagctgagattgcgccactgcactccagcctgggcaacagagtgagactccatctcaaaaaaaaaaaaaaattctagtcctgccacccccccaccccgcgtgttgcttcacaacacatgaatcccatatgtacctgcttcacacgcatgttctctctgtaacccaccactttgtctgattggttggcaggttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaaggcaagtggcttatgccaaaaaattgatggcacaatgattatctgtcattgtggtacctacatagtggaagaatatttaagcatcacatgacttcctgagtctgctgtgtcctgaacgtctagagccttctaggcagcattggtgagcgttttgtgcatggttaagtgtggctgtgccacgatctcagatgtgatcctggcatggtgggcggttttccagggccaggcagctggcactcccagggattacgaggggcaaggtgaatcacttgttactcacagcagaaagccagagaggactgaatgagcaaaagaagtctagaaaaatctgtggaaatggtttaataataagggtattaagacattttaaaaactcagcatggttaagaaggaaaggggttgctcagaaaaatgccccagagggtgtggctgcgtttgtcggttgtgtaggagccctgggtgaagctctggctggtctctgtgcatagaacccatgagcagccttgaagatgtaaacaagatcccctggcccctccttactgtgctgagctcctcattagcagtgtgtggcgttgatcatcaaccagttgtgaacatttaaacaggccaaacatcatggaggagctgatgctcagtcggaatgacagtgttctccacccatcctcaggtcatgacatccccccagcctcaggtcatgaactccccgcatcctcatacgtcatgaccaccgatcctcaggtcatgacctcccacatcctcacaggtcatgacctcccccatgctcaattcatgacttgcacccatcctcacggatcattacctccactcatccttataggtcatgacctccccccatcctcacaggccatgacctccccccatcctcaggtcatgacgtctccccatcttcacaggtcacgaccactttgggaacaaagtttgtcaggaagttgtgcctttcagaaatcttttcttctttttttaaataggtattttatttacttttattttttcttgtagagacagggttttaccatgttgccaaggctggtcttgtactcctggcctcaagcgatcctcctgccttggcctcccaaagtgctgggattataggtgtgagtcaccacgcccagccaggaatctcttaggtttcctgtttaactcaagagaagaacatttacctgcttgtattttcagtaggtaatagtgagaggctcctcatttctgttcatcatctgagatagaaactgttgaacgaggcagagtttctgctctctcattgcctctggggctcctgtgtgcactgggaagtgtgaggtgagaagtggaaggagccaggcaccccatttcctcggtgttttctgaggtaggcttagtgtgtaaaatgacatgaggtaatgagaggcggagctgctctgggcccctgggtaggggcagtgaagcttgtggccttgtggagccccgtgacacctgtgtgttggccatgacctaagcaggtgacctgagcactgagaggtggtcaatgtccggccccatgcatggttttgtttcggaagcatgccaggtgtgttccttgctacatggtcaaaaggaatttgagatgcttctgttgaacagcctggaggtcatcaatgagctgttttaaaaattgtatcagctgggcgtggtggctcacccctgtaatcccagcactttgggagaccgaggtgggcggatcacttgaggtcaggagtttgagaccagaccagcctgaccaacatggagaaaccccgtctctactaaaaaaaatacaaaattagccgggtgtggtggcacatgcctgtaatcccagctacttgggaggctgaggcaggagaatcgtttgaacctgggaggcggaggttgcagtgagtcgagatcgcgccattgcactccagcctgggcaacaagagcgaaactctgtcttaaaaaaaaaaaaaaaaaaaaaaattgtatcaagaatagaagcctggctgggcttggtggcttacacctgtaatcccagaactttggaaggccaagatgggtggatcacttgaggtcaggagttcaagaccagcatggccaacatggtaaaacactgtctctattaataaagtacaaaaaaattagctgggcatggtggcacacacctgtaatcccagctatttgggagactgagacatgagaattgcttcaacctgggaggcagaggttgcagtgagctgagatcacaccactgcactccagcctgggtgacagagtaagactctgtctcaaaaaaaaaaaaaaaaaaaaaaggcagaagcctgctcagaagtcatttggtgccaaatgagcatttcaggatgaaaaaaagtgctgagaactaagctctctgagcacacaggccaccaggaaggatcagacctcgtgcctccatgggtgatgggccgggcgaggtggcaagatgacgactagagtgagcttttctcccttccgtggtgattctgatgaggattcattgagaccatcgagaacacctgccacgcagaacagaatccagtacctgcgaggcgagaggcactgtcttcacagcctctaagtttgtatttgtcactaacaaggaatcccctggctcgagggagcctgttgctgctgtaggcagctctggttactagaaggctccatttagttagcaaactctgatctgtggtccaaatctgccacaccacctgtttatgcaaagttttaatagatcacagctgtgctcatctgtttacagagtaattagaacagggaccatatgtcctccaaagcctaaactacttatctcctggccctaatttacaggaggagtttgctggcgccaactctgataagacagctctgaatctgaatcacagagctgctcttgtctctgagccaaaccctatttaaaaataaggactttcagagtaggtgagaattaggaaattcagtccagaatattgaagactgatgaggatgtgggaaaagtctataagatgattattagttaaactgaacatagaataatattcctaatcccagaatgccacttaagggaatactcatttttaagcctgaatgctgaggaaaaagagcctccccagatctcaacagcttaaaacacaggtttagttcatgctcaggtgagaagtctaccagggacaactgggggctcttgttttttgttgttgctgttgttgttgtttgagatggagccttgctttgtcgcccaggctagagtgcagtggtgccatctccactcactgcaacctctgtctcccgggttcaagcaagtcttctgtctcagccttctgagtagctgggactacaggtgtgcgccaccacaccaggctaattttttgtatttttagtagagggggtttcaccatgttgtccaggctggtctcgaactcctggcctcaagtgatcctcccactttggcctccgaaagtgctgggattataggcatgaggcactgtgccaggtccttttaattttttttaaattatataatattgcacataatcacattaaaataatgtgtatgtgtaaacgaggagacttgcttcttcctcctgccttgtccggctccattccttggagatgtcactgttagtagtttggcatctgttgtctttattttgttttaatagaaacacatttttcactttaaataaagggctcaaatgacactcactttacagctaacttttcctcacttagtattttatgacttttatgactatttttatttttatttatttatttatttatttttagacagggcttctcctgtcacccaggctggagtacaatggcataatctcagctcactgcaacctccacctctcgtgctcaagcgattctcctgcctcagcctcccaagtagctgggagtacaggctcacagccaccatgccctgctaatttttatattttttgtagggacagggttttgccatgttgcctagcctggtcttgaactcctgacctcaggtgatccacccaccctggcctctcaaagtgctgggattacagccatggtgcctagcctatgactgtttttccatatctgctcctaccttcccatcccctgcatgaggcccatatgcggatgcagttgcttactcacttatggatgagtacctgacttccaggttaaatttttttttcttttttttttttttgtgagacggagcctgactcggtagcccagtctggagtgcagtggcgcgatctcggctcactgcaacctctgcctcccgggtcccggttcaagcaattctcctgcctcagcctcctgagtagctgggattataggcacgcaccaccatgcccagctaatttttgtatttttagtagggacggggtttcaccatgttggccaggctggtcttgaactcctgaacttgtgatctgcctgcctcagccttgcaaagtactgggattacaggcatgaaccaccgcgcccagcctttcttaaaattttttttgaggcagagtttcactctagtcgcccaagctggagtgcaatggcgcgatcttggctcactgcaacctccccctcccaggttcaagcaattctcctgcctcagcttcctgagtagctgggaatacaggcaccctccaccatgcccagctaatttttatatttttatcagagacgggatttctccatgttggccaggcttgtcttaaaatcctgacctcaggtgatccacccacctcggccccccaaagtgctgggattacatgcgtgagccaccgcgcctggcctatttatgttttttagaggcaggttcttgctctgtcccccaggctggagtgcagtggtgtaatcatggctctcgaactcctgagctcaagcaatcctcctgcctcagcccgtttttgttgttgttgttgtttgttttcctaattatgaacactgtaacctgtgaccattcctgtcacatttccttatacactcaagctggtttgttgtttacagtaaattcttagaagtgggactgctgggtcctatagtgtgtgctttttccacttcgatattgtcaaatcgtgtttcagtcacattcctcatagccttttgcctttgttaggtcaaaaaccccaaaaaagggctgggcatggtggttcatgcctgccaatacaaaaccatctttgttttatacagaaatgttgctttcctgttttctttccaatgaaatttagatatgaaaatctgacagcgtacatcatgtatgacatatgcggtttcctttgtgggagtggtattgagcgagcatctcttaccagctcacctaagacatttttaaatgacagcctccattataaactgtaatgtaagccaggcgcagtggctcacgcctgcaatcccgtcacttggggaggccgaagcaggcagattacttcagtccaggagttcgaaaccagcctggccaacatggcgaaaccctatctctaaaatatcctatctctaaaaatacaaaaattagctgggcctagtggcacgtgcctgtagtcctagctactggagaggctgaggcaggagaattgcttgaaccctggaggcagaggctgcagtgagtccagatggtgccactgcactccagcctgagtgacaaagtgacactccatctcaaaaccccaactccccccaaaatttttgatttggtttgcatttctttgattatgtttgaggtcgattgagacttgaggctggcactggagcaggcgttcccacctgtcccgtgagggcaaaggtcgtggggagtgaccaagtgcatcagggggtgcagatgccctattctggctctttcacgctcagccatcttagcatacgtgaatataccatgagctgtttctcagcttgttttattttcctggtgagatagatgtcactggaatggcctttctccaagtgaaaggccatcttgtgctatgacttttttttttttttttttttcgagacggggtttcactcttgttgcccaggctggagtgcagtggcgcaatcttggctcactgtagcctccacctcccgggtttaagtgattctcctattttagccacccaagtagctggggttactggtgcccgccaccacgcccagctaacttttgtatttttagtagagacagggtttcaccatgttggccaggctggtctcaaactcctgacctcaggtgatctgcccacctcagccttccaaagcgctgggattacaggcgtgagccgccatactcagccatgctgtgacttttaaaacatttcagtgggaaaatatggacacctccccctaccccctaatatctggcagcgtgagcacatctgaactgctgcagaagaggcggcgaggagagcattttgaggatctgtgggttttcgggtagagaaaatcattcgtgatcccctctcagaactcctctaaggtaaagttgtccagacatatgaagctcaccatttaaaaactgatcttgccatgattcccaataatagtcacttgcagaatgttgacgcagcagaatcagccactcctgtctacaatgaaaaacagcttgcagctccgttaagtggctgttattagaagtggagttctggaggggggacgccggtgtctgctcccggtgacgcgtcccggcgcagctaacagccgcggggctggactcccctggttctgggcagcaccgcttcgttccagaaagcactcgcagccaatctcacgggaccttcttctttcagtcctttcaggggagccagggacgcgcctacctcttcaattccgtgtgagtaccctggttcagcccggggggagcggcacgggccctgggacggcctggatggcacctacacagtgccctgtgtagaatcacctgggtctttaggggtcctgaaagaacccaccatccccccgccgggagtttctgaaacgcgctaaggatcttgccccctagcctgtcccatcactgatctttcccattgatggtggtggcgggcagggctgggggagaggcacggcactgctctctgggagtttccctgttttgggggaactcttaggaggatggggtggggcccgctgagggggcagggcctggtcaggggcgggccgggcctgcagcgcagtggcccctctgtccccgcagggtgaacgtgggctgcggccctgcagaggagagggtccttctcaccgggctgcatgcggttgccgacatctactgcgagaactgcaagaccacgctcgggtggaaatacgtgagtgccacaaggggatgctcgtgccacaaggggatgtggcactaagttgccactgagccacacctccccgtgcagtgtggcccatggtaccagtcacagcactttcagaaaccccagttcctcagccgaggtgggaagtccagactccagtgaggcatggtctcaccactgccctccagcctgggtgacagtgataccccaacccaaaacaaaaaacaaaaacaccatgttttcaagccctgtttcttcctaagccaggctctctgcacccagcccgccctcggcccgctgagcagagcctggtgtgggaggaggccgaggaggctgcagggggctgcgggaggctgtgcccactgtcagggacaagtctagaagacctcagcgccagacctgctggagtcagagacagagagctgccccatgagctctttaccccaaatccctctttctcagggaccttgaattgaaggttgcaatcgccacctcctctccagccttcacctctagctcccttctctctccaccacatggctgatctggcctcctcaggccctgcaccttcctgccccgcttccctcctctacgctgccctgaagtctctcttccaggctccactctctctgaccttcgtggccgagtcctcccctcccccaggccacctgagattccatggttttgaccccctggccatctgccttctgttggatgctcccatgccttccccagttgttgttgttgttgttttgtttgttttttgagatggtctcaaactcctgacctcaagtgatccacccacctcagcctcccaaagtgctgggattacaggcgtgagccaccgcgcccggcctgcctgcctttgttgaaggaggctttcccattctggctctggtgttcttcgggtccaggccacctgctctgcctctttcctgaattcctgatcatctctggtctcccagattcctcatgagttttggaaggccacagttcacaccatggaaacgggctccacaagactagcacgcatccctagcccttcccctggtcagtcagccccatacccatctgtgggccccacttccagaaacccgtgccttccctgcatggccaccacactgcattcccctctatggctgcacccgcttcctgctggcacagtccttcctgtgtctgccacacctggggctgccgcttgggtaggcaggatccatcttggtcatctgtgtccctagcaccaggccacacactcagcaaaacaaaatgatgaggatgtgtctgtgggagagatgttaactcctccccatgaaggaccttctccagatatcctgttttttgttgttgttttttgagacagggtcttggtcgatctcagctcattgcagctttgaccttctgggctgaagcagtcctcccacctcaacctcccaagtacctgggactacaggcacaccacacccagctaagtttttgatttttgtagaagaaaatcactgtgttgcgtaggcttgtctcaaactcctggactcaagtcatcctccttccttggcctcccaaagtgctggaatgacaggtgtgcaccactgcgcccagcctccagatgtctttgacctgtttatgtcactctccctgtatttgccttcacgctagttatgcacggaattcctggagtgtagtcttttgcatctcttcaagcctcttaaattgtcccacatgtagtaaatgttcagtaaacagatctgcattcacactgtcctacaagtaatcccagcactttgggagcctgaggtggaaggatcacttgagtcctggaggtcaaggctgcagtgagctatgaccagaccattgcattccagcctgagtgacagagtgagaccttatctcaaaacaaacaaacaaatgaaaaaccttttagtatatgcgctgccgaagcgagcacatgaaaaacctttaacaacaaatgcaaagtaaacctacactgcctcaatggactcacctggaacagaccctcccagcgccggatgagtgcaccgctcagggaacatctgggtatatagttcatagtatagacttggggggggtttttgccaaaagagtgatgaaattgaaaagtgaaaccttctgtcctgaaacctttgtctcttctttttcaaggagcatgcctttgagagcagtcagaaatataaggaaggaaaattcatcattgagcttgctcatatgatcaaagacaatggctgggagtaatgtgcgaactttcccttctcctttgaatgctgttttgtgaaagaaactgtgaatgtaatggaaacgtaggagcatctggtgacagcctttcttgccctctgacctcaaaggctagctgcgcatagctcttgacactctcggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaagagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccctccaccaggagtgggcaccccataagggtttaggccactttgcagaggatggaggtcaaaaaccactcccagataagtttggttttcaacatttagtaacttgtctcagggcagagggcaggcagggggaccgaggggcagcagataggagagcactgagcccggatagttctcagcctggcaagtggctctgaagctgccttcagacaaggctagtctaggggcaagagtgcgagctggctgacaataagaacgtggccacctgcccagcttcacacctcccccgacttcagcccttcctaaacccagacctgcggtccaggcaggcactgggctgtgcccactcgagctcactgcccacacacagcatgcctttgggtgccatctctttgcccaagcctggaagccttggcaggtgggaaatgccgctgccctggtgggcatggcactgagatgcatccactcagcaggagtgacagaggcagaagttcctttaaagcacatcttccacttaggaaaggaaggaaatctttgtactgtcttggaagcctccacatccggctatggccctgcaagctgctttatccctgcgctagtctcccccgagggtttaggctggcccagcacatcctgtcctcctgagctcgcgtgcagccacccagagcgcaggggtcactgcacgctgcagggctcttgctgccatggtctcaagcctgaagaggctccgcccacaagctggcccatgaagttagcaatgcctgtggcttcagtcaattgtcttgagactgtgaagaggctgaaagacaccttcccgggtggaagaaggagttcactgaaaacttatcttaaactgacccttccctttgagtgagtcttcattcctctcccatgtgggaacccagcctccgatgccccggggactaggggaaacagttggaggttcgtgccgtccccagcctgccacgggtgcgaggacagccaagtcctgagtgactcaagatgcttcacttacatggaagaaacttctaaaactctaccgagtggtttttgtatatactaaagttctatttagagcttttctgttttgggcaagttcgctgctccttctatttgggcactttggtttttgtactgtcttttgtgacggcattgattgaacattttttactagtagtcttatgacttttgtatttttttttttttttgtaatttataccaacaacacttttatcactttttttttgttgggcttctgcaaaatacaagctcatttttaaaccaaatgaacagaccatgagctggcttcaggggaagtgctattcacaggaccatatccaccaccctcttaaattcctaaacaatatcatctaggacttctatttaagttatttaaaataaatcttccttgagagccttgggaggtgatgtcagggttataaatggcacagtgcatttgctgtaggaatgtggtttggcattgttttatacacacagtattttttataccttaatgcttattcttgatggcatctgtcagatattagaattgaaaataagaatcttcccaaaatcctttaatttacctgatgccctcatcaggtcgttaaaaattcaaatggttttaatagctaaaaaactacaaattaagctctaaaacaaacaaactacagaaatgtaaaccttcatttgccaaaggtccttggtggcctgtcccctgccctgggagcagatggccctgaagcccttccctcactgtgcaggccaccgggtgaggctggacggtcacccatggtggcttcactgcaaggagcaggactgccgagctcaagcacggggccttcagcttcccctgtcctctggccacaccgccagcccttggtccttatctgtgtgaggtttacaaataaagcttctgatgtcaaatgtttaaatcgtgccctcagtggacgaggccatgtcctgatgcagaaggctgagcccaggctctctgtggcgccgctgagagcagagggctgtcttggggtcttcgagctctggagccaaggatggcctggtcctacttctctgcccccaccaatgggggacttgaatgtggccagagaatacagtcagtcagggccagccagggtgtctgtcagggtgggcacagggtcctctccaaacctgcttctccctccctggtcaggccttcatccccaccacccgcacctgtaccctggacgctggctcagaggcctacaggtgtgtggacacctgggcagtcactgtgtcctactgtgcccctcctctgcaggcccagcttggtgtctgagcctcttacaagccagttactgccagggctgcaccaggccttgcggaggacagtgcctggcgggagggatggagggcgtcaaaagtcactctagagcccaggggcccgaccaatggtcacagacagggatgacaggctgcagagggatgggctggagaagagaaggagccagccatggcgcagttcttgttcttagcatgatgaagggccacagattggtgtgcagcagggtgacgaggggcagacatacctctagtggtcatcaggcagcctgtggcagtggatggggtgaggcagagatgcagatgaggcgccacccagcatccagggagacaaagggctcaggcctgcagcttcagcatcagtgattgatgagaaaaggaagggcagaggtacagcctgcaagttgctgacaggttcaagatttggggcaacaaaaatgagaaaaccaagaacaaggcctaagttagggcttagtgtgaagaactagaagtggggggtggcctgagggcaacagggagcccaagaggcaagtgtcaggcaaggagagtccatgacatgagaacactgaccactggcctgggctgaagacgaagaaaaagccagccaggggcacatttaacagaaaaatgggggttgagggaggggtctttctttaagggctgctgatgcagctggcccaaggccatcagagtcagtgactgacaggaggagcagagtcttggagcccagtggccgggcctgagagcagcaaggccacttcagcaggagggcggggagagggacatccacttgttctcacagcaggagacactggcctcaacccagtgtgggtcccctcaagattctcacaggggcacagagacgccaggcaggcttgagatgaagcccaggtggttcacagccagagcaggtgagcagggccctgagagctcaggcagggcacggcaggaaactcaatgctgccgtccaacaccagccttcagaagcccctgaagttttgtcaaaacagaccgagaagcccaccctgcagaggcttaggctcagtaagtctggggtctgaaaacttgtcccaggtaatggcgttggtcaggggaccacactggttgtataaataggctgtccctgagaagatgacagaagtaggggtaagaaaaccagacatatacagctggatgtagtggtgcacggctgtagtcccagctacttgcgaggctgaggcaggaggattgcttgagcccaggaggtcgaggctgcagtgagccatgatcacaccactgcactggagcctgggcaacagagcaagaccctgtcttaaagaggaaaccacaatctggagacacagtccttcctcactaacctggcctgcctactagaggggaggcctgaggcaccagcctgggtgtagggcaggccttgtgcttgaaggtcccagcagtgggctctggctgggccaggtcctggaaacagggccaaggcccttggcaacaggttaagggatgggaaggctgtgggctcccaggggccaggaaaggggatgcaggcagcaggcaagcaatttattggctggcagcagagggcaggctagaaaggctggaaatggagatgtggacatgggcccccagccctgcaaccccaccaaggtccacagcggccaacctgctgctaccaggagctgaagtccccaaaaccccgactgggcttcttcttggacatggggacagtggcactggttgagggctcttcctctgctgctcgcttcctgggaagagaagaagccgctgggagcccacaccctccctcagcccctcctgacttgtctgtgtctccatacagccctcccggtgtaggcccaacccctcccacctgctgctcccacatccccctgaatttgatctcttccacccacagaggccccggccaggccttcagaggcagtccctcggctgcagaggccacacagcacaagcccacggccgggaccagtgcccatagcttgcttgcccctctgggtctgaccctcagacctcagtcagccctaggaaacaccatgggaaacagggaggccagccccgcggcactcacgtggctgctgggttgatgtacttgcccacgccctggcggaaggtctgggggccctggctccctgcctggggctggctgctcttcactttggtctccggggctaccttgagctgtgtcttccgctcctgcgcaatctgtggcacaacagggcgctggctaaccggcagcacctcgggcaggacagatgctaggcttggggtggaaaagtgcactagcccagaccctcctaggtggtggcatcgtgccccctcacctgggcatcggcctcctcataggggtccacgaacactgtagtggcatcaatgcggatctcctcctagcagcaaagggggctcagtgcacggcaggtcctccccctgcctgcctggcccccagccgccacgccccacctccctgggcacagaccttagggcggtcagttttggggtcactctccacattctccatggctgtcagtacgtcaaagcccccaacaaccctgcagcagggagacagaggtgggtctgcgtgtgctcaaggagggcacccccacggctgagccccaaggcacgtgggaagaggggttgagagccccgaggctggcctggtggtccttgggcagcagccaggaaggcgatgagagggagtggcaagggcggggtcggctgaccatggccctgggcatatccagctgggtttttttctgtttttgttttttttttggtttcccccacccacaggaaaaataggagtcacaaaacgtggcttgtgctctccccgctggtttggtaaacagagttccacttggccagaaccacatcacctgcgtccaccctgtttcgtgctgcttccacacagctgggtgggcgtcagagaccacgtggcccacaacgctggaaagacccctggactagagggtgaagggagctgggtgtggccaggcttgcgagtggcgcgccactgggtctgagacagggcagtgtccaggccacatgggcgagtttcctcctctcctgagcccggtgggtctagagagccagacttccctggcacatggagcaccctccatcgcagctctgcatagcctcaacccccagcagtgatggccagcatggcacatgactcaggtccacgaaaaaggcagtgaggaggcctcaggtggggaaggaacccacctagcccactgaccccccaggcttcacacagccgcttcccttaccgtccaaagatggtatgcttcttgtccaggtaggcacaggagcgaaacgtgatgaagctggggaggagggctggatggttagggagagcatggcaccttctgcacctggcctgcctaagagcacaccaggagctgcccaccctctacagccagctctgggaacctgcagcttccacggacgcatgtgtgcacgtggttccctgcgctgcccaccagggcaggtcattagcccccaaggctgcccaggggaccccggaactccagctgtccccaggtcttcctgctgccccggctgctgcccactgcctgtcaggtggtccctgtgcccagaaccaggttggccatgcagctctgtgggaggtggctgggacgaggggacacctggaaaaccagagccagccccatgtcatcaagggacctgttgaaggactgaggagaaaggaggcaacaaagccagaacaggagtcaagggattaagaaacgtgggtaacataaataaacatggactaagaaaatgctcaggtcgtccaggcacagtggctcacgcctgtaatcccagcactttgggaggccaaggcaggtagatcacttgaggccaggagttggagaccagcctggccaacatggtaaaaccctgtccctattaaaaatacaaaaattagctgggcgtggtggcgtgtgcctgtagtcccaactacttaggaggccaaggcaggagaatcgctttaacctgggaggcagaggttgcagtaagctgagatcacaccactgcactccagcctgggcgacagagtctgtctcaagaaaaaagaaaaagaaaaaaggaaatggggtggaattaaaacagccaacagcactgccatgagacgaggagagagtttctgccagcctggtctgggaggaaggcagagactacctcataactttggacttttttttttttttttgagatggaatcttgctctgtcccccaggctggagtgcagtggcgcgatgtcggttcactgcaagctccgcctcccaggttcatgtcatagtcctgcctcagcctcctgagtagctgggactacaggcgcccgccatcacgcccagctaatttttttgcatttttagtagagacggggtttcactgtgttagccaggatggtctcaatctcttgaccttgtgatccacctgccttggcctcccaaagtgctgggattacaggcgtgagccactgcacctggccaactttggactttaaatagatgtccttcttaaccttagaccagaagtaaaacatctaatttccaaaccagcagaaagagaagagaagcaaatgaaaataaatataaaaaatggtaactagaaagcaacaagatcatagaacgcaacagaccacctgaagaattaagtccacatttaagattgtcaggattggccaggcacagtggctcacgcctgtaatcccagcactttgggaggccaaggtgggcggatcacaaggtcaggagatcgagaccatcctcgctaacacggtgaaaccccatctctactaaaaatacaaaaaattagccaggcgtgtggcgggcgcctgtagtcccagctactagggaggctgaggcaggagaatggcatgaacctgggaggcggagcttgcagtgagccgagatcgcgccgctgcactccagcctgggggacggagcgagactccgtctcaaagaaaaaaaaaaaaaagactgtcaggatgaaggagaacacgacagaccccagctgtgagccttcaaaaagccctcagagggcagagccagagaggctgaaaagaaaacgatggaagacatggggtgggtcccggcgctggcggcacggagcactccccagggtggtgcaggcaggcacagcccacaacccggctggtgagacacaggacttaacctccactgcatcaaacatgcaccccccagccacgcagggacacgctcctgagcccaccaagtctgaccacacccgaggccaccagacaagtgtccgcagatgtgacatctgcaacggtgcagacctgagctctgacctgcaagcagttccctctcttgctgatttctaacacagtgaaggaaactagaagcagaattaaactcagataagaggaaagtaaaagaaccatcctgaggcaagctcctcctagaaaatctttttttttttttggagacggagtctcgctctgtcacccaggctggagggctggagtgcagtggcgcgatctcggctcaatgcaagctctgcctcctgggttcacgccattctcctgcctcagcctcctgagtagctgggactacaggcgcctgccaccatgcccggctagttttctgtatttttagtagagatggggtttcaccgtgttagcgaggatggtctcgatctcctgacctcgtgatccgcctgcctcggcctcccaaagtgctgggattataggcatgagccaccgcgcctggcctcctcctggaaaatctttaattacaagaatcacaaaagggaaaacaaagctgtaacaaattaaagtctaatgatctttgaatacggtaaaataggcaaacctttggcaacagttgtccaagaaagcacaaaatactactagaaataagaaaagaaggccgagtgtggtggctcatgcctgtaatctcggcactttgggaggctgaggtgggtggatcacctgaggtcaggagttggagaccagcctggccaacatggtgaaaccctgtctctactaaagtacaaaaaattatcctggtgtggtggtgggcgtctgtaatcccaggagaaccgcttgaacccaggaggcagaggttgcagtgagccgagatcccgccattgcactccggcctgggtgacaagagtgaaactccatctcaaaaaaaaaaaaaaaaaaaaaaaagagaaggtggcaactgatctgtcagcagtttcacaggctggttaagccaaagagaaataaaaaataataaaatgattccctgccctggcccctgccaaacaacaaaaacaaaccacgcacccaacctacttgaaaataaccaacagtcctaggcaatccttggctgagaagaaattgaaagggaagctaccaacaaccagcaagcagtgaagagggaacatgcaccctcaaaatgacagacgtggctatcagaaacacacatggattaaagtgaggaaggaggaaaagcaccatgaagaagcaaagacagaaactgaaaacaattacaaacccttcaaagtgaagtgaaaacagacaaacccttcaaagaccactaagggactgaggaatggaaagtgtgattaggcatgagaaaaaaaggtcagcacagcgaggccaagagaataccagccttcatggaaacaagtgcccgttaaccctgaaatgaaagccccaaggaagtggcacgaatagctgccagctgcctttgcccagctgttaagcacagctgactcgtttgatttttttttttttttccagacagggtctcactgctgcccaggatagagtgcagtggcgcgatcctagctcactgcagctttgacttcccaggctcagattatccccccacctcaccctcccaagcagctgggactacaggcgcacgccaccatgccccgctaattttttttattttttgtagagatcgggttttgccatgttgcccaggctgctctcgaattcctgggctcaggcaatccacctacctcagcctcccaaagtgctgggattacaggtgtgagccaccacgcctggccatccctgtgattttaaccattccaggccacaaagccacagccagccctgctcgtaacatgcaggggccacacctgtcacagcaaaacctgctggagccagtccacacaaccgagaccacgtgtgacagtgagctggcagaaggccacggcgaagccacgacaggccagggttcaccccagaatgccacggagacacccatccactctggccttgtagtggccacatccacaaatcccgggaggaccagaaaaaggacagaatcatcatagtagatgctaacaaagaaacctctaaaaagtcagccaccctcctaaaaacagcccaacaacaaatgttctgagaaggcaaaacagcgatttctgtggagcacagcaagatgcccacatcctcctcccccatcaggcccacggtgacgtgacggtgacgtgactgatgtgcacaccagggaagcagagagcagaccagcttttggtgataagcgtgactatctagaaaacccaaaaaaatcttaaaaacttttgaattataagataatttgttaaagtggctagatataaaatgaacggtagtttttctctacatgagcaatgatccccaaaagttgggaaaaaaaaagtccatttacaaaagtatcataaactataaaaaatccttaagaggttgctttatcccggaagtcacaggacccatgtgaagaaaacgattgaaagactgaaacataacatcaggccactgtctggggatggaaagggcacctctgttcttccacaatacaggcatccggcccctgtgtgcatggccctgctggccccccatcccctgcctcctgccaccagactgcacactgctccccacatgcaccagggccagacctcctgtgtctctccaggcgcctctccctgtgcagcctgtgccctgcacaacccctcccacacgctgacctcccccagcactgcctggccacaggcacccacacgaatgcctggtccctgtcaagaagcccttctggacctccagtaattcccgacttctggtctctcgaggacacacccggtgcgggcagctctccctgctgactcactctggggacccccttttgaacgcaggtgcacatgcttggcctaggtgtgccgtacaccgtctgggtatgattcagaaccagcacacccttcagagagggccaagaggaagaacccgcagagagtgccggctcacctcccaggccaccccagcaagcccagctgactcacaattgagacctgttgctgttgggcccggagttggccatgctgaggatgccgcggcccgtgtgcgagaggttgggccggaactcgtctttgaagggcttcccccagtatgactccccacctggaagagaaaggcccatgggagcaggaaagcctgggccccagccgaggcagaactagaaacctcagagtcccgaggggcatcagggccttgctgagcccagcctggggcaggggcacttgatagggaggctcccagccccacgccaccaactcctgggtcccttggagcccccacgcctccaaacaggcaggctgctgcccactcaccccagccccgcctggggcctgccccgggacagggattaaagagtcaaggccaccatcatcatcactcaagctatgggaatacagaggttgggggatctggacccaagcagctgccaggctgaggggcttggagaggctgcaggagggagggctggcctcagtctgaggcagaccccaggggcccagggaagagaccacacactcttgcctcctctaccatgcaggcctcacagccacctggaaatgagaaaactgagggccaggcctgagggggcacagcactgatggctgccagtcgttccaccctggtctagcagattccatgtctgagctgtgcacaacccctgcccagctaccccctcatgccccacggagcagccaaagtgcccagagaggggcccagcaccagtacctacccgtgcctgtgcctgtggggtcgcccccttggatctgtgaaaacaaaagccagtgagcaagtcacactctgagacccgaggcccaccgcctgcctgactgaaggacacccctcctgccagatggctccacacaggggctgggctcttggtgataatgaggggccctcccagccacctccctttgtgaacccagttctggatgggctggggcctcaagggtcagtctatgggttccccaacagaggatcaccaactggactcatcctggccaccgtgggatgggccagggccctgggatggggcagggacaagcccacccagcccccgatgtcccaccaagctcatctgtgcagccagtgactctcgtcactcaccacaaagttccggatggatctgtggaagatggtgccatcgtaataatgcttcttgcaaagcctgatgaagttttcgcaggtttttggtgtctgcaacatagccccaatacttgtatgaagcagagagctgccaaaggcagctcaccacagccacaggaggctttttttttttttttttttttgaggtggagtcttgctgttgcccaggctggagtgctgtggcgcgatcttggctcactgcaacctccgcctcctaggttcaagacattctcctgcctcagcctcccgagtagccaggactacaggcatgcgccaccatgcctggctaatttttgtagttttagtagagacgggtttccccatgttggccaggctggtctttaacatgtagcagagtcagctgcccagccacactgggcacggatggacccacaacattaagcaacaggacccgtgcagccgcacggcccagagtacagcgcatgggagaagtgtgggcagagcagcaggtgcggcttggccccttctctgagacactggcacctgtgcgcaggccatgctgccaacgcggccccctaggaaggacacagggcactgctgcgggtcccgcctagtgacaggctgaatttcctacaacaagcacataccagtggcagccctatatttaagacatggctgtcagatgacccagagatgaccttggggcatggggagtggctggcctccacacccaccaggtcgcagtgcagctccaggttgaggtcgcccttgttggtgtgcagccgcacgtagcccttcttcttcacaaactggtagcgcagcacatcctcgtcgatggcagctacaagccaaggtcccagctcagcccctgccctcaccctggggcagccccaccatgccaggcagcaccgacctcagacacacaggcggggactaggctccagctctggggagagcaggggagctggaggccgagggtctgcttaggccacgcacaggctcaccccagcctcatggggctggcaggggttcagcagctaagagggggaggactaggggctcaggtgacagtgggagcccctgacagaccaataaagtgggagtcggggagcacacccaccccctgccacttttgggtcacatggcaggtggctacagaggccaaggtggctacctgcttcatgtgtggtctccgggaccatcgcggtggaggtgaaggaagcgctgaccttccctgtggaatagtgggcctgccaaggaaaccagggtggcacctcagcagtgccatgggaggcagttgggtggggacgtgtcgcttgcctagaagccaaccacacgccacccctgccccccaggccctgcttggtgcctctcctccaggagggcctccccaaccagcaggaggaagaagccaaggctaggccaagccagggtcccctggcctccactggatcccgactcttatgatatcaggtgaaaccctggagataaaataccacacaggactggccacctcagggttaggagtgtatggctgacttctcatttatttttattttaatttttttatgagacaaggtcttgctctgtacccaggctggagtgcagtggtgtgtgatcctggtgcactgcagcctccaactcctgggctcaagtgaccctccgacctcagcctcctgagtagctgggacgacaggcgcatgccaccacgcctggctgattttttgtagagataaggtctcactatgttgtctaacctagtcttgatctcctggcctcaagcaatcctcctgcctcagcctcccaaaatgctgggattacaggtgtgagccaccacgcctggcctcatttctttttaaaagtttcaaactttctacactaaacacattacatatttaatcaggggtcggggaaaagccccaataaatgttattttttatcatagaggaagaaaaaggggtttctcccatcagaagaaaatacaagccaggcacagtggctcacacctgtaattccagcactttcggaggccaaggcaggaggctctcacttgaagccaggaattcaagaccagcttagacaacatagcaagatcctgtttccaaaagaaaaaaaaaagtaatatatcaaagtgctaagggcagtgtgttagacggagtgacacactggacaacaagctttctttttcaaattttccagaatttgaataattctttaagaaggagaacttcagagctacctgcccatgtctctgccctccccctagctccagatccccatgctctgcctgacaggaggaagaagcaaacacgacagccccagacaggtggcaccgtgcagtcccaggcatgccatccacgtcagcaccgcagcagaccatgaaacgccccaactctccctggcatggctttgggccccagtgcacatcgggccctgccctcccagccaccacagaaccacatgtgcccgctcaacgtgcctgccctggctactgagctcaggctgggaccacagcacaaggcagaccttctgtggcagggatctcccctacatgcccccacacaccccttggttcttcaacgaccagtgtggacatcagcccctccccttctgccttctcagattctatctgcctcagggcagccccagggctgtgcactcagagccatcaggggcaccacagctctgggggatcctggctgcctccctgccgtgtatcccaggcccccatgagcccctttcccaggaccactccaagaggccatgagatgggcaggaagacggggcttgggcttggccgagtgccctccgccactcacagcgttcagcttgtccactttcttcttctccggggccttcatggtggctgccagaatctcgtcccctttgaactccttgtagagctcctgcagggtctctcgggtctcggcatttgtatttttcagataataagacgggtcctgtttggccttctcttcatctacaaaacagtagcatggccctgagccgccgagcccccagtagcctccccacacacgtgctggggacacagatctagaatagcccagggccgtccagccatggcgcaggcaccgtgccactgccagccacagaatgccacagtgccccgctacaggcctgaaggtctccccaggcagttcacaagggtctcaggatggacttcaggttgatttgtatattttatatttatctgtatattctaatctttttagagtatacgctttgctttttttttctttttttttttttttttttttgtggagatggagtctcgctctatcgtccaggctggagtgcagtggtgcaatctcggctcactgcaagttctgcctcccaggttcacgccattctcctgcctcagcctcctgagtagctgggactacaggcgcccgccaccacgcccggctaatttttttgtgttacaatcttgtaacctcgtgatccgcctgcctcagcctcccaaagtgctgggattacaggcgtgacccaccgcgcccagccttttgagacagggtctagctctgtcgccccagctagaaagcggttgcaagatctcagctcactgtagcctccacctcctgggctcaatcgattctcctgcctcagccccccaagtagctggggctacaggcgcaccaactacacccagctaatttttctattttttgtagagacagggtgtccccatgttgcccaggctggtctcgaactcttgagctcaagcaatccgcctgccttggcctcccaaagtgctggggttacaggcataagccaccacacccagttgctttgcttctgtaattttaaaggttatttttatttaaaataatagaagtgtttgggggtctttccagatgtgaaatcacccattcttgccgactcaggagggtgcctgctgcctactgggccttggacagcagcccaccctgtggagaggggccggcatccctgtgcagagagcacagacacggcccagccccaaccctgacctcaggctctcctgactcaaatcttccccagttcacgtgctcagcctacctaaaacccgttcaaacaatgctcacaaagtgcccaggccactgctctgcagcacaaggccgagtgacctctgaacatgagtcctgctggctcctccaaggctgcaggacagccaccagaggccagggaaacaggaggaccccatcaccccaccacctgcccactgacagcaccggccagtctgcagggagcaggggaacctgagcaggtgtgctggcagggcagcaagtctatcccgcccattgtttctgaggctgcagttggctcagattctctgaacactagttcagaaaatgcagggcctgtctgggctgggaccccctgacctccaggaaagcgggggctttacccagggagcactgtcccaatttcatccaaaagccccctcgcctagcccagcccctaggtgtacatacctgggtctattattttcatgttattcttcacatgatagaagttagagacattgaacttgtccaaattggtggggtcctgtggcaaaaagagaatgcccagcagagtgaacccagcctacggccaaatggcagccacatgcagcaaaggacggccagctgtcagaggtgtggaagaggccagggctacactgaggttgggggagtcaagcagggcatgagggaggaggtggtctgccccaggcagggcagcaaacaggggcaggggcagggacggggacgcagcctcgctagctgctggctgagctgtgaccttcctccaggcacatggctaacgagcattcattgctgttagggagctatcggaccggaacgtgggcagccgtgggccgacctctggttagaatgggacaagccacagaggtgattgactcagcaggccacgctccagccagcacctgcttttctaagtcagtgtttttcattaattcacttggggttctctgacacctgcagggaccctgtgccagatacagggtctttgcagagctcatgccagctcctgccctcgaggcgctgaagcagagccaggcctgcagagtggctattcagatgcctcaggtggctttgaggacagatatgaggggccctgacgtgggggtagggccctgtagaggcctgggctggctgcaggtgctgaaggcagctggggcaggcaggcaggggacactcacctggagggtgatgatgtcctgccgggagaagggctcgtcggtcagcaggtcccggaagttcttggccttgatatttagctgttccactgcctatagccaggaggaagtggttttacgatgcctgccccaagccttggcacaggggactgcaagcagggaggcctggagctggccccgaccatggcacgatttgagaggcatgaggaatgagagagacagcagtgtacaccccactggctgaaagcagtggctcccacagaggcggagctggctgggcctcagacgatgagccagttcaccctcgcagcaaccttcctgcaggaagctcttgtctgcacattgatcagcaaaaagactcagcgagtcacccacccactcgctgcaggctttgccaagctcctcccatgcacaggtatggtgccaggcccccgtgggcaggggctgtgcacacaagatgcctgcactcctgcggtgcggtctagcagagccctcactccactaacgaggactgaccatgccagtttgtgcaggcttctggcaagaagtggctcccaaggcccctggagcagcgctggccacctacaccccacaaacgtccaggtgcaggattgacaacggcgcaaaggtcggctttcccgccatgtggggcctgccccgcctcacccaagaggaggacccatgtgtgaacacggctgtctcccctctccctacacccactccctgccagaactcctccaggggacagctccctcctgggggcaagtgactccatccagatccggggcgagcactcccctcacagccctagaggcctgtcctcaaaacatgggtgccttcccagcacctgggctttgctgaagacgcggaaggacctcttggggtttaagggtccctgctgggcagccaggactgcctggattccgaaggatgcacctcccccaaccctttttttgacctgcctgaaaatggggaggctgcactgccagagctttgctagatgaccatgcctgtggctgtgactgtaaaccccacgaggacaggccgtacacgtagcacacagcccagccagtgtatactaggaacacacagcagagatctccccaccgctgtctccacgccccggagcgaggacacacctcataggcgtagacgttgccggtcgtcctcacagccacgatgtgggtgttgttggtgaacacggtaaacagcactgggcagtggtacttccctagagagaaggcacacacagggaggccagtcacctctgtgggctgtgaacatcccagtgaggaccgcagagggccagggcaggacagaactccaaagtcagcgatgggaggaggtggaaccccatgtcagctgccagagcagggaaccatggggacagctgctcaccccctcaagcccttccacaccgttaggaaactcctattcatcctgcaagacccaatcccggcatcgtcttcctcagatcctccagcccacccctgggtgatcaccatgctagcctcctcctcctactgaagttggccctcggcaggaaacaacccatgttccagccctgacagctctacctcctctcacccacatcctccgccagccccctggtcagctcttccttcagaaccgcccatccccttgcctgcctactgtcttttttttgttttgctctgttttttttttttttttttttttttgagatggagtctcgctctgtcacccaggctggagtgcagtggcacaatctcggctcactgcaagctccgcctcccaggttcacgccattctcctgcctcagcctcccgagtagctgggactacaggtgcctgccatcatgcccggctaatttttctgtatttttagtagagatggggtttcaccatgttagccaggatggtctcgatctcctgacctaatgatctgcccacctcggcctcccaaagtgctgggattacaggtgtgagccactgcacccggccttgttttactctgttttgagatggagtcttgctctgtcacccaggctgaggtgcagtagcgtgatctcggctcactgcaacctccatctcctgggttccagcgattctgctgcctccgcctccggagtagctgagactacaggcatgcatgcgtcaccatgtacgactaatttttgtatttttagtagagacagtgtttcaccaccttggccagactggtcccgaactcctgacctcaagtcatctgcctgcctcagcctctcaaagtgctggcattacaggcatgagccactgcacctggccttggttactgtctctctgcctgtaagtccccacccagtggccaggggccctgtcaaagtgcccacttctggggataaaaaagtaagtgcagtagggggactcagaaacatcaaccacatgtatttgtggggactttttctttttttttttttttgagacagagtcttgccgttgcccaggctgcagtgcagtggcatgatctcctcggctcactgcaagctccgcctcccgggttcacgccattctcctgcctcagcctcctgagtagctgggacctacaggcgcccgccaccatgcccggctaattttttgtatttttttagtagagacggggtttcaccgtgttagccaggatggtctcgatctcctgatctcgtgatctgcccaccttggcctcccaaagtgctgggattacaggcgtgagccaccgcacctggccttgtggggactttttcttaaaaaaaatcctgatttgaggccaagttagagcctcaaattagttagagcctcaagttagaggtggctcacacctctagtcccagtgctttgggaggccaaggtgggaggattgcttgaggtcaggagtttgagaccagcctaggcgataggctgagaccccgtttttttgttttgttttgttttttgagacagggtctagctctatcacccaggctggaatgcagtggcgcaatcacagctcacgcagtctcaacttcccaagctccaataatcctcccacctcagcctcccaagtagctgggactacaggtgtgctcaaccacactggctaatttttaggtttcattttgtagagacaaggtttcattatgttgcccaggctggtcttgaactcctgggctcaagcaatcctcccaccttggcctcccaaagtgctgagattgcaggcgtaaaccatggtgcccagctgtttttttttggtggggggatgctgacgcgggaggatcacttgagcccaggacttcaagaccagcctgggtgacatagggaaacctcatctctacaaaaataaaaattaaaaaagtagctggggctgggcgcggtggctcacacctgtaatcccagcactttcggaggcagaggcgggaggatcacctgaggtcgggagtttgagaccagcctgaccaacatggagaaaccccgtctctactaaaaatacaaaattagccaggtgtggtggcacatgcctgtaatcccagccactcgggaggctgagccaggagaatcgcttgaacccaagaggcggaggttgcagtgagccgagatcacgccattgcactccagcctggggaacaagagcgaaactccatctcaaaaaaaaaaaaaaaaaaaattggctgggcatggtagtacatgcctgtggtcccatctacttgggagactgaggtggaaggagcacttggtcctggaaggtcgaagcaacagtgcgctctgatcatgccactacactccagcctgggcaacagggcaagaccatgtctcaaaaacaaacaaacaaacaaaaatccttctgatgtgaaaactgttttttaaattggggcttcagcatcatgcaagggggtactggtgggagcaaagacagaactgcacagatgggagacagcaggggctggagttgatgatgggcacaggggaggcgtatcacacctcctcactccactttcacgcacggggaattccaattaacaaagaaacaggtggggcgcagtggctcacgcctgtaatcccagcactttgggaggctgaggcaggtggatcacttgagcccaggagttcgagaccagcctggccaacatggtgaaaccccgtctctacaaaaaacacaaaaactagctgggtgcagtggtggtgcctgtagtcccagctacttgggaggctgaggtgggaggatctcttgagcccaggaggcagaggttgcagtgagctgagactgtgccactgcattccagcctgggtgacagagacctcatttcaaaagaaaaaaggaaacacaacaaaagaagctgactgccaggtcaaagttttaaaagaaaaaaaaaggctggacctcattcctccctcagtggctctcatcttggagcggaagcccaagtcctcctgtggctcccaggccccacaggactgctctgcacaccatccccacccctgacctctgtcaccacatcccctgcttccaccgctagcacacgctgttccagccacattggactcccagctgggcacagacacccttgagcgtgcgcccacctcagggtctttgcactggctgtgccatcagcctggccctgcactcccccgatgcccacacggctctccctccctgcagcgggtcagggcggccctctcccctccccctgctgtgctctacacacacaagcagcctctggcacaccctgctgagctgctctctggtgttctcccccaccagaatgcatgctcctctcattcaggagagacacagcctgttgtgctctctgcacatggcaggcactcaataaatatttgctgtccctccctctccctctcccgctcccgctccccagggtctccctctgatgccgagccaaagctggactgtactgctgccatctcggctcactgcaacctccctgcgtgattctcctgcctcagcctgccgagtgcctgggattgcaggcgcgcgccgccacgcctgactggttttcgtattttttgggtggagacggggtttcgctgtgttggccaggctggtctccagctcctaaccgcgagtgacctgccagcctcggcctcccgaggtgccgggattgcagacggagtctcgttcactcagtgctcaatgttgcccaggctggagtgcagtggcgtgatctcggctagctacaacctccacctcccagccgcctgccttggcctcccaaagtgccgagattgcagcctctgcccggccgccaccctgtctgggatgtgaggagcgtctctgcccagccacccatcgtctgggatgtgaggagcgcctctgcctggctgcaaccccatctgggaggtgaggagtgtctctgcctggccgccccgtctgagaagtgaggagcccctccgcccggcagccgccccgtctgagaagcgaggagcccctctgcccggcagccgccctgtctaggaagtgaggagcgtctccgcccggcagccgccccgtccgggagggaggtggggggcagcccccgcccggccagccgccccgtccaagagggaggtggggggcagcccccgcctggccgccgccccgtccgggaggtaggggcgcctctgcccggccgccccttctgggaagtgaggagcccctctgcccggctgccaccccatctgggaggtgtacccaacagctcattgagaacaggccatgatgacgatggtggttttgtcgaatagaaaagggggaaatgtggggaaaagatacagaaatcagattgttgctgtgtctgtgtagaaacaagtagacataggagactccattttgttctgtactaagaaaaattctgccttgggatgctgttgatctatgaccttacccccaaccctgtgctctctgaaacatgtgcggtgttcactcagggttaaatggattaagggcggtgcaagatgtgctttgttaaacagatgcttgaaggcagcatgctagttaagagtcatcaccactccctaatctcaagtacccagggacacaaacactgcagaaggccgcagggtcctctgcctaggaaaaccagagacctctgttcacttgtttatctgctgatcttccctccactattgtcctatgaccctgccaaatccccctctgtgagaaacacccaagaatgatcaataaaaaaaaaaagaggtttggagaaataaaaaataaacaataacacacacacacacacacacacacacacacaaaataaataaataaatatttgctgaatgagacacacacacacacacacacacacacacacacacactgctgatcacaggaggggaggcagcccaccctcggccaccagggtggagcgccgtgtcctccaccgacgtcaatgacgtgctgaggttcacccattcattcacctgcgaatgctgcaccgactggggaccgggctctgggctcagacaagcggggcaaaagggccttggcctcaggtgctacagcatctccctggaatgcatgcacccagtaagcaaggacaacccctaagccatagcatctccacaggcaaaagacctggactagaacctagcacaagatcaccacctgggcaggggtgggctgcacaactcatccgggcctctggccacaagaacagcggaaggtgtgtaatgggcatgaagcaggagccgcagcactgggctgggctctatgagctgtggcaaagaaaagcctagcccaagagctactggacaaatccctccagaccacccacatcccctactcagctgccgccttggttcccagcatgagcaacttctgcctccaacaacaaacagaccacagcctcagccagagggggcccatgccctgcagatccaactgtgcccacaaaggccactagcagcttacaatggcctgatcgcctttgtgggaagttcccaacaccacaggttctgcccccaacctcccccaccttaaaactacccagacctttgagaagaaatcttgtgacaccttttttttttgagacagagtctcgctctgttgccaggctggagtgcagtggcaccatcttggctcactgcaacctctgcctcctgggttcaagtgattctcctgcctcagcctcccgagtagctgggactacaggcgcccgccaccatgcccggctaatttttgtatttttagtagaaacggggttttaccatgttggccaggatggtctcaatctcttgacctcgtgaaccatccgcctcggcctcccaaactgctgggtttacaggtgtgagccaccgtgcccagccctgtgacactttttgcggaattaaaagcaggtgtctagcttggtcagaaagcaatgactgattccgtatgaaaactggtgagagctgggcccttgggtctgcaggtcaagcccagaattggctgtgatagttccactcaccctcactgttcttggaaaagttcagcttgatcagggacctcccgtccagcttctggaagaagcacagttaataattaatgataatgaataagtaactgatgcacagagatgctagggtcagagacaggcaggaaaagtctctgactaggccaaccctgtgcagctctggacaaaagggaaggccccaagaccctgcaaggacctcacgggggctgcaggatggcgtcgggcagttgtgtttatgtggcacccccaccacgctctgagaagagccgtcacgggtgaccccgagcaggaggaccaggccacagggtggtgtgtgttatacttctgcagggtttggacgtctttatggtgagcacagattacttctaaaattaaaaagtgaacatatttcttcagctagagtggtgggacacacagagtccctctctgtcaccaggctggagtacagcggcaacatctcagctcactgcaacctcccactccctagttcaagtgattctcctgcctcagcctcccgagtagctaggactacagacacacgccaccacaccaggctaatctcctgacctcatgatctgcccacctgagcctcccaaagtgctctgtcatatgaatatttaagaaaaacaaaacattaaaagtggggagaaagtaagaaatacactccaatgctaagaatggttgtgttgggaagatgggactctatttttctgtttctggatgttttttcttttttcttatttcccctaccccaggtggcaggtaatgttttcagtttctgtggtgtgtctgcagtacagctcttccacagcaaactttcccataaaacaaagtctggacaaccggaggtgggaactgctgggggcggggctgtggggagaccctggaagggaggcagagctatgtgctgctggggagcacctcactcagggccacaatccagcagctgctgccacctggtgtgggctgggcccagctatgcctacccaggcccaggggagacacagcgggagcctcctggggctgggccctaagctggcagcaggtccttaagctgccctccccgccctccgtgggccctgcctgctgctggccaacccaactgaccgcatctgctcctctaaccaccttcgttccttcctttgtcattcaactacccccacctccctacatcactacaggtgtggaggagaccaccagagggccagcagggtccctattcagacacaggacctgagcagagagactccccaacacaacaggctcctcctgagcccccaaaagtcacatgggccagccagcccttggcccaggaactctcctcagaggtttggctagcaaggctctgctgacacccataggtctggccaagcaagcacacagcaaggtcccttccagagcaggccaagggagaggcgcaggcacaggataaagacgtgtagggcgctcctgcagactcaccccaacatgatgcctggaacaaagaaatggccacacctccctgatgtaagccctaacagcgtggctaactgccagatcagactttgtgggtgtgggggccagcacaatcgacaagtttgggaaccccaaagagtacctgtgaagcaaaacacccaaagtagcaaaatgcatcccagctgcaaccaaatgacagaatccactgggacagcaggggccatgagggcagctgtggacaggaaaaccccacctacccccaccttgccaccaggctgctccctgaggccgacacccagccacacagggcacaggcaggcagcagggacctctgctgagaagagcaacagagaatgacttcccagactggggcacggaccttgggggaagcccctgggatccaatgtggctcccagcagcagacatcacagaaacagtcttcaagtgacaaagaccaaggaagaagagtgccctccctaaggaggtgaggccacaagccccctacccaagcatttgaaagagaaaagccacgggctttagtcgctggtccaagaacactcaaaaaccagccccctggccaagttccccttgtactggagagcagggaagccttggaggagcaccaactccatctacaaagagtccccagaaccctgcagcccccagaacaccacaagggccagaagagctgagacagatgggctgccagcttctcctgctggcccggtagggagggtcatattgtccagggagctccctcccagcggctccagcacagggagcccaccggagtcccgaccctccgtctcgcacagtttgagctcttgccccaggccataggaaagaggtggaggaatacatgcaagtaattccaacaggaagggcaaggtcactggtaaaatacactagatctccctcggaaccaggctgcataatgtccccacaaaactgatgctcactgggaacctgtgaatgtggcctgacttggatataatcaaaggtttatatagggtctttgcagatagaatcaagttaagacgaggtcacagctatggcccaagaaaagacatgcacatatatacacgtgcacaggccggaagcatttctggaaaagaatgggtgtggggagaggaggggaagactgtccctcctcactgggccccatgaacggttctctcccatgttcctgtgttcatgaaaaccaccagaacaaaaggagaagtgagaggatagcattcactagcatcactgaaactcctgcacagccacctacctctccattgctggggttggtcccgtacttcttaagccatggaacaatgttcctgaagggaagacagaacagaaagcatcaccagggtgcttaggcgccacctggtaacaacactgtggtcttgcagggctgcttccaggttagaggcctgtgaaggggtcttgcttcactttaggagaggaagagctcctcatcttgtctcaggaagttgggggatatttgtggatacataggtttcaaaatatgttcagagttattactgtagttatgtataaacaacaaaaactacaggtgaaaatgagtaagtaaatggtttgggttttttttctttgagacaaggtttcgccttgtcactcaggctggagtgcagtgtttcagtcatggctcactgcagcctccaacccctgggctcaagcgatcctcccacctcagcttccaagtagctgggactacaggtgcacaccaccatggctggctaatttttgcacttttttgtagacacaggttctcaccatgttgcccaggctggtctcaaactcctgggttcaagagatcctcctgcctcagcctcccaaagtgctgggactacagacataagccaccactccgtcataaatgttgatacatctgtataattaaatactaagctagcatcaaaaactatactttcaagccaggcatggtgatggtgtgtgcctgaaatctcagctactcaggaggctgaggtggaaggactgcttcagcgcaggagttcaagaccagcctgggcaacatagtgagaccctgtctcaaataaaaaaaaaagaaaagaacaaagaaaaactatactttcagagaattctgaatcacacggggaaaaaagctctcatcacaaccaagtgaataaatagatccacagagtgttacctgtcaacacttcacagtgttcacagtgttatctcaatcatgttactacaaataagttcacaaaaaattagcatatttacagtggttatcttggatagtgggactgtggtaaaattttctttttctaaaataaggctgaaatttcctaaaaattcattttcaggccaggtgcagtggctcatgcctgcacttggaggggtagggggtggtctaccccattccaggcagtgacagcagtacctgacaactagagctgcctgcccaagggtcacagcagcattgctgccatgtccccaaggccctagctgttacttctgtgtgcccaagagccctacccaagggtaccaagggtccccttccttaatgggtgttgagaatctcacatttgttagatcaaaattcaaggaaaaactcacagtaagtcaaagacgatgccatcgggagtgcagactgggtagacaaagggctgcagagagagactgaaaaaggacagtcattcctggtgagttgccacgcaccctggtcaggatgtgggctggctgagactggcatggtgacctcctgaaatgctgtcccagggagccctctctgggcagcctggccacctccctctctcaccaaccttctcctccaactacaatagtgtttgtgccacccctggtgaaggtctagagcaggatccaacaccaaggcaagctcctaacatcatgacgaggactctgcatcttctcccaacatgaactgaagggccacatcttcaaggcacacttttacgcataaccccacatccacaaggggcagattcactatcagacaggatcagagaacaattacaagggaaaggtaaactcgcaaaactcttacctgcagtggtcaaaaggtaaacgacgaaaatttgtttgtgggagatctgtttaaaaatgaaataaaaaacagaaatcttactctgtaaagtatttcatctatgtgcacctgctagcaattcagttacagcttatgaaaaagttcatgcaaatttttaagtacagcaattgctgtggattaaaaaccttttaacagataaaccaaaacacttggggtacatcaaaaaagaacttactgggaaaagtgcatactttttacttccattaaaattatgacagtgctcttgttattgtagtcttgatagttttgacagctgaaaatattatcattctttttattccttataaacttgatagagaaaaaacatttaaatgtacatgtaattttgtatttcatttacttatttattttttacttagctcccagcatcggggaatattttaaattacattttacaaaaatcaccactaagatgaagcaggttcttctatcttgagtatatttctctttcatgaactgtgtcctcagcccattcgtctaccatagtttccgtgttcttgttgtctatttttacagctcactgtatcctgaagacacagttccttaataccactcccccaacggggaacagaaagactgcatgccttacctggcttcttgccaccataaaagtgagtgtattcagcacaggtaatgtacctgaagaagagaggaagataatgctaccaccaccacctttataaagaggacgaagtctttggaagtgagtaatctttgcttactcagcaaatgcttactaaatacctactatggggcgggcacggtggctaacgcctgtaatcccaacactttgggagcccgaggcaggcgaatcactagaggtcagaagtttaagacaagcctggccaacatggtgaaaccacgtctctactaaaaatacaaaaattagctgggcatggtggtgggtgcctgtaatcccagctactcgggaggctgaagcagagaattgcttgatcccgggaggcggaggttgcagtcagccaagatcacaccactgtactccagcctgggtgacagagtgagactctgtctcaaaaaaacaaacaaacaaaaaaacacctactatatgtcagccacacagtgataaacacaacagacatggagaccaggcacagtggctcacacctataatcccaacagtttgggaggccaaggcaggaagattgcttgagtccaggcgttggagaacagctggggcaacaaagcgagaatctgtctctacaagaaaatttaaaacttagccaggtgtgacagctcacacctgtggtcccagctactccaaagactaaggcaggaaggcaggttgaggctgcagtgagctgtgacagcaccactacactccagcctgggggacgggggagactctgtctcaaaaacaaacaaaacaaaaaacaaaaaaaaccggccgggcaaggtggctcacgcctataatcccagcactttgggaggccaaggcgggcagatcacgaggtcaggagatggagaccattctggctaacacggtgaaaccagtctctactaaaaaaaaaaaaaaaatagagggccaggcacggtggctcacacctgtaatcccagcattttgggaggccgaggcgggcggatcaccaggtcaggagatggagaccatcctggctaacacagtgaaaccccgtctctactgaaaatacaaaaaattagccgggcgtggtggcaggcgcctgtagtcccagctactcgggaggctgaggcaggagaatggcatgaacccgggaggcggagcttgcagtgagcggagaccatgccaccgcactccagcctgggcgacagagcgagactccgtctcaaaaaaaaaaaaaaatggtatcttattgccacaaagagtctgttttgtcaatcttatgatttctatttctttatttttatttattttatttattttttttttgagacggagtcttgctcgctgcccaggctggagtgcagttgtgcaatgtcggctcactgcaagctccacctcgtgagttcacgccattctcctgcctcagcctcccgagtagctggtactacaggcgcctgccaccacgcccagctgatttttttgtgtatttttagtagagatggggtttcaccgtgttagccaggatggtctcgatctcctgacctggtgatccacccgcctcagcctcccaaagtgctgggattacaggtgtgagccaccgtgcctggccccttatgatctctatttcaacattaatgctggtcagttgttgtgtctaagccacaaaagggagggggatataacaaggcacagctgatctctatcccatcatggccaggaactcagttttaaggttttcctggggttctcttggccacaagggtgtctgcttagccagtggggggacttagggttttatttttagtttacagggaggagcaggctcaagagctgaaaatcaagagttctgtttaaggcatattaaattcgagatgtctggcccggcacggtggctcacgcctgtaatcccagcactttgggaggcagaggtaggtcgatcactcgacgtcaggagttcgagaccggcctgaccaacatagtgaaaacctgtctctactaaaaatacaaaaattagcatgggcatggtggcaggcacctataatcccagctactggggaggctgaggtgggagaattgcttgaatgtgggaagtagaggttgcagtgagccaagacggcaccattgcactccagcctgggcgacagagcaagactccatctcaaaaaaaaaaaaaaaaaaaaaaaaaaaatttgagatgtctttcagtcctccagtggagatattaagtaagccactaactacacaagactggggaaagcagcttatagatgactgggaaattatatcacccacagagaatgtttatggaaaagaaacgtatgagatctgagagaagggaggagggtccagaaaggagactgggaaaagaaagaccgctgaagtcgatggaaaacaaagagcatgtgaaatcccagataccaaagaagggcttcagaaggagggagtggtcaacagtgggacatactgttgagaagcccaacaaaatgaggactgaggctgcccagacgcggtggctcacgcctgtaatcccaggactttgggaggccgaggcaggtggatcacctgaggtcaggagttcgagaccagcctgaccaacatggagaaaccccttctctactaaaaatacaaaattagctgggcatggtggcgtatgcctgtaatcccagctactcgggaggctgaggcaggaaaatctcttgaagccgggaagcggaggttgcggtgagccaagatctcaccattgcactctagcttgggcaacaagagcgaaactgcgtctcaaaaaaaaaaaaaaaaaaaaatgaggactgaggattgaatactatatttagcaacaagaagtcgctgggaacctgaaaagagaggccgctgaagtcgagagaaaacaaagagcaggtgaaatcccagataccaaaggagggcttcagaaagagggagtggtcaacggtgtgacatactgttgagaagcccaacagttctggggtcgaaattctgacttgagtggtttcaagagactcagaaaacagcatgaagccactagtctctcacttgttcttaagagaaacaacacggcggcagcgggaggggaacgtgggacgtggggcacggggcacgggtggatttttaaattttatttattatttttgagacagcgtctcgctctgtcgcccaggctggagtgcagtgacacgatctcggctcaccgcaacctccgcctcccgggttcaagcgattcccctgcctcagcctcccaaatagctaggattacaggcgcccgtcaccacgccccgctaatttttgtatttttagtagagacggggtttcaccgtattagccaggctggtcttgaactcctgacctcaggtgatccgcccgcctcggcctcccaaagtgctgtgattacaggtgagccactgcgcccgacctggtttgctttaaattagaaggctctgcagcacgtttgcaggctgataggcatgaaccagaacacagcgagacgtgaagtacggaagaggtagagactactcattcaagggcgaaactcgcgaacagacgggggacggtccgggcagaaccagagtaaggaaaaccgggctgcgctcgagcccgcagctgacgtcatcggagccgcggccccgggagagcgcggcggcccgagggtcattaccctgactggagacagggcggcagcttccgggaggaagtgacctttgggctgtgctctggggagtagctgagagggaaggcgagcggcgcgcagtgcgggacaggcggttcactgaggcagagtggagcgccgctcccgactgcggctcaacttacattttgtccttttggtgctgtcgcttccccatggcggagcggcggcggcgactagcgagcacgaaaaaacaacggctgacaactcagaccatggagccgcagccgagttccgtgaccacttccgggttccgcggcgcgccccggaaacgggcgcctggcgtgctgggaattgtggttcgctagcgccaggtgctcatgctcggaaggatcgcctgcccagtatggggtcctagctaggtgtgccatctcccgcaggcgtcttttcggggccgagctccctcagcctcgaagccccatcttcttgaggggtctgtctggaccgccttgtctacccccctagccacggctcagggccattcccatactgggttctcaggtcttatttatttattttcgagacagggtctcgctctgtcgcccaggttggagtgcagtggcacaatcacagctcactactgcctcgacctcccaggctcaagcgattctcccacctcagcctcccgagtagctacgggcacgcaccaccacacccggctaatttgttaattttttgtagagacaggctcttacaatgttgcccaggctggtctggagctcttgagctcaagcagtcctcccgccttggcctcccaaagtgctgggattacaggcctgaggcttcgcgcccggccagcgctcaggtctttttcaacgtcctcctagagcttcaagtctcatgagcctccaccccatcccttcccgcctccgtggcagatgccttcaaagccatgtaccactctcgttctactcgctcacttctcattctctctgcatattcggtccccaccgcctccaggcccctcggaggcccagcagcaggtggccatcaagcctagaggtccaaagccctacctgatcccttccgtctcttctgccagacccttcccttgggtcagatcagtaccttgggcccctagctacactcaggcccagggtaatcttgcctaggctcctaattttaaatgccatttgtatcccatgactcccagtactaagtcaccagcactccaggttcctgatctccacttgggtaaccactgatctgaaatgtaacatgtctggatgggcgtggtggctcacgcctgtaatcccagcactttgtgtgtgtgtgtgtgtgtgtgtgtgtgtgtgtgtttagtagagacggggtttcaccatgttagccaggatggtctcgatctcctgacctcctgattcgcctgccttggccttccaaagttccgggattacaggcgtgagccaccacgcccggccaatcccagcactttgagaggctgaggcaggcggatcacttgaggtcaggagttcaagactaacctggccaacatggcaaaaccccatctctactaaaaatacaaaaaattagcctggtgtggtggcacacacctgtaattccagctacttgggaggccgagacagtagcttgaactggggaggcagaggttgccgtgagccaagattaggccactgcatcccagcctgggtgacagagtgactctgcctaaaaaaattaaattaacatgtctggtcaaagtagaattttctttttttttttctttttttttttgacatggagttttgctcttgttgcccaggctggagtgcaatggtgtgatcttggctcactgcaacctccgcctcccaggttcaagcgattctcctgcctcagtctcccaggtagctgggattattacaggcatgcgccaccacgcctggctaattttgtatttttagtagagaaggggtttctccatgttggtcaggctggtctcgaactcccgacctcaggtgatcctcccgcctcagccctcccaaagtcctgggattacatgcatgagtcaccgcacccggccataaagcagaattttcaatcctccctcttctcccagtccccactctgctgagcagtaccaccatccacccagtcaccgaaagccagctatctttgccttatttcatggctggcttcttattctctaggttttaacataagtgtcacctccccagagagaccttccctaaccacccacttccatgcatctcccataaagtctgtcacaattcctcacaatttgtaatcctgtgtaattcagtctgtgtcccggtttactgagcaccctccctgacacaaccactgcctccatgacacacatacagtggatgggatgtagctccttaagggctggaatcttaggcccagcatggtggcagcacctgtgattccagctacttgggaggctgtagtggaaggatcacttgaggcccaggagtttgaggctgcagtaaactatgatcaagccactgcactctagcctgggcaacagagtgagatcctgtctctttaaaaaagggccggggtgtggggaggggacagtcggtgcggtggctcacgcctgtaattccagcactttgggaggctaaggcggttggatcacctgaggtcaggagttcgagaccagcctggctaacatggtgaagccctgtctctactaaaaatacaaaaattagctgggcgtggtggcatgtgcctgtgatcccagctcctcaggaggcctgaggcatggtgatcgcttgaacctgggaggcagaggttgcagtaagctgagatcgcgccactgcactacagcctgggcaacagagcacaactctgtctctaaataagcaagcaaacaaataaatacaaaccaattaaaaataacccatttgtggtgatgcaccatgatgactcagtcagaaagcaaaatgcaccaataacctaaaaattgaccccattggagaaatatttcaaaaagcaagaacagttgagtaaatgatgttccacccgtttgatggaatattttgtatctattgttattggtgaacttaaagatttattattattattattattattattattattactttttattttttgagatggagtctcgtactgttgcccaggctggagtacagtggcgtgatctcggctcactgcaagctccacctcccgggttcaagcaattctcctgcctcagcctcccgagtagctgggactacaggtgcctgcctccaccctctgggctcaagagattctcccactcacgcctcccaagtagctgggactacaggtgcgcaccaacatgcctggctaatttgaatacctgagctcaagtgatcccccacctcactcctcccaaattgctgggattacagtagtgcaccaccacgctcggccagaattctgaattgtctttttataaaacagtgtgagttccttacacaaaaagtcctctgaattcttttttttttttttaaagacagagtctcactttgtcgccaggctggagttcagtggcacgatcttggctcactgcaacctctgcctcctgggttcaagcgattcttctgcctcagcctcccaagtagctgggactgcaggcatgagccaccacgccctgctgatttttgtatttttagtagagacagggtttcaccatgttggccaggatggtctccatctcttgacctcgtgatccgcccgcctcagcctcctaaagtgctgggattataggtatgagccattgtgcccagccaaggcctttgaattcttattcattgctggatgcaaaatggtacagtctttttggaagacagtttggctatcgtaccctatgattcagcaagcatgctccttggtatttacccaaatgagttgaaaagttatgtatactctaaaacctccacacagatgtttatactgctttattcataattgcaaaacttggaggcaaccaggatatccttcattgggcgaatgataaaatgtggcatatccaggcaatggaatattattcaatgctgaaaaagatgagcggccaggtgtggtggcctaactgcctgcacctcttgactccccacttagcctgtgtgactcattcaggtctggcctccacctccaggcagtcctccatcccccaggctgggttcagacctccttagttcccagcgtgcccgaccccatctcctgtacccctaaccaagctcaaggtgggcacaagagatggtcccaatgtatctgctgagtgaatgaaagccacgtcattcttatggctcttctataaggtacttttcttcaaatgaggccaacaaacttatcctgagatttcctttctatcctccaggtgaagaatttggacatttcaagatctgaagtgaaattaaactggaatggcctgtcacgaaacccaaggaggtcgaaggggtttactctgggcttgagggaaatgaaaaaggagcatcttggggagtgtcccatgtgccagcctaggtcaccatttcttctcagtctgttagtgaatcctcacaaccatcctgagtgcttattctcattttacagtggaggggtctgggctcagaggttggctctgtgtaggcagtgcctgtgcccgtgctgtagaactgcacatgaggtgtggaggggcctggggctgacgtcccctctctgccctgtcttgcagccacatggttgatctgactggttgatctgactcccttggttctcaaccctggaggcttccatttctcatatgtggctggaaacagcctgcccaagctccattgccctggctccccctggtaagcatgcctccgcacctccctggggccagacaccatcctggctctaacccagtgcactgcaggcagagggtagcatggggagccatgcccacagggagaggcaggagtggggctggagatgtgggaggggccccctggttttccacctgtcctttgggagccccaggatcctgtctggtctacactatgcctacggtctttggtcccttccctccactgccctgcaagtcggtcagtgggagcctcccccactccaggcagtcctgggtgccccctgctcagaacaatcccaggggctctcctgggcctgtagccgtggatctcagccctctgcttttaagcagcagacccctctttgcagacagggtcttgatgcacaaagcagataaacggggtttgctctggttaaggcgttgggtgggggttgaaggcaccaaggggctccacctacttggctttaggcaagcaaggcagccccaggtgccagggggtgatgaggtcaccacggagaccatggtggtggtagcggcagaggtggcagcagggttggtggcaggcatggggaggtcaaccggtcccacaagaggttgggttctggtttcttctgtcttggcttctttctcgtcttcttggtgtctgcaacaaaaggtgccagtgagtgcctaccttgcagctggagcaggtagagtgggagccagacacagtggtatggggtcttcacgcagtccctccaacaggaaagtgagggggccccaaagaacaccatgaacaatacctagagccactgctgacaggggccaacatgccccatctcaccaacctcaccttggggggctacaggtgctgttggtccaacaatcagtggagggctcactctcaatgctccagaaagtgggacccccaggcaagctgggcctctccatgtgacacagaagtgagtagccccacactagtgtaggcacccacgaacacaaatatactgaaggaactgagcctgaatccaatcgagctttagagcaactgtccaagaaatacaggcagaggaggaagcaacccaccagcagaccgtaacagacgcaaacccgggaagtgggacttgccagaggacgacaccagacaggctatccctcctcaaaggggacttcaacagaagtggccaaggacccagggccatcccagtgtacatttgctgcccctgtgtggccacatatatggccccctttcatttcattctcacaaggttcccaatttagacactaattatacaatcaccctagttaaaaggaacctaagaggcctaacagccaaacataatgaatgtgtgagtctcactgggtcctgaggtgacaaaccaagtctagaaagacttctgtggcccatctaggagaggtgactatgaccagctgatgtcagagaactgttgtcaattatgtaaagtgtaacaatgacattgtgattatgtcagcaaatgtttgtttttgtagttgtcactttatagagacagggtctcactctgtatcacccacgctggagcacactggtgtgatcatagctcaccataacctcaaactcctgggctcaagctatcctcctgcctcagcctcccaagtagccaggactacaggcatgtgccaccacacctggctattttaaaaatttttttgtagagatggggtcttgctatgttgccaggctggtctccaactcctaggctcaagagattcttttacctcagcttcccaaagtgctgggattacaggcatgagctactgtgcccagccaaatgcctttttttttttttttgagatggagcttctctcttgtcacccaggctggagtgcagtagtgcgatcttggctcactgcaacctctacctcccaggtgcaagcgattcttctgcctcagccttccgaagtagctggaattacaggcaagcccagctaatttttctgtatttttagttgagacggggtttcaccatgttggccaggctggtcttgaactcctgacctcaggtgatccacctgcctcggcctcccaaagtgctaggattacaggcgtgaaccaccatgcttggcctttttttttttttttttttttttaattaagatgcattctaaagtagtcagaggtacaatgatgtctgagatttcccttcaaatacttcagaaaaaggcctagggttatggagagtgaaacacatttggcaagatggggacagttgctgaggctgacgacaggttcttgggggtgttcgctgtcatctccagttttgtacatgtttactttaataaaaagtgcctctttttttttaagtgccaaacacagggccagagacaagccacagggccacaccaaggacatggttggtcggtgccaggactctctcaacttttttttttttttttcgagacggagtctcactctgttgcccaggctggagtgcagtggcgctgtctcagctcactgcaacctccgcctcctgcgttcaagcaattctcctgcctcaggctcctaagtagctgggattacaggcacgcaccaccacgcctggctaatttttgtatttttagtagagacggtggtttcaccatgttggtcaggctggtctcgaactcctaatcttgtgatccgcccgcctcggccttgtcccaaagtgctgggattacaggcgtgagccaccgcacccggccttttttttttttttttttaattgattcaggtttgcttggttgcttgagccagccctacctacaggccttcatccaccactccaaaacactcaccaaggtgagcagtgagggctctctctctcggaaaggtggcccaacttgctcaggatcacacagccaggaaggaagtagcagagctgaagtcagtctcctaactaaagaatctagctaggggcagcgcctctcctcccaggtccagactgcccaggccccttcctgctctggataaaacctgatccaaggagggcaaatccaaccggaagaatggaggtggtcacctagccctcggcctggctgcactgggctcagacccccgcccagggcccagcacggggagaggttgatcctcgccccgggagtagaggtgcacgcggtggatgctctgcttcagctgctccacctgctcgtgcatctccagggcgcccatgctgttgcaatggttcagctccgcctgcacaacacagaagaacttcgcctgcaacaagagtaggagaggcagggcagggggaggtccggggcgtgagacgcctgcccgctccactccccaggctgtgcagcctcggctttctgatagatcctaccctgcagccccagctaggccgacggcgacctctccaccccacccccatccccggcccccaaagctccaatcgtcggagctctttcctaggggacggcggacccgggtagtgacagttcccgcccagccggtcccatgccccgcggccgcatccggaaaaaagagagcccgcgctgttccaattgtaccaccctctccgccagcgacgggttgcggacggggctgcggaagaggaggcgcagcgcgcgcccagtgtaggtgtccgcctgcctctccaagtcctcctcggagatctgctggcaggtcttgctctgcgggacctcgctgtcgaacttgtctaggatctctacgagcgagcgcggctggagagcccgggtggcctggaagcggagcaggcgtctgggcggggctcccgagggtctcggcgcgccgaccgccactccccccgaggccggagcgtggggtcaccaggggaggcggggcccgtcgtgcgggactgccgggacgcaccctctctccccacggccgcggcgcaggtgcggactctctagcctactgcagccgcgccgccccgccccagccaatccgcgcggaagccgggggcggggccaatccccagtcgcctgcctcaggcgacaatgcccgttgctctgggcacgcgcgctcacgacctcgagggggcgaacgcggctgcgcgggtcctggcccagttccgcaggggccatcgggcctttgacccgggtcgggctcttggctgcgccgaggacgtggttggtcagcaacttctttaaggtccccacctctcggcaggcccctagtcccctccgacgggcgcccctcctcgctgtctgtagcctcccgggcctcatccaggcaacgccccgagaacttcactctgcccctaacccctctagttcggacttttcaccctcctccctctccttcactctccattggcctccccagattctgcgctctcctcccctttacagccacttgtttgctctgtactcgctgcatctccggcccctcctcagtgtcctgttcctcctgctccacctcgctgtccttttcctcttgcccctcgaatgcgtttctgaaggtcctggcttcaccgtctcatctgggacgatcttacacacttcttgttcctgattagaacccataactgactgaaaaacacacccactgtgtctcacccttcagctccagacccacatccaaatgaccactggggacgattcttgggcatctcatgctgaacatgtccacattcacgcacagcttcttctccctgaaagctacttttcttacccctctcccctcctacttggtcagccactgaccccagccactaacaagggggtgcaccctggactgcgtcctcccttgtcccctccttgtcctccatcagccctgagatccatagtgtgcctgagacgtttaatcagatttttcatctcttactgctaaaccaccacccctcagctcttccaacataggaagtgacatttatttcctcctgcctggggacaaccaaagaagaatgaggtctgtcctgatcatcttgtctaggagtgcaggcagagagacttgtcaggtacacttgggctcaaatctctattctacttcctgccctggtgtgacttacaaaatgaaactttaaaatctatagtatgtgcctttttttctttctttttttctttctttctctctctctctctctctctctctctctctctctctctctctccctccctccctccctctctctctctctctttcttgtcggagtctcactttgtcgccaggctggagtgcaatagcgcgatctcagctcactgcaacctccgcctcccaggttcaagagactctcctgcgtcagcctccgtactagctgggactacaggcatacaccatcatacccagctaatttttgtatttttagtagaggcagggtttctccatattggccaggctggtcttgaactccagacctcaggtgatccccccgccctcggcctcccaaagagctgggattacaggcgtgagccaccgtgcctggccaggatgtgccttttttcatacaggacaagcacccccttgagggtggagcagatccctaatcaccctcccatcatgtcattccagtaacccatgcttcacactttatacctgtatttgtatttttaaaaagtgtaggccgggcacagtggcttacagctcccagcactttgggaggccgaggcgggtggatcacctgaggtcaggaattcgagaccagcctagcaaacatggcgaaaccctgtctctactaaaaatacaaaaattagccgggcgtagtggcacattcctgtaatcccagctacgcggaaggctgaggcaggagaattgcttgaacccaggaggcagaggttgcggtgaggcgagattgcaccattgcactccagcctgggcaacaagagcgaaactccgtctcaaaaaaagggtggggggttattgggcccctcctctttgtcagacactgccaagagatttttttttttttttttgagacggagtttccctcttgttgcctaggctggagtgcaatggcgcaatctcagctcaccgcaacctctccctcctggattcaagtgattctcctgcctcagcctcctgagtagctgggattacaggcatgcgccaccatacctggctaattttgtatatttattttttatattttcaagagggagtcttgccctgttgtccaggttggagtgcagtggcgcgatcttggctcactgcaacctctgccttccgggttcaagcagttctctgcctcagcctccctagtagctgggattacaggtgcccaccaccacacccggctaatttttgtgtgtgtgtgtgtgtgtttttagtagagatggggtttcaccatcttggccaggctggtcttgaactcctgaccttggacccacctgtctcagcctcccaaagtgatgggattacaggcgtgagccactgcgcccagcctaattttgtatatttagtagagatggggtttctccatgttggtcaggctggtctcaaactcccgaacttaggtgatccacctgcctcggcctcccaaagtgctgggattacaggcatgagccactgcgcctggccagagattttttaaatgacagttgtctctgcctcaggggctcccagtctaatggacacttctgccacagggagaacattttgatttaggccgggtgcggtggctcatgcctgtaatcccagcactttgggaggcccagaagggcagatcatgaggtcaggagttcgagactagcctggccaacatagtgaatccccgtttctactaaaaatacaaaaattactgggtgtggtagcacctgtagtcccagctattcgggaggccgaggcaggagaatcgcttaaacccgggaggcggagtttgcagtgagccaagatcgtgccactgcactccagcctgggcgacagagcaagactccatctaaaaaaaaaaaaatttgatttaacaagctgttctggaggaatattcaatgctgtgaagcccagagaaggcttccattgggagggagccagtgagcagagccctgagttcagtctccccgcagcaagagcaggagacagctgcatgggggtctccagccagtgggtacagaatctgtacaggactgaggggtggccacctccagccatggcccctggtgcctagaggaagggaggatggatctaagtcagatgaccctaggatcaaggaaccccaagggatcaggactaggaagccaaggagcatgtgtcattgcccctgttcctcccacgggtgccagggcttctctccccagggtaggggtaaagcagtttcccaatgcgcccagctagggatgaggggaactcccaaaagcccatctggaaacctagtcctcctctaaagaagatttgaatgactgtgactgggcacgtagaaaccttttgcaccgtgtcaggtcttgatggtagaggtggtcatccaagcatgcctggggtcaggctccttggaagttcagctccaaccctgtattccagctgggacggttggaatgttagacacctcagtccctcctgcaggttcagggcacacctctctgtaagagaacaaactggcatggttggtagacatcatttgcaggctttgtatcccaagtccacccatccatctcacatagtaccactccagctgagtccactcaactgatcagtcaactggtcagtccatagtaccactccagctgacgtcctggggtgaaggctgcctcctgaaaggcctgccttacccccttacccaactgccacccagaagaacattctctccagagcctggccctgttcaagcttccagcaaggactgggcccaagccaggcctagaatgatcttccatgcaaaagactgggcgtgtatttcccctaagaccctgaccaggcctggagttccagtcttaccccagggacccaatgtggaaagaccttcaaacaagagcttttcagaagctggggaggtctgctcctgcacctgtccagccatgacaggatggagagtttagggatgattctccagctctgcacccacctgatcctctgatggagggtccagtccagcttcacatctgtgcctaatcagtggaaacacttaccctctgggcacctcaaccttctcaactggaaagtggagtgaggcagcaagctccctttccccctcccagggtagcaggctggacctgaccgatgccctttcatcattgcactgcttcccagcggcctatagtagtgcaacagggaaagagtgtcgggcaggcctgccagtgcctcccccagggtggtctgcagggatctgagacctggaatgcaggctggctggggcggggcctctgcccggggggaaagggtgccctctgaccccagaggcccaggcctgtctagaatctcaagtttccatggagaagggagcgaattgggtaggggggaggggagggcctgcaagcccaaggggccctgcctggggagtgggaggtgagggttatagggagggagatccccaaggctggtcccagatgctttgacaatatcattgcactgcttctcagagcacagtagtgcaacctcgtcagagcacctgcggccagcaggggggaccccaccacccccaatacacgcagggcgggaagctcaaccatggatgggtgggtggggcagagcccccgtccagtccatccgggcagggaaggagaccgcagcggggtgcgtccctggggtcttcagaacccaggacacccaggcctttcccagaacgctccggattgaggtggaggagaaaccccagactagggggttgttccaatcccggagcaggagctgacgggccacgcaggggagggggcgcacacacaaagacgaacccgcactcagccgcagtccaaagccggctagcgcccggagcggggtgggtacagcccgacgaccctgcgccctgactcggcccgcggctccaggagaaaaagggcggccccaccccgggacgacgcgccccttctagctgacgactccatccctggccccttgccctgcactagatacactctggattcttttctaacatattcttctgcctggaggcccagagtggagcagaggatgggggctccccgcccttctagagttccctgctccaaagagggcccccgggatcccggccgcgcccctccgcctgacccgccgagtagggccgcccagcccagcccaggatcccctcctcagacacagctgactcacgcagacatcccttccgcccagggcccggtcaggacgcggagggttagacggaagaggatcccggccatcgtctgcccccgggtccccgtccagacgaccctgcacctcgtggcggcccctcgcctgccggctccatctttaacccgctgacagtcggaggggccgggcccccgactccttagcatagcgctgcgctcattggccggcgctggcgcggggattcgcctcctgcatgcctgttggctgagacgggagagatttcaaaatagcctccgggttccgattggcccggcgccggccgagtctcgggctccgtggttttaacaatgagttctacaaacactttttccccattcataacttatcaaaaggaactttgcccgccttttctcagctccaatctctgcgagttttctagcgacaccgacaagagcgcttggaagcccggtgaggggcgccaggcgcgagcccacagtgggggaggccgagaccctgtggaaattcccgaacccccgccaagcctgctgtgaacgcggccgcgggctgctttgttatgcatgctgaggttgctctctgcgcctcctggatgggatatttggacgtggtgggcttacaaactggggtagcccccctcccaactcaaccaccccggatcgcccggcaggacgcgagtgaggctttcctgaaaacccccgggtatggctgggctatggagaccgggtcctgggccccgtggtcttttggatctgtgggagatatggggaacggaagtgtaagctttggtttcttcgtgattgtgatccactttgcggagaagcattcattaagcgcctacccttcgctgatgactaggaagtatattgatcaccgggctgttgaacggctcctagagggaagggaggagctgtgcttagacaactgtgcccctgcaacccctcctgctttattatcggtccaatggctgagagcaaatgtttttgaggcaggcagaggtggttttgaatctttatgaacccctgttgccttcttgcaaaattgagatggcaatcaaacctgccccatagggctggctgttgccagcagcaaatgagatgctgtgtaaattgttggcccagcacctggcatttagtaagtgttcactgaaagtgagttctgctgccactacagtttttatttttggccttgtcctgcattctgcctggaacaatcttatctgctcccacagcatgggctttggttgcccagggattcccacttgtgcactgttgggttcctcttggtcaacactcctcacctcactgcttacctatgtgtggtaacggaggtgggggaatagacagagagggaggagtgggctttgacagcccataggagctggggctggaccagaggagtgcccccttggatttgcagggtgatatggtttggctctgtgtccccagcctaatctcatctagaattgtaatccccaagtgtcaagggagggacctggtgggaggtgattggatcatgggggcactttcccccatgctgttctcgtaatagtgaaggagttctcacaagatctgatggttttaaaagtggcagtttcccagcctggccaacatggtgaaacgctgtctctactaaaaatacaaaaattagccaggtgtggtggtgtacgcctgtagtcccagctactcaggagactgaggcaggagaatcacttgaacctgggaggtggacgttgcagtaagccgatatcacaccactgcactccagcccgggcgacaaagcaggactccatctcaaaaataaataaaagtggcagtttcccctgagcactctctctctcctgtcactgtgtaagacatggcttgcttcccctttgccttccaccaggactataagtttcctgaggcctctccagccatgcagaactgtgagtcaattaaatctcttgtttataagttacccagtcccaagaagtatcatttttttttttttaactgagacagagtttcgctctcatcacctaggctggagtgcaatggcacgatcttggctcactgcaacctctgcctcccaggtttcaagcaattctcctgcctcagcctcctaagcagctgggattacaggtgcccaccactactcccagctaatttttgtttttgttttcagacggagtttctctcctgtcacccaggctggaatgcaatggtgcgatctcggctcactgtgacttccgcctcccaggttcaagtgattctcctgcctcactctccagagtagctgggattacaggcgcccgccagcaagcccagctaattttttgtgtttttagtagagacggggttttaccatgttggccaggctggtctcaaatgcctgacctcaggtgatccacccgcctcggcctcccaaagtggtgggattacaggcgtgagccaccgtgcctggccactcccagcgaatttttgtatttttagtagagacaaggtttcaccacgttggccaggctggtctcgaactcctgccctcaggtgatccacctgcctctgcctcccaaaggcatgagccaccatgcccagcctcaggtagtatctttatagcagtgtgagaacggatgaatacataggatgtagtctaccctgttggtgccccacccatatccccttggcacttacctctacagaaaggatgctcatggccagcacctgaggctcagcctgggggccttattctggcttcaggagtcccttacccagtgtacaaggccagtgcaaagtgctacagagtggctccccccacccactcagcagacccagcctgtgagggaaactactttgggaggtaagtacctcacttccttgccccttgagtggaatagcttttatttatttatttatttatttatttatttatttatttattgagacactctcactctgtcgcccaggctggagtgcctcagccacccaagtagctgggattatgggcatgcatcaccatgcccagttaatttttgtatttttttttagtagagctggggtttcgccttcttggccagaccggtcttgaactcctagcttcaagtgatccgcccgccttggtctcccaatgtactgggattacacatgagagccactgcacccagctgggtgggataactttgatgcacgttctgcactgggtcccagagatccccagtgggattgagctccagttgcccaaaggggtaacttgctcaataatgcacctttcactagcttctttcccttcccctctcacagccccattcctctgtgccagcattttctggaatcacctcccaacaatatacttccattcaaatcctctcaggtcagatgagtaatgggagagatggatagacttgtagatgatcctcaagaagtttaacgatgaagccaggtgcagtggctcatggctgtaattccagcactttcagaagccaaggcgagggccaggcacagtggctcatgcctgcaatcccagcactttgggaggccgaggcaggcacatcacctgaggtcaggagttcgagaccagcctggccaacatggcaaaagcccgtctctacaatacaaaaattagccaggtgtggtggcacttgcctgtaatcccagctattcgggaggctaggaaggagaattacttgaacctgggaggcggaggttgcatagagccacggcactgcctgggcgacagagtgagactccacctcaaaaaaaaaaaaaaaaaaaggaaagaaaaaaaggaaaccaaagtgggaggatcactcaagcccaggagtttgagaccagcctgggcaacatagcaaaaccctatctctacataaaatttaacaattagccaggtgtggtatggcatgcctgtggtcccagctactcaggaggctgaggtgggacaacctcttaagcccaggagatagaggctgcagtgagctgtgattgcgccactatactccagcctgggtgacagaccaagatcctatctccccaaaaaaataaaaaagaaaaagccaggtgctgtggcttacacctacaatcccaacactttgggaggctgagatgggagaattgcttaagcccaggagtccaaattcacaattggctagagcttttctcccaccccctcaccccaccccaaggctttttttttttttgagatgggatcttgctatgttgcccaggctggagtgcagtggcacgatcttggctcactgcaagctccacctcccgggttcacgccattctcctgcctcagcctcccgagtagctgggactacaggcaccgccaccacatccagctaatttttttgtgtttttagcagagacggggtttcaccatgttagccaggatggtctcaatctcctgacctcgtgattcacccacctcagcctcccaaagtgctgcgattacaggtgtaagccaccatgcccggccttttttttttttttgagatggagtctcactctgtcacccaggctggagtgcagtggtgcaatctcggctcactgcaacctccgcctcccgggttcatgccattctcctgcctcagcctcccaagtagctgggactacagacgcccgccagcacgcctggctaatttttgtatttttagtagagatggggtttcaccgtgttagccaggatggtctcgatctcctgaccttgtgatccgccggccttggcctcccaaagtgctgggattacaggcgtgagccaccatgcctggccccccccccccttttttttcttttttaaagagacagagtctgttgcccagctggaatgcagtagcaccatcatagctcactgcagtctccaactcttgggctcaagcaatccttccacttcagcttcccaaagcactgagattacaggcgtgtgccaccatgtccagctgctccatcctttaataaggtcaactgaggccaggcgtggtggtgcaagcctgtaatcccagcactttggcaggctgaggtgagcagatcacttgagtccaggagttcgagacaagtgtgagcaacatggcaaaaccctgtctctagaaaaaatacaacaattagctgggtgtggtggtgcatgcctgtagtcccagctactccagaggctgaggtgggaagatcatttaaacctgcgaggtggaggttgcagtgaaccgagattgcaccacttcactccagcctgggcaacagaggcattgacaacaacaaaaaaccacgaaaggtcaattgatttctccagtgcaaggtgctctgtccacactattccgagcctctttcagccagctgccacccctagcctctccttgggctcttttgttctgcttcagggaagcaaaccgttatactcagtagctcccatggccgacccacagcagcccagctaagttatcaagtccaggaagcctgtaatctctgccataaccgctagaggccaccaacacaccagcaaagctaacagttctcttcctttattagggctctcctatttcgtctgctcctgccttaaaggtacgatactctggcctgcccaaattgtgcctactcttccaggcagccttctcagatctctgcaggtagcagttttatgtggctgccttcccttgcaatatcttctgtagttctgttatttcattgagactttcaaaggtcgtggtgggggcctgagatgccatgtgcctatggtggggtgccatttgcacccggtgagtgaaactgcaatgctactttccagcagatgggcagaatcctcacctgtcccttggtcatatacaggtgtcaagactgccacaactgacaggagagtgagctcctcacatctagggatgagggagctggagagcttgtgccccatcccagctgacagggagtggggctcccacccatcctgctctgaggtctggccttggcccttaacaggaaggttcataaagctaaggggctggggacctggggtcacttgccatcagaccgcctcagggtggacagggggatgcccagggcagcactggagtacatggaagaccactgaaaaggttaagattgcacagtggcggctgggcgcggtggctcatgcctgtaatcctagcacttcgggaggccaaggcgggcagatcacgaggttggcagatcatgaggtcaggagatccagaccatcctggctaacacggtgaaaccccgtctctactaaaaatacaaaaaaattagccaggcgtggtggcaggtgcttgtagtcccagctacttgggaggctgaggcaggagaatggtgtgaacctgggaggcagagcttgcagtgagccgagatcgcgccactgcactccagcctgggtgacagagcgagactccgtctcaaaaaaaaaaaaaaaaaaaaaaaaagattgcacagtggcatccacctgtaatcccagccacttgagagactgaggcaggaggaggcttgagccatgcagttcgagtccagccaggacaaaacagtaagaccctgtctcaaaataaaagtaatacaactgtaatcccagcactttatgggggcagaggtggaaggatcatttgagctcaggaatttgagacccaccagggcagcacagtgagaccttgtctctactaaaacaattttaaaaattagccagagagggcagacacggtggctcatgcctataatcccagcactttgggagggcgaggtgggcagatcacctgaggctgggagttcgagaccagcctggccaacatcatgaaaccccatctctactaaaaatgcaaacattagctgggcgtggtggcacgtgcctgtaatcccagctactcaggaggctgaggcaggagaatggcttgaacctgggaggcggaatctgcagtgagcggagattgtgtcactgcactccagcctggcaacagagcaagacgccatctcaaaaaaaaaaaaattagccaggcatggtggcacatgcctgtagtcccagctacttgggaggctgaggtgggaaaatcacttgagcccagaatgcggtgagctatgatcactgccagtacaccagcctggatgacagagcaagatcctgtctcatcagaaataataattagatgggcatggtggtgtgtgcctgtagtcccagctagtcaggaggctgaagtggaaagatcacttgagcccaggagttcaagtttacagtgagctatgatcatgccactgcactccagactgggcaacggagtgagaccatctctaaaaaagcaaaaccggcctggcgcggtggctcacgcctgtaatcccagcactttgggaggccgaggcgggcagatcacgaggtcaggagattgaaaccatcctggctaacacagtgaaaccccgtctctactaaaaatacaaaacaaattagccgggcacagtggcgggtgcctgtagtcccagctacttgggaggctgaggcaggagaatggcgtgaacccaggaggcggagcttgcagtgagccgagatagtgccattgcactccagcctgggtgacagagcaagactccgcctcaaaaaaaaaaaaaaaaaaaaaaagcaaaacccaggccgggcatggtggctcacacctttaatcccagcactttgggaggctgaggtaggcagatcacctgaggtcaggggttcgagaccagcctggccaacatggtgaaaccccatctctacttaaaatatatatataaaaattaaccgggtgtggtagcaggtgcctataatcccagctcctcgggaggctgaggcaggagaatcacttgaacccgggagacggagatggcagtgagctgagattacgccattgcactccagcctgggggacaagagcgagagttcgtctcaaaaaaaaaaaaaaaagcaaacctcccccccgccccccgaaaaaaaaataataaagggtttggacagattcagcagtcaggctgggctggagacaggttttgcactgaggaagaaatgatcaactgggcctgggctggcacctcctggtcatcctcaggctcacagtgaaacgcaatcatagaccaacattctttaatcacaaaggcacttgaggacccctacaaacccaaagtctctgccaagagtggccctgcagacgccccacctgccaccctccatccacccatccatccacacactcagagttcatcgtgacctgcagagggctccacactaggcttgatgaagatgccttccatggccttccacgtattgtgcgtgttggcactgggcatgccgtggacctcatgctgcccacggatggggcttccatactgctcacccgtgactgacaggaacacagaggtgcccacatgctggaagcgcacagcagcctcacgctcccagtgctgtccagagcagcgcactgtccataggtccaggtcgtcgccctcgccgtcttccccaaaggcactcacctcctataggtgcaaaggatgagaagacagtggtcaccacagaaggcggcattcgcacctagtacaccgagcctcgggttcttccctacccttcctggagcctcagctcccacagctgcaaaaggtgacaccatgacccgcccccgcaacctctagcactccctccccagcatgggctcttcagacacatgcacacaccattgcatctgtctgtgcagagaccactggtccccacggagctaaggcctcctcctccacattttcccagtcctaacccctctgacctaccttcagcctaaaattcagcccctcaggctaacagtcaagctgtctatctatctcaaacattttcttccaccagctccccaagggcacccactgttccattccaatcccctgaattccaatgacctccatgcattggcacaatctcttctgctggcctgggaagtctctctttcccctttgtggcttgtaggactcctaatcatcctttcagatctagcctgagttcctcctccccagtggagtttcctattccccaccctcaaggctgtgtggattcccctcctgggtcccacttgccaccagaggaagagctatccaggcgtatctctccggatctctctcccgtcgttctccctgccgggccgggagcacctgagggcaggatcctggcggagttactctgtgtcccccgagggggcgctcagtaaccatctctgaagtgaaatttccatttcacgaagaagctgaggctcggattggaacccagggctctgtctctggcccctcacacaggccaggagtctctctgggggctccgggaggggctcacctggttgttggacagcggcgacgggaagtggtgcgtgtgcaggttcttgcccgtaagcacatgcgtgagcctcaccgcctgcccgcagcgcaccggggacccgcgcgggcacccgccctccgagccgccgcggatccgccagtagctattggcgtcgtccgacgcctctacgccggtcaccgattgctggccgctgcctgaggagtgacaccccacacacccagggtctccgtcaatcgcggaaccccggaccctcgccctgggaccagaacatgtcccaggggaccccaagggctcacccccagcccccgcctgacaccccctcagtctttgggcccgcagttccccgacgaccgtccccaccctcaatatcctcgacaccctcaaagctttggcccctcgacctcccaacgactctagagcccccgccgcccggcttccagacggcccacagacccccatgaccaccctgtctccacactcccaaccccgagccccggttccccgcgctctcccagtcgctggccccacgcaccggatccgtatttgatgtcgtgcgagtgcagccgcacgcggtggtgcgtattgagcagcttcagcaccgacccgcaggtcacgagctccgcaccggtcttggcggcaccaccgcccggcactaacagcgccagcagcagccccaacagcaccggccaggcagccccgccgcggcccgcgctccacatcgccccggcccggctccagcccctcgggcccaggggccgcttccgtccccgccgcggcccaatccggttctgacagcgcccgcttgcggcagccaatagtcggcccgcgcggcactccgcttgcactgccactgggtcagcgcggggagggcccgcccccggttcgcgagagccgtagctgggcggggactggagacacgaggagggttttgattggtccacgcttccgaggacttaccaatgagtgcccagggaagggcggctgagtctccgagccgcggagagtgagcgtgaacagttggtgaagacgcggctcctcgcagccggtgagtccctggacaccggctcaggatcctaggaccctgcaggcacgttttcacgacgccccttgatcctggactcctgggcactcagtaatgagtctctcccctcagaacctgggcccgcagctgcagggtcttgaggttgttggatcgctagattttgtggtcacaaagtcgacagatcccggggtcactgaatcgggatcagtccttaagtccctggaccccgggattaatgaaacctccagtcattcggccctaggccctctctgatactgggtcaccacagtccctagaccctggggtttctgaattcccctggccacttatacatttgactcctttcgtggctaaatctcgtggtcactgggtcatcgggcaggagagggcagcagggagctgtagcgttgagaataatggcagcttctcaccagaaagtcccaaagctgtcttaggaaaccagagtcaaaggagaccaaggggctgtgggaaccatgcctgggcgaccgtgtcccaggtctcctggccatgagtaggtctccttcttgccgccttctcagagtgttgtcagctcaaccttcaagggaggaaaacttacacctctgtttatttattcattcatgggacattgttacagcagcttcactccagatcctgtggggtcacagagcaaatagctctgggctcaagagtctgactagggtgtagttgaagcacaggcaaagcagagagaaaagttcatatttaattaaatcatccagaattttgcgttcagaaaatccagagtaaagccattttcattacagcaacatgttattttgggggtttcgtgtttaatactgttttgattttgagttacatgtagtataagacaccttgatcttttcagcatttaggtgtccaaacggttaaaagtcagtctgccctggatttggtagtccctgcacttgaggggtctccagtctagggtggaagagctgaagtactatctgagaggcgatggatatatactcttggacatgtcagccatcatctcaaaatcagcacatccaaagcagaattcctggtctccgccctcaaactacccctcccccaggcttatgagtctcagtaaatggcacctccattctgcagatgctcaggcccaaaacttgggattcttctttcattcgtctctttaccttgctcctcacatctcattcaacaatttttttttctttaatacggagtttcgctcttgttacccaggctggagtgtaatggcgcgatctcggctcactgcaacctccacctcctgggttcaagtgattctcctgcctcagcctcctgagtatctgggattacaggcatgcatcatcacgcccggctacttttttaaatatatttagtagagacagggtttcaccatgttgaccaggctggtctcaaacttctgacctcaggtgatccacctgcctcagcctcccaaagtgctgggattacaggcatgagccaccacggcacccagcctttttttttttttttttcaaacttttgagtctcccatgtgcatcattcaagaagtctttttttttttttttttttttttttttttgagacggagtcttactctgtcactcaggctggagtgcagtggcacgatctcggctcactgctgcaacctctgcctcccgggttcaggcaattctcctgcctcagccccctgagtagctgggattacaggcatgtatcaccacacccagctaatttttgtatttttagtagagacgggttttcaccatgttggcctggctaatttgtgtacttttagttgagacggggtttcaccatgttggcctggctggtcttgaactcctgacctcaggtgatccacccgccttggccttccaaagtgttaagattacaggtataggccgggcccggtggcccacacctgtaatcccagcactttgggaggcgaaggcaggaggatcacctgaggtcaggaattccagaccagacatggtgaaaccccgtctctactaaaaatgcaaaaattagccaggcatggtctcatgtgcctgtaatcccagctgctcggagggcggaggtgggagaatcacttgaacccaggaggcagaggttgcagtgagccaagatcgcgccactgtcctccatcctgggcaataaagtaagacttcgtctcaaaagaaaagtggtaaaagcatagatcaaaagatcatgccagttccctgctagaacctgccagccatttcccaattgcatttaggaccgtaggaggctgaggacacagcaggcaatcttcctgacaagcaagataggattctaagtaggctgagataccagacccagagttggggaagccaacgtagcactcccttgactctcaggggcagcctggtcgcctctctttgctgttcccttctccggcctcctgctgcagaccaccttcccctgctcaccctatgggcagctcctcagggctgattatggcatctccagtgccctccacctaccaactataatttgtcttaaggttcaggttctcaagagagaatctgattggctcaacaagggctgctcaaggtacaatcagctgtggagaggaggaagggtggtagctagtctccaaatatgaccactaacaattcctcccatccccataagccaaagaaaagacatggagtccatttcgcctttccttgaatctgagtaggtagcgcaacttgttttgttttgttttgttttgttttgtttttttgagacggagtctcgctctgtcgcccaggctggagtacagtggcgcgatctcggctcactgcaagctccgcctcccgggttcacgccattctcctgcctcagcctcccgagtagctgggcctacaggcgcccgccaccgagcccggctaattttttgtatttttagtagagacggggtttcaccgtggtctcgatctcctgacctcgtgatccgcccgcctcggcctcccaaagtgctgggattacaggctggagccaccgagccccgctacgcaacttgttttgaccaatcgaatgccgaagaagtgctgtttggggacttctgagcaccggccataagaacgctggcaggtctggctttatccttctaggaagctagagaatgcaccttactgtaatgaagtgccagattactacgtggtaagaggccacatagagagggaccctggaatgctccagcctcagttcaatgagcagctgaaagcagtcacatgagcaactccaatgtacaccactactccactgagccggtcaaactccagtgttgggcggggcacagttgctcatgccgttaatcccagtgctttggcaggccgaggtgggcggatcgcttgagcccaggagttcgagaccagcctggccaatacagtgaaaccctgtctctatcaaaaatacaaaattggcagggcgcagtggctcacgcctgtaatcccagcactttgggaggccgaggcagatggatcacgaggtcaggagatcgagaccaccctggctaacacggtgaaaccccgtctctactaaaaatacaaaaaaattagccgggcatggtggtgggtgcctgtagtcccagctactcaggaggctgaggcaggagaatggcatgaacccaggaggcggagcttgcagtgagcagagatcacgccactgcactccaccctgggcgacagagcaagactccgtctccaaaaaaacaacaaaaaaaatttagcccgacatggtggcgcacgcctgtagtcccagctactcaagaggctgaggcaggagaatcccttgaacccgggaggtagaggttgtggtgagccgggatcgcaccaaggcactccagcctgggcaacagagcaagaatccatctcaaaaaataaaaataaaaataaaagccaggtgtggtagttcatgcgtgtaatcccagcactttgggaggctgaagcgggcaaatcaactgaggtcaggagttcgagaccagcctgtccaacatagtgaaacgccatctctactaaaaatacaaaaaaaattagtggccaggtgtggtggttcatgcctgtaatccctgcactttgggatgcagaggttggcggattacttgaggtcaggaattcgagaccaccctggccaacacggtgaaaccccgtctctactaaaaataaaaaaattaactgggcatggtggtgggtgcctgtagtcccagcaactcaggaggctgaggaggcagaattgtctgaagccaggaagtggaggttgcagtgagctgagatcatgtcactgcacttcagcctgggagatagagcaagacttttttttttcttttttttttttagacacagtctcactctgtcacccaggctggagtgcagtgatgcaatctcggctcactgcaacctctgcttccccaggttaaagccattctcctgcctcaacctcccaagtagctgggattacaggcacctgccaccacacctggctaatttttgtatttagtagagacagggtttcaccatgttggctaggctggtctccaactcctggcctcaagtgatctgcccacatcagcctttcaaagtgttgggattacaggcatgagcccggccaagacttcatcttaaatataaataaacaaataagtaaataaataaaatggcggctgaaatctcaggacagcaaacctgtgtcccagcaacacaggctttatttctatttctttcactggctcccttgagagtctcagcagagctcctcgtgggcattcagcctgtggtgactcctgctcttggcaggggctggtgtgatgtgcagcaactctgacagagcagggaatcgagtggctagtggggacttcatggtgggtcaccgtggcccacgtccacggagtggctgaccgaggcctcctctccaggctctgggaggctctagactccatcctcatccttgtcctcatcctggtcttcatccttgaactcatcctcatcttcatcttcaatctcggctttatcacggccctcattgtccatgtccttggacttggggggactggaacccatgccggtgcaggcagacatgtagagcttgggctccaaagggctgagctgccggctggctggcaagttggtgtagagggagcggcagggctctgtggcctggtcctgggcagtgtgggtggctggttcctgctgcacagagggtgtctctgtgctgcagtgggaggtgctgagccgggaggcctgccgggcccttttggactcctccagtttacgcagcaggcagctccggtgggtctccgaggacaggtggatgcgggagccttttaccttctttaagcccagggaaaggtccctgagcacgtgggtgatggggaaggagaagaagcccagctgcttactgaggtccttttcgaactcgtacttgcggatgaccaaggaggctgcctgctgggtcaggaagtcggcgagctcctcataaaggcggttggagaagtgagacatgctggacttcgacgagatggagggcagcggcttcttcttcgtgaacctgctgctgctgcaggggctctgcatagcagccggggagggaaagggacacatgtcacacctgccagccccatccctctgtgacaccccttccagccactgtgccctcctcagagccctgccagccctgcccatcacaaacatgaatgggtacccttagtgtgacaaacacatttgccacacgaagggtacagccttaccacacctgctatgctgttgcactcaactgcccactctcatgctcacctcgccatcacacctcctacaactgttgggcctggggcaagggcagggacctgtcacagggtaaggctaatctgagccttgacaactgggtttgggcaggctcctgcccaggcctgtgcccagagacagctgcaggggccttgatggctgaggaaagggtcgagggaccgtgctggagacccaccagtgtgaggccacctacgtcttgtacacatcctccctgggcaacttcccctcagcaaagtccagggactggagagtcctgctcgaggcagctggattcaagggagctagacctaggaggcaaggccccggctgggcttgggctgctgtccacaagggacgggactttccacccccatgtaggagcgtctctagattcacatacaaacgttagaaaaaatacccagcataaaaaatagcctttatttatctgtgacaacacctggtaatagctaggccaggattcatgggcccccatcagcttgacccctgcccaggaggtttccacagtgcagggcaagagaccttgaccttgagcacctgttagtgacagtggctgctaggagtggtgggtcaaggagcccttctcctgcaaactcatgcccggtcctacttttgaggaggtcacctctggacacagtgaggcgggagatgaagaggcaactggagagagctcagggagaaggtagcaggaagagcgggggtagggggaggaaagtggaggtgtgacagggcccctgaggtggccctggctgcaggccacctccaccacaatccctggcgtgggcagggtgaggtgcaggccctgccagggctgggccctctggctggagctcagggaaacaggtgggttttgtaatttgggatctgagtcaggtgcctcctccctggagtggagtgaggggctggggacattgggcttctccgtgggtgtcaccttgagtttgaatctggtggccacctgggcactagacatggagggggagcctcctctgtccttgcgttttctctgaagcatcttggggctggagactgtggggcggggggaagcatagggctgcccgccattggtgggtttagctggctcagagcccagaggcggcagatctgaggtgggctccaagctggtggggaacagaggacggccgtcgcggcagtgggcgccacggagcttatccacagcctggctgaccacgctttgcagggcagggaagaggcggtggtcagccaggaagttcagcgtgcgatggggctcacggagcggacagtagccaggcaggtcgagggactccagctggctcagtaatgacttgatctccttattgaactctcgcttgcggaagattggctcctgttctccaggcctcggctctgatgcttcaggcacgccagagcttgagcccagcagccctgagaaccaggacaagggctgctcctgtgtccactgaaagctggtctggctacccagcgaatcccacagcagggagtccctctgggagcaggactgactgaggcctttctgcagaaagagggtgactctgtgaagtgttcaggagcagccaagccagggctgaccctagccctgggctctccatgggagtccaccccacccagccatggccctggctctcaccccttccctctccagctgtagcagccgcttgaggttcttctccagcaggagtttgtccctcacaggtggcaatgagccttgggcacctaggtcactgtcccggctgtgggagcccagacagccggccatgaggctgctatggcagttggacatggagctggagctggatgggtagttgttggggtgtccagtgcagagggtcggccgtacacggtgccggtgtacggtgctgaggctgggccgggcatgtgcccgccgtccaccacttggcacctccactgggtcctgcacctccacaagcggcaccccagcctccgtcttcatggcagccatgcgctcagtcgccttctccaccactgtctccaggctgtccaggacctggctctcagttaggaaatccagaaagtggccaaagggctgagggtgcctcttgtttcggcgttggccctggagtgctgagctgccacatgtggatggtgggtgtggcacacggcccggcttgcaggctggccgcatttctgggaccagtggcttcttgggcagctgcacctgagcagacaggtatgtcacagggggcaggggtgccctacaggtgaagggttccctggggtaacactaggacctgggtgggagtgagtagtggaaggagctgcattttggagtctggaagccctgggtttggaccctggctctgccacctacagcctgatgccagtgtgcaagatggcccctcttgaggtccaatgtcctcatctgcaaagtggaggtctattcagggtcaccccgaagctttcctaacacctacatttcacacacacaagtcctggctaaggagtctgcaagcctgcttctgccctgacacgtggcaggatgagcaatcatgaatctctcggagtctccctccagctcctcatctgtccatgcagcaggccatccctgtatccatggcagggctgcaaacaacatctgaggtcttgagtgcagacaacacctgaggtcttgagccctgtgctacccgggcctgtttctccaacttgagccataggcacctagtcaactccatgctcccactctagggtcccagtccacccaagcaccttctgggtcgctggaagtcaggaggaaacaaggaatgaaattgagtgtgacaggggcaagcagtgggggacataggagaagtcaaggcaataaggacttcactaagaggcccagagaagtcaatagacaatgagaaatgggggttgtggtcttgggtgccagggttggtggggaacatgttgtggcctcaagggtcggcgccctgctgggcacacttacccgtgcactgcacatggagtggctggcctcgtcatcggccaggtaacccgagtggtggcggcacctggccatgtggtcacctggcaggtgaccgggcctgctgcccacctctctcttcagctgcgcattcctctctgcgtggggtggggagacaacctgagggtctccaataggtccacgcatctgtggccctggagtctgcgggtccctcgctccccgcaccccgcctccttcatgcatccagcccttcctctgctccatggcccccatgcgtctgcaggcaggcagtttccagagtcatcggggtggaatcgctgaggacaatcctgtctccgatcatctttggatctgcgtgtgctcgacccgccctcctcccaaaccctgggcaacctggctttcaccccagcccagaatcaacagactcaccagaaacaccgccttgctccgcacaggccagtacagtctgcgccctcactggagcagctgcacagtgcgaggaagtcggctggcggcctccacttgcttatttgcataccacatcctcattggttcttaccgaggagctcgtccacttccctctccgacacaatggttgggggcggggcccacattggccccacctccaattctctgggctctgccctcccacactcgcctgggagccgcaggctgaggatgctggtgcccacgctccccgctgccgggaggaccccccacccaccaccgaagctggggctaggctctttgatctgctcctgccccgaggggagcctaaaagccaaagccacgtcttccaccggtggcacaagcaccttcctcgtgtcctccttggttgctgcgcagccctgggcctcctgctcctgttcgtttccaggggcctctgcccttcccgcggtgtgcacagccccaggttctgccttgagacctctcccctctgcagtggaaagagtgccggctctaagtcacagacctagcttcagttcctggctctgctctttcctgccaatgtgactcaacctctcagcattagtcccacactgtaaatgggcttgagtgttcttccaatatgggagtatgggattcaataaaatctccctacagcacacccagtaacccagtggagccttgtgtattctttaattaattaatttatttatttggagacgggagtctcgctcagtcgcccaggctggagtgcagtggcgcaatctcggctgactgcaagctccgcctcccgtgttcacgccattctcctgcctcagcctcccgagcagctgggattacaggggcccgccaccacgcccggctaatttttttgtagttttagtagagatggggtttcaccgtgttagctaggatggtctcgattccctgatcttgtgatccgcctgccttggcctcccaaagtgctgggattacagacctgagccaccgcgcccagcggagccttgtatattcttacctcctctccctccctccttttcccctttgctcagtaataccccaccatggtgtcacttcttccaaaaaccttttactgtgaattctgccacgccctacgcaattcacagtaaaccccattccagactctaccataccatgttgctacttatttttctatcagatggtgcttctttggggccagaacagaggcaagtcacccttaatctctaatactttcagtgtctggcaccaagtaggtgctcaataaatgtcagtctcctccttcccacctgcagaccctcgggacctctgacctttccaagatcagcttccagtggagaacggtggttggttgaggtctgacaattcaccagtcactataaacacatcagtccttatgccaagagcatggctgaaggactctatgaggctttcaatcctcacatgcctcacgaaatattgttcctctcaagctctgctctgtcctctcagctctggctacccactaggtcagggacagagaggacatagcaggcctgggtgctggccccgaggtgtgaggttcagtcttagctccactactcctggcaggaccacactttcgctctctgaaccccagtttcctcatctgtgaaacaggaatgacattaccaatttcatagcccggacacaaataccacactttccatgggaaaaatcaagactgtcacattgcaatggaaactgtggctgccaaccataatgactatttatacagtcatgggtaaggaaagcttttctggaccaaagagaaaacagtgaagttatgaatgtaaaagctgtagcctggcagagagctcaagatggaaactggagataatgttttctcaaatgaagccttagtgtatatgctttctttcattttcttagtgtctagagctcaagaaaaaaaaaaaatcaacaaatcaagaaaatgcctgctcttagaaaaatctgcaaaagatcaataggcaatttgaaaaagaataaaaatagctaataatatgaaaattttcattcgcactgctaagaaactactagaatgtgataacattgatataatcatctttatgttctcaaaacaacacacaaaaaagttgggttggggagaaagggagttgggtgtgtttatttgcttagagaaaacactggaaggacacaacccagaaagtttacaatggcaatctctgggaagggtaggagattcttttttttttttttttttttttttgagacggagtctcgctctatcgcccaggctagagtgcagtggtgcgatctcggctcaccacaacctccgcctcccgggttcaagccacgctcctgcctcagcctcccgagtagctgggattacaggcgcgtgccaccactcccggctaatttttgtatttttaatagagacggggtttccccatgttggccaggctggccttgaactcctgacctcgtgatccacccgcctcggcctcccaaagtgttgggattacaggcgtgagccactgcgcccggcttccttttgatattttacatattaaatatcacttttgcagtcaaggaaagttccgcattgcaatgaatccatcactggtctggttagcgcgggagcagttgccgggtccttgcaggggcacgccggaccgctaggtggcgagaacaaaggcgaagtgcagccgcacctgggcgtgtgcgtcggggcggggcccgggcagcgtccgggggcggggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggtgaggggagggcctctagcagggcggcgatcggcttggggcgcgcggctccgcggccgctagtgctccagctcgcgctccgccctcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtgcgtggttagtgatcccagtttggagggcgttactcccaggcggggctgggggagtaggggaagttcgatgcccccaggtgaaaggacgtgctcctccctgacccgctccgcccgcaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtgaggctccccgccccgtctcctaccatagctgcctctgtccctccgcactggctgttcacctggctagctgtgtccgtttctcaacccggaagcgagtctggcgtcgaccgctgccgccaccccagttaccccctcccaccccgccgtcccttccctagcctacctagcccttggccatggcccggcctggtcccacctctgatgtcccgccccccacaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaacttgggtggtttatcagctgtgcccaggagaccctcagagaaacaagcacggacaaagagcagctccctcttggctcaaaccactccaggaaatggcccattctccattctggttttgttcatgctgcaattttctttattcctttttagggtgggagtgggagattgtcctcaccaggctgctttggaagaggcataatactataatctcagtattgatttaagaagtcacctgtaggctgagtgtggtggctcacacctgtaatcccagcactttgggaggccgaggcgggcagatcacctgaggtcaggagtgcgagaccagtctgaccaacatggagaaaccccatctctactaaaaatacaaaattagctgggcattggtggtgcatgtctgtaatcccagctactggagaggctgaggcaggagaatcgcttgaacccgggaggcggaggttgtggtgagccgaggtcgcgcccctgcactccagcctgggtaacgagcgaaattccatctcaaaaacaaaagtcatctgtttagatgtaagccattctacgggataggcgtgaggagaccctgcaaccctgtgggaatacatttaaatttttctaggaggagcagtcttcccgggaaatgggataccatggttcctaacttctggcaatgtagggatgccctgtggactggggccgcatgtggcttagctgaaagctcctgaggtgcaggagcagatggggaaggcagtgcgagtcctctagagcacagagtccttctgcaccactccgcaggatggaaaggcagatggaataccatgtggtccttgtctcatttcatgaaatagcatctatgaggcaggcaccgatgtccccattttacaggggtagaggcaggagtggcagagcagggctttgaaactactcattcatttatttaatgtgcactgggccctagcctgggccaaacatggaatcaggggccaagagagctctcatccagcctaggcagcttggagagacgtgtggctttctgaagggtgagtgtgggatgtcgctcctccttcctgcttctacccactcatggccccatccccttgactgtggcttcagtccctttttctggctccacactcgtcttccatcttgaccttcactagacttggactctcccatctgcagcacttttcctgctttcttgcacccatgcttgtgagctggaatcactgtacagttgctcctcctgctgcctagcctccacctcctcgcctcagcctgctgagatctggccacactcctgcaggctgctggctaaggctgggagaggggtggcctgaagttagccggggatacagacgtagctcccttgaggggcttctgttatggaagtgttctgagaggaggaggcagctggttgtgcagctttaggctcaggagaggtgtgggtgggcaggagagacctgggggtctgcacagatgctatatgagtggctactgtcactcagggagggaaggagggatgagcagagtcgacagcagccctggggaccgtgagactttttttttctttttaaagacaggatttcatcctgtcacccaggctggagtacagtggcacaatcacgtctctgcagttctccacctccccaggctcaggtgatcatcccaccatggcctcctgaggagctgggagcacaggcatgcctggttcatttttgtattttttgtagagatggggttttggcatgttgcccatgctggtctcaaactgctgggctcaagagatctggtcaccttggcctttcctaaagtgttggaattaacaggcatcagccacagcagccggctgaccatgagcatttgagtgaagtgaagccaggcacagtggctcacacctatcatcccagcactttgggaggctgaagtgggaggatcacttgagctctggagttccagaccagcctagacaacatactaagaccttatttctgttatttaaaaaagaaaaaataatggctgggcatagtggctcacgcctgtaattccagcactttgggaggctgagtcgggaggaaggcttgaggctagcagattgagaccagactgtgtaacatgccaaaaccctgtctctataaaaaatacaaaaattagccgggtgtagtgacacaagcctgtagttccatctactcaggaggcagagataggaggatcgactcagcctgggaggtagaggctgcagggagcagtgatcatgccactgcactctagcctgggtgacagagtgagcctgactcaaaaaaaaaaaaaaaaaaaaaaactgaagtgagggggcatagactggtaggataatcaggcccacctgattataatgaggcccatctcacgaggaggtgaaagtgataaggacctgttggggtggtgactggtgggccacaggggctgtgggggcagcaacagtgtcttagccaagcggttcactgttatccgcccactcggcattcgtgtctggagggtccactctgtgctaggccagggctggagctgacatggcctggtctgcaaggagctcccagtctggtacatacagggacagtcatccagtgtcatccagtgacacacagaggaagatgtaggagaaacccacggcaacatgtggagccacaggggggtttctgaacctggccagcaccgggtggggaatgctctctggaagtgacttccttcccaaggcctcagttatcgcctctgcacggtggtcctttctactctgatcctctgaggcctccagggttccctaggggccctctatgaacaagaacacgttccaataatctgggaaatggccacttaccaggcatggaccaggctaggcactgcactgcactgggagcaatggtaccctcagctcccctctgttctgggttggtgcccggttcccccatgccatatccaggaagcagagagagaaggaagagccaggcaggacagggtgggaaatgctgagagcagctctggcttctttcagggctgggttagatggcaccaaatgaaaggagaagcagcaaggggcagcaggtgacagaagtcaggctgcagcgggtacaggagtgatgaaatggatgcttatttcatgctgaacaattaatagtgaacaaggccaaaaatggtggctggtggctgtagggaagaggaagttgacagaggggcttaaaggtctctggctctggggagggtggtaactggctgtttctgggctcagagggaccctgtgggaagaaatatgccaaatggtggaatgcaacaggctctgcagtcagaatgtgaacaaaaacaggccaggggtcttggttgtctttaaaagcagggataaggatgccacagggctctcctgagactcagagggtaaagtgctaggtatgttaaaggctagtaaaatgacaccccaagaagtttccttccccaagacctgcagatccagctgaacagtgcaggcctagtctcagctggtgtcaaattccaggcagggaaggcctagccaaaaaagtcctgggtctggctgagcccttgctgagttagcaccactgccgcagcaccctggcagtgggctgtactggggactcagagtgtttctggctggcaccattcatggacatggcccagctccacccacaggcacacccttatcaattctgtgacctcttgggaccgcaggtttgcctcttctaaacatggattgttaacactcccaggaggctccaggatgacccacgcatgtaagtgatgcacccacactttagtccctgtcccctcaacgagacgcccaagagcgccctctgcaggccccgactgtctgaagtctccggctttcttgctgattatacctcatctccttccctctagggaggcaggaacacttctatgtacctcttttggagaggctgggaatggggagagagatcagaagccccaggacctgggccccagccagccctcccatctccaagagcataggcccctggcactgcccgctcccaggaaggaagaaacccacacgactaaccagtgtctgagagcatttttattacgggcagcagaacgggatcgcagcatcttagaaagcctattctctgccgtggtggggagtagggagcagagggaaggacccagcacacttcaagaaaccaggcgggtgtgaattcctgagtgagcttggggcagcagtgggtggctgctccacagctcgcccctcctccagaggacccagctttttggttttggagcagccagggctgttcgccagcttgctcagagcctaccctgaaggcatggctggcaggagcaagccgcccaggcccaaaggagagacacccactggctcgaaagccaagcctctgctgacggggccaaccctggggtgccagtgccagggctgagagtccctgaggggctgccggcacacaggtatcctcccgtgatgagcagagtgcagtgaggggttgacaggcaggcagagctacgttggcagaaatacgaagcaatgggacagtttccaagaatggcaacatttctggatccagagaagcaacaagaacaaatggtggcttgtttggatagctgacagaatttggcattttattacaaactggagtgtgagtgaaataaaatccatcatcacttttctgctaatgaagacagatgtggaaacgccagcccggtgcccttgccatcccgggcacaagggagtctccagaaacctgcccttggcgtacctaggacaaaagaagccgagttcgtgtacacaccgcaggggccatgcgcctgaacaatgttaggctgccgaacctgcccatcactccccacttctgcacagaccagaccaagctgtcttacacgcctgtaggccccggaaagatctcaagttatagaattaaaattaaaacaaaaagcaaagtttaagtcatcttctccacaggatctagtcccccccaagagccaagaagggaagccgccagtggcagaagcggggttggtgacacacggcatttggatcgtcggcttccttggggtgtcagagcgacatggattctctactagtgcggggacaatcccatttgccttgaaaagacattaatattcaaatctttacaagtttatctgacgataaattctaaggtcaatttttatttctacaaaaaaaggcagtcaaaacaatataaaacacattgaaaggatattactgagtgagcttcaagtggagcttgactctgcaaaggctgtgagtccgaagggagaggaagtccgtcttgttcccgggctgggctggctgctctggaggagggggtcagcaggggcccaggcgaccccagactggtgctttaaatagccgagtcctgctaattccaatcctacaaagggtcaaagtgtgccgagggagggctgtggcagggccactgcacggaggaagtggagagcaagctccgtggcacattcggatgaagctcggtgacagatgagctaggagtttcaaacggacattctggctgtagctttgcctgcaaggaccagcagatcttctacaatggctgcagggagaagtgccaacctgggacctcaggagcctttctggcgagattcatcacacacagtgtgcacagcatcctcctgactagcaggccccccatttcggggccaccacagacctgtgattatagggcttctctgtgcaggccaggccagaggtcagttacacacactgacatcagggcttgcccaattaactgatgttactgtggtaacatcagctggagtttcacacaagaactgaggagaaggactggaggaggggtgtggctgtttgtttttaaattttttaaaaggatgttataaactggagtcaggagaatttaaaccaactcccacactgggcaacagtgccacacatgctaagaaaagccaccaggaccgccagggcagtcttttctcctttgtggaggcgagcccggggtctggggaagtaagtaagtgaaaaataaactcggtgccagaaagtgggagtggcaagggtagggaagaaagggaaccacaaccgttttttttccttttttttaaaccttatgggttaaatgtaacttgaagattttggataaaattggacaagaaaagaaacaccattcttttgaagtagattgaagcagtgatttttaaaacaaagagagcagaactagaacatcttaaatttttaatcctttctttacaggttacctagaccacttttgattaagaaaactgtagaaagttagtaactgccacaagcgaacgccaggcggtggcacgtgtcaatttccacagagtcctgctttgcggggtgtctgaatgcactgcacggggtctctgctcacacttgctggaaccaatcgtggcagattttagtccacaggtcgcttttccccatatttctttgtaaactcttcagcattcttacagaattttttacggtccttagagtattcttcagctaggtcagcccgaagcgggtgctcaggctgggggtcattcaccagtgctatgagggactggattactgccaagagaaggacaaggcatggggggttaacacagtctcagaaatggcacaggcaagaggcagctaatccgggaacaaaactctggctttacaactgatttacagctaatgtgcttttaagccaaagctgcctcctatttatccaaaattctgactgccagaaaactcatctttcctctgtgattagaagacactgatggacaacaaatagctaacactacagtggataattgttcacagtgatgtgcttccgcctccaggaagccttcctgacctaacacctggggaggtcttagccctcagtcactcccagcccttttttcttggcggggggttggggaggagggacagggtctcactctgtcacctaggctgcagtgcagtggcaccatcttggctcactgcagcctcaacctcctgggttgacctcaagcaatcctccagcctcagtcccccaagtagccaggactacagtcgtgcaccaccatgcccggctaatccagtcctcttgtgtactctggagataggaggcctagtattgaactgactgctcactctcatgcatgcacacagggtcactttcttcagggcaggaccgggtagaacttccctgcatcagcccagcacccagcaccatgctcggctcagggaagtttcggttaaggtgactgagtgggcactagagagaagggtatgtgatggcgctgcacttgtcaatgcgcaatgacccaactctggaagacccttaggagtttctgaaccctctagaaagggtcactggggccagccaatgggaagctgacaaccgccatcgcatcacattgtcaagaccacaggcagatgtcacgctgatggctctgatgggtgccacagtactccccctaggtgccgtagcccagacgtgccccagggtggaaggatagtggggaatcagaagcagctgctacccacacctcctcacatactttgccacagttgccccctgaccctgtcaggaccagcaccctcagaatgttccttcccactgtaaaacagtgcccctcttctccgaactgctgatgccacaaattccttcttattttttttagacagtcttgctgtcactcagactggagtgcagtggctcaatcatactttactgcacggtaccctcaaactcctgggtgtaaatgatcctcctgcctcagcttcctgagtagctgagactacaagcacatgccatcacgtccagctaatttttttttttaacctaggctagagtacagtggtgcaatcacagctcactgcagtcttatctcctgggctcaaacaatcctcccaccttggccttgagagtagttgggattacgggtgttagccactgctcctggcctagttttttgtagagatggggtctcactatgttgcccaggctggtctcaaactcctgggcttgagtgatcctaccgcctcatcctcccaaaagtgctaggatgacaggcatgaagccactgcacctggtcaattcctttattaagggctcatattgttcattcagcattacaagaaatggattaaaatgcaaatgctagccaggcagatcacctgaggtcaggagctcaagaccagcctgggcaacatggtgaaaccccgtctctactaaaaatacaaaaattagccaggcatggtggcccatgcctagagtcccagctactcaggaggctgaggcaggagaatcgcttgaacccgggagacggcagttgcagtgagccgagatcgtgccactgcactctagcttgggcaacagagcgagactctgtctcaaaagtaaataaataaaacaaaatgctgatgctggctgagtcatatgcaaaggcataatcattcaacagcacacattaagtgagggccacagcacaaagtactcctggcctggtgtccaaaacccacctgcctaacctctgctttttactgtgcctggtgagaatgggaaagagagggctcctgtgaccacagtgggtagaggtgaagcagtggggcagaggcgaggagggcattgcgcatgcaatgctgacaggttccacgtttgttgggggtggatgggcaaggagggtggactgtgaacagcaagcaggggcaaggggcctggaaagctctctgcaggccagggtggcctctaattcagtctctaagcctcttcaggggtaggtggtatcacctccctgtacaagccacctgtacctctagaggcagcaggccctggaggtatatttttatttaataaacatttatttatttatttaataaacgaagcccacccttggctgactggccacagtgtatttcagtgcacaccaccctcggtgtgagactgctcccttttcctggctgttcttgacttcagggctggaaattgagccacagtcgcctaagagcacaaataggtggctccccttcctttcccatgattagaaatggccctgtaacaggagaattactaccgcattagcattttagaaacctcactgggctaaggacaggctgagtacttcgttaggggcacgctcaggagttttcacctcactctctgatatgaatacttaggctctctacttctcactatcatcaccttggtaactaatgcagaggttggtggctcacacctgtattcccagcactttgggaggccaaggaggaaggatcacttgaggccaggagtctgagactggcctgggcaacatagcaagacctggcctctacaaaaaataaaaaataaaattagccggttgtggtggcacatgcctgtagtcccagctccttgggaggctgaggtgggatgattgcttgagcccacaatattgaggctgtagtgagctgtgattgtgccactatactcagcctgagtgacacagcaagaccctatcgcaaaaaaaaaataatatatatatatattttttgagatggagtctcgctctgtcgcccaggctgagttagtggcacaatcacagctcacaatctcggctcactgcaagctccgcctcccaggctcatgccattctcctgcctcagcctcccgggtagtgggattacaggcacctgccaccatgcccggctaattttctgtaattttttagtagagacggggtttcaccgtgttagccaggatggtctcgatctcctgacctcgtgatccacctgcctccgcctcccaaagtgctggattacaggcgtgagccactgcacctggcaaaataaaaatttaaagacctatttctcaaaagatgccatttgtctatttcgttattttttatagtttcactaatttgatcaagtctgaattttttttttaattgagatggcgtctcactctgtcgcccaggctggagtgcagtggcacaatctcagctcactgaaacctccacctcctgggttcaagggattctcctgcctcaacttccccagtagctgggactacaggcatccgccaccacgccttgctaattctttgtaattttagtaaagatggggtttcaccatgttacccaggatggtcttgatctcctgacctcatgatccacccatctcatcctcccaaagtgctgggattacaggcatgagccaccatgcccggcctcaagtctgagtatttttaaatttacttagtagttctgataagtatttcattctttcgctgttcccctgggtgcatttctggctccttagctaaactataataaacttcagctgagctgaacttattttgctagtaagaacacctgacagattgtctgctttacaaattacaactgtggccctctatcaacatttttcatatataggacagcatattaaaattatattttataaaacatccagccctgggttcttggtctcttccatgacccaaatgctcctcagaagtactttttttttctgcaaaatgtaggggcttaaaaacatacaacaggccgggcgcagcagctcacacttgtaaccctagcactttgggaagccgaagtgggcagactgtctgagctcaggagttcaagaccagcctgggcaatatggtgaaaccttgtctctactaaaatacaaaaaactagccaggtgtggtggcatgcgcctgtagtcccagctactcgggaggctgagggaggagaaatgcttgaatccaggaggcggaggttgcaatgagccaagattatgccactgcactccagcctgggtgacaaagtgagactctgtccccccaacaaaaaacaaaaaacaaaaaacccacacaacaaattagccaattttaccttttactctcactatattctcatcagagaataaagcctataatatttccttccttttgttccttttctttttttttttttttttttaagacagagtttcgctctgttgcccaggctggagtgcagtggcagcagctgggactacaggtgcccgcaaccacgcccggctaatttttggtgtttttagtagagacggggtttcaccgtgttagccaggatggtctcgatctcctgacctcgtgatctgcccgcctcggcctcccaaagtgctgggattacagacatgagccaccgtgcctggcccttttgttcttaatgacagtttctctgcaatagcggatgtaaacaatatttgtgatttcccctccttttcataaaaatccagggagcttcattgtcaaagaataaaatgtcaatgtaccttcaacccaaaaagatatgcaatgttgtagccttccatggaatgtgctttaaaaaaagggggggggtgttttgttttgtttttttgccccccaagtagctgggattacaggtgcctgtcaccacgcctggctaatttttttttttttttttggagatggagtctcgctctcactctgtcacccaggctggagtgcagtagcgtgatctcagctcactgcaacctccgcctctcgggttcaagtgattctcctgcctcagcttcctgagtagctgggactacaggtgcacgccaccgtgcccagctaattttttttgtatttttagtagggacggggtttcaccacgttggccaggatggtctggatctcttgaccttgtgatccgcccacctcggcctcccaaagtgctgggattacaggcgtgacccaccacgcccagcctggaacattttcatcccccaaaaagaaaacccactctcagtagtcacttcctattctcctcctcctagaccctgacaatcactaatctactttgtctcaatggatccaccctagtctgagcatcccatatacagctgaattttatctgtagtgcttatgttctataaacttgccatgaacattgaattaatgatactgaatcattgctcctaagggaaacagaggtttaggttcaaacaagcctctgctcacatttttgccagctgattaatatataactttgttttatgtgtgtttaaagacaccttatttaataggtaatattgactcagcagcactataactcatgcccaaataaagcttatctcacacatgtattttctccaaaaggcatatcatgaccttctgtgctcaggaatactagacagcacttcagcaccacgtttggggccaaagcaaaatcaccaacaaaaagcacaaaatccaagaagtttggcattagacagcccacttgcttcagttgagagctgaaacaagaaggcagggcatcgcactgttcaaccacacaacctcagctggaacacgtgcatggggtacttcaaattttttgctgctctgcacacgcacacatctgtgatagacgagtgccgagagtattgattttggggctacaaaaaactttagtgagtaggcaaattcgcaaacgcagactctatgaacaatgaggctcaactacaaatggaatcatacaatatgtggccttccatggatggttctttcatttagcatattttctttctttttttttttttttgagacggagtcttgctctgtcgcccaggctggagtgcagtggcgtgatctcggctcactgcaatctccgcctcccaggttcacgccattctcctgcctcagcctcccgagtagctgggactacaggcgcctgccaccaagctcggctaattttttttatttttagtaaagacagggtttcaccatgttagccaggatggtctcaatctcctgaccttgtgatctgcccgccttggcctcccaaagtgctgggactacaggcgtgagccaccgcgcccggcccatttagcatattttcaaggtttatgtaccataagacagtacttcattgctttttatggctaaataatatttcattgtagagatacaccattttttgttgtttgttttgttttgttttgagacggagtttggctcttgttgcccaggctggagtgcaatggcacaatcttggctcactgcaacctctgcctcccaggttcaagtgattctccagcttcagcctcccatgtagctgggattacaggcgcccgccaccacacccagctaattttttgtatttttagtagagacagggtttcaccatgttggccaggctggtcttgaactccggacctcaggtgatccacccgcctcagcctcccaaagtgctgggattacaggcgtgagccaccacgcctggctcacattttgtttattcactcaccaattgatggacatttgggctcttttcacttcttatccattgtgaataatggtgctatgaacatctgtgtacaagtttttattgggcatatgttttcatttctcttgggtagatatagctaagagtggaattgctgggtcatatgagcatcttttcatattactatttcttccattatgcttacttttctgtacttgtgggtggctaaagtcagctacaggttgtgaattgaggaggtcaaagaacttcaaggctggatctgagagaagccataattgggaacgctgaagtttctaaggacaagggcaggagacaaaaatcatgagcaggtgctctggagacaaaggaagagcgctggaagattacagcaggagggtggcacaagtggctttttccctttctttctttctttttttttttttggtacagacggggtttcaccatgttcctcaggctggtctcaaactccttggctcaagcaatctgcctgccccagcctcccaaaatgctgggattacaggcgtgagccactgtgcccggcctcaggtggcactttcacttcccatatttaagaaacaaatgaaggaatggtgaggcatttaaaaaggcaggctttgcaggacagtggcagctgaacagcagtcaggaaatagcaccagaaaaacagggacacccaacatatgaagaatcaggcaggtgggagaaggaatggcatgtccagaggagctgccatttgggaaaagcaggcccaagtgggcctgaggaggcagcaaggggactcagcaaccttgcctgcctgtcccacctctgccatcatgtctcccatcctgcatactcctcccatcaagagctgaagtctattttccctctcattaaatctggacttgcctgaccaaaagaatccacagaagtgacaccgtaccagttctatgccttcaccctggaaccctgagaccaccatgctatgaaggggtccaatgtagccttgtggaaaataagagaacacaaagagaaccgaagtgccttagctaataccatttccgcacatgtgcactatgcctaccagctcttcccagccaagttgagttcccacctcaatacagctgcatgagtgaccccaggaatgaacagtcagctgtagaaccatgtagctaagcccagccaacctccagagtaaaaactaataaactggtattactttaagccacaaagttttgataggggttataatgcagtaatagataacaaacatgggaatgtggccgtcaagtgcaaggaacaacattcttgatgtatgtgaggatggggatcaaggccatgccacaaacaatctacataataatgttctaggaaggaatcctcaactgtcccaaatcacaaaatagcaattccagttctgtccatcatggcacacagaatagctcctgtaccaaaatttttaccttaaaaatcccaagtcaacagtactttttacaaaaaaaaattaaaagctgcccctaagttatttggctcttgggggtgggggagaagcagccacagtctgaaaaagcagagcattttggcagtgcacctggataggaaggtaaaaagtgaataaccctgccacggccttctatgcagcagccccatgagaggtggcaaagcacgtgcatccatctcctgagagcctccctggccctagccccaccctctcagtctacaggtaagggaggagcctcagaactctttgtggccagaacctgaggtgcagggctttcctgggcaacctggcctggaaggactgccactccccaggcacgatgggttaacagacatgactcggcaaggactccaggaattactgaacactcttgatcaaatgcagctataggttttcgacagtgctaggaatctgtacagaaaaaaaccaggctcgccgggcatgatggctcatgcctgtaatcccagcactttgggaggctgaggcaggtggatcacctaatgtcaggagttcgagaccagcctggtcaacgtggtgaaaccccgtctctactacaaatacaaaaattagccgagcgtggtggctgtaatcccagctactcaggaggctgaggcaggagaattgcttgaacccgggaggcggaggttacagtgatctgggatggcatcactgcactccagcctgggtgactccgtctcaaaaaaaaaaaaaaaaaaaaaaaaaaaagaaaagaaaagaaaaaatcggctgggtgcggtggcttacgcctgtaatcccagcactttgggaggccgaggcgggcggatcacgaggtcaggagatcgagaccatcctggctaacatggtgaaaccccgtctctactaaaaatacaaaaaattagccgggcgtggtggcgggtgcctgtagtcccagctactcggaaggctgaggcaggagaatggcgcgaactcgggaggcggaggttgcagtgagcagagatcgcgccactgcactccagcctggtgacagagcgagactccgtttccaaaaaagaaaagaaaagaaaagaaaaaaccaggcactgagaagaactgtgtcaagcttttataaacatcagcttgtacacaaacaaggaccaagcccactagagactgttctgccctgactgaatgtttagcacccactcctttcttctactcagtgtgggagtctaatgggcacctttcatggtgattacttccaacaagtgaggcttgatttttcttgcgcaaggctttgaactccaccttccaaggcttttttcaatcactaaaacaagggacctcctcaatccctgtgcaggtcaaaagttcagctgagttattcccacagggactggtggcacctcagccatactttgcgtgcacctggtaaggtaggagttctctggactccgtctgatctggcatcaggaaggacccatgagcccctaccctagagcagcacccctaaaagaaaccctccacttgcagcctctcaagtgccagcttcatccactctaatctaaacagactttatactggtttaggtacttaaaaggaagccatcaaaatatgagattaggacttcaaaagaaagtctagaattaaatgaaaaccagacacagtccataacaaactagtcacttctaggggacaaaagggaggacaaccacaatactgactcaaatattcttcccagaagaatgagcatgtttatgttcacacagccacacacagacatgtgcaccacgcacagccacatccaactccagggaatcccaggcccactaaagccaactacgtgccttcatctgggaatactgcccttacatctgcctctgtccctcccctcacatcacccgagcaactaggctctagcccatgcccttcctatagcctggaaggccctctccaacctcctttcctccttcaagtctgagttcaggcactaactactgcatgaggccaccttaaatcccactctcccttccccttgtaggcagccccacagtccttcatcccttccagggaccagtgcctgcacctctctgcaccagcagcaagccactgggcttgtctgtccatgtgtgttcccactgtggatggcagcccagggctgagcactggaaaggcctcctcaaaccctatacaggtcaaaagttcagctgagatgagccattcccacaaggtctgacaggacctcagctacatttttcgtgtacctgaaagattctctggattctgtctgatctggtaccagaagcccccaccccagagcagcacccccaaagaccccctccgaggaagacacaggcacatgtcttaccttggtcggttttggttgctggcttccagttttcggcactaattactggcagacagacctgccccttttcgtcgatgtttgggtgatagatctttgttttaaatgtgatcttcggtggtttgaatgggtactctgctggaaagttgatttcgattctgaaggctcccttatcatatggagggttgtcctggaaggaaagagagatcaaaatgaacacaccatggttcataaacctatggccaagacaggaatgttttaattgtttatctgaaaaatcaatttatttcaagggattcaagtatcaactgaagccctgccaccttcaggacaacccagccacccaaaagtatttctagagcaagctatctgctaaactgagaaggggcttgagattgatgtcctggtctcttcatacttttttaaaaaatagactttactttttagaacacctttaggtatacagcaaaactgagaggaaaggacagagaattcctaaataccccctgcccctgaacacacacagcttttcccactatcagcatccctcaccagaggggcaaatttgttaccaccaatgaaccttttaccttaacacatcattaccactcagcttccctagtttatgttagggctcatacttggtgttgcacattctataggttttgtgtggttatcagacatgatagctggaatcatgcaatatgtagctgctatgtctgaatgtatctccccaaaaatcttatgttgaaacctaatcaccaatgtgatggtattaggagttgggaccattgggaagtgattaggtcatgatgggattggtgtccttatcaaagaggcccctgagaactgccttgccctttccatcatataaagacacagtgaaaaggcaccatctataaaccatgaagccggccctcagttgccactgaatctgttggcaccttgatcttcagacttcccagcctcaataagtgagaaataaatttgtcgttagaagctatttgttctttttattattattattttttcagagtctgttgcccaggctagaatgcaatggcacgatcttggctcaccgcaacctccgcctcctgggttcaagcaattctcctgcttcagcctcccaagtagctgggattacaggcacccgcctcaatgcccagctaatttttgtatctttagtagacatgcggtttcaccatgttggccaggctggtcttgaactcctgacctcaagtgatctgcctgcctcggcctcccaaaatgcagggtttataagcgtgagccactgtgcccagccgttacttgtttttcccccacttcatacttacttatttatttttgacagggtcttgctctgttgcccactggatggtggcgtgatcttggctcattgcaaccttgacttcacaggctcaagcaatcctcccacctcagcctcccaagtagctgagactacagataggcaccaccacccccagctaatttttttgtatttttatagagactgggttttgctatgttgtccaggttggtctcaaactcctgggctcaagagatctgcctgtctcggcctcccaaagtactaggattacaggtgtgagccactgcacccagactcatttcttcttagtgttgaatgtcatttgtctagatataccacaatttatttatccattaacccactgaaggacatcttggttgctttcaaaccttagcaattaatgaataaagctgttataagcatctgtgtggatacaagttttcaattcatttggctaaataccaaggaatgtaattgctggatccaatggtaagacatatgtttagttttgtaagaaactgccggccgggcgcggtggctcacgcctgtaatcccagcactttgggaggccaaggcaggtggatcacgaggtcaggagatcgagaccatcctggctaacacagtgaaaccccgtctctactaaaaatacaaaaaaaaattagctggacgtggtggtgggcgcctgtagtcccagctactcaggaggctgaggcaggagaatggtgtgaacctgggaagcggagcttgcagtgagtggagattgcgccactgcagtctggcctggacgaaagagcgagactgagtctcaaaaaaaaaacaaaacaaaactgccaaactgggccaggagcagtgactcatgtctgtaatctgagcactgtgggaggccagggagggaggatcacttgaggccgggagttcaagaccagtttgtgaaacataacaagaccccatctctacaaaaaaaaaaaaaaaaaaaaattaaatatattagcctgggccaggctcagtggctcacacctgtaatcccagcactttgggaggctaagctgggtagatcacttgaggtcaggagttcaagaccagcctggccaacgtggtaaaaccctgtctctactaaaaatacaaaaaaattagcagagcgtagtggtgcacgcctgtagtccagctacttgggaggctgaggtaggagaattgcttaaacccgggaggcagagattgcagtgaactgaggttgcgccactacactccagcctgggtgacagagcaagattccatctcaaaaaataataacaaaataaatatattggcctggcatggtggcatgtgcctgtagtctcagctacttcagaggctaagaagggtggacttcttaggcccaggagtttgagaatgcaatgagctgtgatcacgcttctgcactccattttgggcaagagagagactcaatttctttgttaaaaagattttatgaataaataaatgaaagaaaccgcctaacttgtcttccaaggtggctgcaccattttgcattcccaccaggaaagagcgagagttcctgttgctctacgtcctcagcagcatttggcagtgttctggattttggtcattctaagagatgcacggtgttatttattgttgttttcttattatagagttttaagtgttctttgtcctttagacagtcctttatcatattatgtttttgcaaatatctcttgatcttttctgaagatacaagtagagttgtaccagaggtaagttacaacccaaccagaatacactgtgagtactagaagtccaaataactgccttgatgccaagtcctggccagctcaatcttcccagggtagaaacagtagtcagctcaatggctggaccctggggacctgagctggtcactcaacaggtgatcaccaggcagggccagcaccatgccctagccccttgcccctagaaccacccgaaaaccacctttggggcctggacactctgatggccccaggagcctgagagatgactcagcaaagagtcttttggcctctccccaaccctacctatctccagagctggggaagcccttcccattgtactcccttttccctcacccaggtctgccatggcacttgccatggcacacccaacccaaagaaatccaagcttcacagagagcccaagaacaatctttttttttttttttttttttttaagacggagtctcgctctgtcgcccaggctggagtgcagtggcgcgatctcagctcactgcaacctctgcctccctggttcatgcaattctcccacctcagcctcctaagtagctgggattacaggtacccgctaccctgcccgactaatttttttttttttgtatttttagtagagatggggtttcaccatgttggccagcctggtcttgaactcctgacctcaggtgaactgccggcctcggcctcccaaagtgttgggattacaggagtgaactactgcacctggccccaggaacaatcttgacagccctacaccccagccccatatcttcaagccgtggcctaagtacgcactccagtaaacagagctcctctgctggggagcaaggctggcgtgcgccagttctccacattctcctacatccaagccctgccctgggaggggaggcatggagcaagggccttaaaggatggataagatgacataaggctgaggagtggaagaggcctcccaggcagagaggactaaagactagatggcagggacttggaaggaatagcatagagcaagacaggaggctgcgggcaggcagtgtggccccagggctactgaagccacgcgtccaggtctgaatcaccaccgagcagctgaaaccactgtcagcatattcatctgtggggagtcacccaggctggagtgcagaggtgcaatcacggttcactgcagccttgacttcccgggctctagcaatcctcccacctcagcctcccaagtagctgggactacaggcatatgccaccacactcagctatttttttatttcttatagtgatggcgtctcactatgttgtccaggctggcctcaaactcctgagttcaagtgatcctcccaaagtgctggagtgctgggattataggagtgatgcaccatacccagccagcttttagttttcaagaggagaattaaatggtggtggtggtggggggaagtaagtaaacatcattgtcatttacactgcttgagccatgtaaaaatagctttccctcactgggtgtggtggcacactgggaggctgagccaggagaatcacttgaacctgggaggcagaggttgcagtgagccaagattgtgccactgcactccagcctgggcaacagagtaagacacacacacacacaccacacacacacacacataccacacacacgcgcgcgcgcacactttcctgcatgacttttggttggtgaaatctgctaaaggtcttcactgattgtccaggactgaccaacctcccctgttccccactgtgggccaggtcctgtccgaggagctggggtgaagcatgaatgaggccatctggccccaagttagcaggtctagcctcagactttgcctcttcctagcttaaagagtctgagaatgttcctgtacatctgtaaaatgggagtagcaacagcctgtacccagagtttatgatgagagataaggactataaagtcctacatgcctgacacatgggcaaagctcaagagaagcagatttggctgggtgcagtggctcatgcccgtaatcccaacactttgggaggctaaggcaggaggatcacaagagcccaggaggctgaggctgcagtgagccatgatcacacctctacactctagcctgggtgacagaatgagaacctgtctcaaaaaagccaaaaacagactgggcgcagtggctcatgcctgtaatcccaacactttgggaggctgaaatgtgcagatcacttgaggccaggagtttgagacaagcctggccaacatggtgaaaccccgtttctactaaaaatacaaaaattagccaggcgtggtggcacatgcctgtaatcccagctacttgggaggctgaggcaggagaatcacttgaacctgggagacagaggttgtggtgagctgagattgtgccattgcactccagcctgggcaacaaaagtgaaaatccatctcaaaaagaaaaagaaaaagaaaaaaaagaaaccctatctatactaaaaaaaggccgaggcaggtggatcacgagatcaggagatcgagaccatcctggctaacacggtgaaactctgtctctactaaaaatacaaaaaattagctgggcgtggtggcacgcacctgtaatcacatctactcaggaggctgaggcatgagaactggttgaacccaggaggcaccggctgcagtgagccaagatcacaccgctgcagtgagccaagactgcaccactgcactcctgcctaggcgatagagcaaggtgttctctcaaaaaaacaaaacaaaacaaaaacaagtccttttgtaaagacaggatctcactttgttgctaacaatttttttaaattagctgtgcgtgctgctggtgcacacctgtagtcccagccactcaggaggctgaggtaggaggactgcttgaggctatagttttaagttgttagttgttaaggctgtagtgagccatgatcacgccactgccttccagcctggacaagacagtgagatcctgcctcttttttcttccaaaaagaggaaggaaaaaaaagaagcagttctgttactacatgaggcaggccaggcctctcaccacccagggaacttggccaaactcatctgaacttctctgggcctctttcctagtctggggatctgtggatggtcaaaggagtggctcaggtgtgcataagtcacacaaactatgtgcctgtcccagagatttttggtgaaagaggcatgcaaaaattaaaacataagatataccttccgggtaaaggcctacagctctacaagtgaatttcaacattagagctaaacttgccctttgggaaggccactcagaaataacaagggatgttaatgaaaaaacatggttttgttgtaaaaaatatatatattataaaacattgcagaaaatttgcctccaacttaagctgcaacatttcaatgtcaaataaaccaaagattttagcattatctatttatttagagatagagtctcacgcttgcccaggctggagtgtaatggtgggatctcagcactgcaacctccgcctcccgggttcaaacgattgtcctgtctctcagcctcccaagtagctgggattacaggcgcaggctgccacgtccggctaattttttgtattttagtagagacggggtttcaccgtgttgcccaggatggtcttgaactcctgagctcaaaaatccacccaagtcagcctcccaaagtgctaggattacaggcgtgagccactacgcccagctgatttcagcattatcttcacatgaacacgactagtgtttttctgttatgcctgcctttgactgtcttgtgctccctaagctcatactgctgtattgaggaagtcatttgagatgtaaattaattccttatgataattttacacactctaaactagttcaaaaacttaaactccagcactttggaaggccgaggtgggaggattgcttaagcccaggagtttgaggctgcagtgagctatgattacaccactgcattccagcctcggcaagagtgagaccctgtctcagaaaaaaaaaaaaaaaaaaaaaatcaaaaaacaccttttcaatccatgtctaaattctaggacagactttttatccacttgtctttttttttttgagacagagtctggctctgtcgcccaggctggagtgcagtggcgcaatctcggctcactgcaagctctgcctctcatatcattctcctgcctcagcctcccgagtagctaggactacaggcacccaccaccacacccggctaattttttgtgtttttagtagagacggggtttcaccgtgttaaccaggatggtttcgatctcctgacctcatgatccgcccgcctcagcctcccaaagtgctgggattacaggcgtgagccacggcgaccagcccacttgtcttttttttttttttttttttttttaagacagagtctcgctctgtcacccaggcaggagtgcaatggcacgatctcggttcactgcagcctccacctcctgagttcaagcgattctcctgcctcaccctcccaagtagctgggactacaggcatgcaccacaactctcagctaatttttttgtatttttactagagacaaggtttcaccatgttggccaggctggtctcgaactcctgacctcaggtgatccgcctgcctcggccttccaaagtgctgggattacaggtgtgagccaccgcacccggcccacttgctatttataaagaaagaaagataccggttttaaagtggattttcttttatatatagtatggctaacattttcctgtatttgcttctagtcattataatgcatgcatgtaaataagagttgatcatttcaacctgggaaagccaatttaaaaaaatttgaccaaagtttctcaagtacttagatgccaggtgcttttccgtgccatctccagcccatattccgcccctcctggtcccctaacaccaaccctgggaagccagtgctgccatcacttgcatttggaaatggagcaagtgaagtacgattgagtgactggcctgagacctcccctaaactcagccttcctgtcccggaacacaaccccccacatctgcaggtatccatctgggcccatcctcatcacctttgtgggatgcggggacgaggggaactggcccttttctcgagtcttccaccaacatccaataaattggcaggacaccttttcaggctgcaagtagggtaaaaatctcagatccttcacagctcttgatatcaacctcccatggcacaaagccattttgtggcagctaagactaagaggaagctctttgccatatggcaccgaactatctggggtctttcacccacttgtcctagctctaaccctgtggtcaaatctaatcttcctttcccatggcaacctttcaagaatcctaaaaccccattccacttcatgttttcccttcccaagtaaagacccagagtccttcatcccacagaagtcaccgtttcatgtcactgctgtgaagcagggaagaccaccatacagctctctggcagccacagaggaagtcaaggtgtcttctggttgtctgacttggactgctgctacatggcacgtccttgtggtgtgttcctagctggctgtaggacaccacagacaggactcatggctgacctgaagagctggatcctagtttggatctaactagcatgctgctccttcttcatgccaggcttcagatggactgaagggtcctgtgcactgttgtcacttctgcctagcttggtggcgactccacagcagcatcctttccctgtggctaacctttttcacccagtgaactaacaaagctgaagctttccctgccacagggatgtctactgagaccagccctgtgggctgcctatccctacacagtccagtcccctgttaagagagaacaaggggacgcggcttgccctgctcggagtgccccaggctggtttgtcttttttttttttttttttgagatggagtctctgtcgctgaggctggagttcagtggcgcaatctcggctcactgcaagctccgcctcccgggttcacgccattctcctgcctcaacctccagagtagctgggactacaggcgcccaccaccacgcccggctaatttttttgtatttttagtagagacagggtttcaccgtgttagccaggatggtctcgatctcctgacctcgtgacccgcctgcctcagcctcccaaagtgctgggattacaggcgtgagtgagccaccgtgcctggccctgccccaggctggtttctatgctctcaagccttcgtgatccactctggaaccttgtcaagagctgagttaggccaggcacagtggctcatacctataatcccagcactttgggatgctgaggtgagtggatcacttgaagtcaggagttcaagaccagcctgaccaacatggtgaaatcccatctctactaaaaatacaaaaaaattagccaggcgtagtggtacacgcctgtaatcccagctacttaggaggctgaggcaggagaatcacttgaacccatgaaacagaggttgcagtgagctgagatcacaccactgcactccagcctgggggacgagagagactctgtctcaaaaacaaaaaaacaaaaaaacccaaaagagttaagtttaggaggttaagttcttgtgacttctgaacatggaatatgtccttactccatgttcgaaagtcacaagaacttaactttgtaaattgcctttaagtatgattgattgattgattgatttttctttgaaagagtctcgctctgtcaccgaggctggagtgcaatgacgcgatctcagctcactgcaacctccacctcctgggttcaagcaattctcctgcctctgcctcccaagtagctgggactacaggcacctgccgccacacccagctaattttttgtatttttagtagagatagggtttcatcatgttggccaggctggtcgcaaaatcctggcctcaggtgatccaccctcctcagccccacaaagtgctgggattacaggtgtcagccaccacgtccctccttgcctttaagtatttattgtctcttctgaaaacaggctttttggttatttgaatcaaaaaatctgccacatgagattcatcttgttctaatattggtttctgaagatgacttctttgtactgttttcaacaacttggttttggggatttttcataatacagttctttggcaacaaatatttccttttttttgagatggagtctcactctgtcgcccaggctggagtgcagtggcgcgatcttggctcactgcggcctccgcctcctgggttcaagtaattctcctgcctcagcctctctagtatctgagattacagatgcctgccaccacgcccggctaatttttatatttttagtagagatggggttttgccatgttggccaggctggtcttgaactcccgacctcaagtgatccgcctcccctggcctcccaaagtgctgggattacaggcatgagccactgcacccggccggcaacaaatacttcaacactaaagagttcaatcgtattccctttggaagtaaatagtaggaataagtttttttgtttgttttgttttgttttgtttttttagatggagttttgctcttgttgcccaggctggaacacaatggcacgatctcagctcaccgcaacctccacctccccggttcaagcgattctcctggctgagcctcccaaattgctgggattacaggcgcccaccaccaggcccggctaattttttgtatttttagtagagacggggttttgccacattggacaggctggtctcaaactcctgacctcaggtgatccacttgcctcggcctcccaaagtgctgggattactggcatgagccaccgcgcccggccaggaataagtattttagaactggttttccaatctttcatttcataatgttcataaactaccttctgaattgtatctacaattaaaatcacaatctccattaaccgaatttgacaaagaccattccttccttttgggctcaaatagccatgagtacttctcatacataattcacttttctcccaagaatggaaaaaatacagcactcacaccaaaaatagaagtgaaaaaaacaaaacaaacaaaaaatcccaccagacaccccattccccaggatgccgtcaggcctctgctgcacagcccaagaacgttctctgtgcatacatggtgctctcaaaggccttaatttctgtacatctatgcaaactacacatatgtcctcacactgcctatattttttcatagtttctgctcacactgccttccactatgcagtccagatattgtcaccctcccacccaccgctgccctgcttctgtttggtcttaagtgccttgcaggtggagccacactcagtgcttaagagaccatggattccaggagggtggcttctctgtggcctctgtccatagaaccttgtgtctggctgtgataggagctcaacagccccatcaatgtagggggatactctttctccccaaaacaactccagtgtgccctcagaaaacagggctgccctcattggtctcaaccattacagctacaggagacggaagtaggggagagagaaggcagagtggcacaattagcaggaagcagaaaagaactgacaattacaggcaagtgctgagcccagggaggcaggatgcagctcccatcaaaggccagaggggcaatgcagaaaggaggaatgaggcatccggagggcgtggattttaggagcaactgctgtgcaaataagcttgcagaaagaaggtgagaggtctaactacaaatgtaactgcaaaaaggtgaaagaggccaggagttcaagaccagcctggccaacatggcgaaaccctgtgtctactaaaaatacaaaagaattagccgagcgtggtggtgtatgcctgtagccccagctgccagggaggctgaggcaaaagattgcttgaacccaggaggtagaggctgtagtgagctgagatcacaccactgcactccagcctgggagacagagtgactctgtctcaaaaaaaaaagaaatggaactaggcgggtgggggcatggtggctcatgcttgtaattccagcactttgggaggctgaggcaggaggatcgcttgagcccaggagtttgagaccagcctgggcaacacagggagaacccatttattattattattattttaataaaatagagacggggtcctgctatattgcccaagctggttttgaactcctaggctcaatcgatccttccaccccagcctcccaacatgctgggaatataggtgtgagccactgcacccagcccccatctctatttatttaaaaaaaaaaaaaaaaaaggaaagggaaagggagaaggaaagggaactagaaatcaataacagaactagaaaactcacaattatggggaaattaaacgtactctctaacaagcaatgggtcaaagaagaaatcacaagggaaattagaaaatatcctcagaaaaaaaaatgacataccaaaacttaagttatgcagcaaaagtagtgctcaaagggaatctacagctttaaatacctacattgaaaaagcaagtctgaaatcaataatctaactggatattttaaggaacaaagaaagtaataacacaagaaagaagtaaatagtaagcacagaggagataaatgaaaaacacacacacacacattaatgaaaccttccttgaagagatcaacaaaattgaaaaaactttagctagactgataaaaggaaaaagagaaaagactcatattattaaaataagaaatgaggcagggcatagtggtgtaatcccagcactttgggaggctaaggcaggcggatcacttgagtctaggagttcaagaccagcctgtgcaatatggcaaaaccccatctctacaaaaaaaaaaaaaaaaatacaaaaattagctgggcgtggtggctcatgccttcagtaccagctactctggaggctgaggtgggaggatcgcttgagcctgggaggttgaggctgtggtgagccatgatcatgccactgtactccagcctgggcaacagaacgagagcctgtctcaaaaaaaaaaaaaaaaaaaaaaaaaaaaaaaatctacatataaatggatcaaagatccaaatttaagagctaaaactataaaactcttagaagaaaactcaggaaaatttgcatgaccttggatttggcaacagtgtcttaaaaatcaaaccaaagtataggcaacaaaattaaaaatagataaattggacttctttattaaaaatttaaggccaggtgtgatggctcacatctgtaaatcccagagctttcagaggctaagccaggaggaccacttgagcctgggagttcaagactagcctgggcaacacagcaagactccatctctacagaaaaaataattaaaattagctgggggttgcagcatgtgcctatagtgccagctacttgggaagactgcttgagcccaggagtctggggctgcagagagccattattgagccactgcactccagcctggatgacagagcaagaccccttctctaaaaataaaaattaaattaaaaaatttaaaactttagtgcatcaggccaggcacggtggctcaagcctgtaatcccagcactttggtaggctgaggcggacagatcacttgaggtcaggagttcgagaccagcctggccaacatggtaaaaccctgtctctaccaaaaaatacaaaaattagccaggtgtggtggtgcacgcctatagtcccagctactcgggaggctgaggtgggagaatcacttgaacccgggaggcagaggttgcagtgagacgagactgtgcttctgcattctggcctgggcaacagagtgagaccctgtctcaaaaagaaacaaaaaaacaaaaaacacaccatgcaaaaacatgttctacatccttagtatgaagaaaacagaaatcaaaaccacaatgagacagcactacataccaactagaatggctgtaacgtaaaaacaaaaaaaaagtaaaataacaaatgttagcaaggatgtggatgaactggaacctttgtagtggaaatttaagacgttacaggatgggcgcaatggcttatgcctataatcccagcactttgagaggctgagatgggtggatcacctgaggtcgggagttcgagaccagcctgaccaacatggagaaacccagtctctactaaaagtacaaaaattagccaaaattgcttgaacccgggagatggaggttgcagagagccgagatcgcataactgcactccccagcctgggcaacagagcaaggctctgtctcaaaaacaagaacaaaaattagctgggcatggtggtgcacacctgcaatcccagctactcgggaggctgatgtataagcatcacttgaacccaggaggctgaggttgcagtgaaccaaaatcacaccattgcactccagcctgggtgacagagtaagactgtctcaaaaaataaaataaaatggaataaaataaaaagaaattggctgggtgtggtggcacacacctgtagtcctggctactcaggaggattgcttgagcccagaaattcaaggctgcaatgggccatgatcacaccactgcaccctagcctgggtgacagcacaaaaccctgcctcaaaaaaccaaaacattattatgaagttatgaaatggtttattaaaaactgcatgaaggccagcgtggtggctcacgcttgtaatcccagcactttgggagactgaggagggtggatcacaaggtcaagagactgagaccatcctggccaacatggtgaaaccccgtctttactaaaaatacaaaaattagcggggtgtggtggtgcgcacctgtagtcccagctacttgggaggctgaggcaggagaatcgcttgaacccgggaggcggaggttgcagtgagccgagatcgtgccactgcatagcgacagagcgagactccaactcaattaaaaagaaaaaaaagaaactgcatgaaaaaaggctgagaggaagtatgctgaaggttaagagtaaacacattcactgggctagaagcttcaagaagggtgactaccacacctctagttcctaaagggcagtacacaaaatgtaactgaatttcttgatgatgtgattatgggtaatattttcttccttagacgttaccttagcatcttagatgaaaaaaaattacagaaaaacaaatgtttaaagggaatagaccagagttgcgttggcaacaatgaagtctctaggaagtacctccccagccttccctcccacctgccctcctctgtgcactacgaccagggcaatcgctaggtggctacccaaggacagcaccactctccactaaggaccagggctgggctgccatgccttcatcggcctggctctacttttaccccaactgggcagacctcaggtgagtttgtatagtagattcccatgctggcccagcccgtccaatgcaggaagacctaaagcccaggttggggtacaagtgtggaccctggggatgtcagatgtcaacaatgccttaactgctctggagaaggaagaagacttcattgaaacattcctcatacaaacccaggggccctggaagaaagcaagggagaggaccgagaagaagtggtatacacagggacaagagcagccctggctgttgcttaccgtctccaaggtgaaactttggcctggatagctccccagagcctcagcccaagcacacttggattctaccagccagcctccacctttgccctagtaagatcttagcccactgctccatagcccctgccagcgtgaaaccagagggaggcctttgcatgagttggggcagagcatgcccagcagcaatctacccgtggagctggctagcaggctctcaggccactaaattctcagggccagactgcccaagccttaccacttaaaaccattccattcatttttatcattttccaaagagccacagattaactgttcatttctttgctcagtagactacacaatctcaattagaaaagggacaagaggtcagatggtcccggccatcttcaggtccctagagtaggcaagggctgcactcacaggccaacccctcccatgcagaggtgtctctgccacccacaccctttgccctgagccctaacaccatcaagcctaaagaaatctaaaggactcatcttcaaaatcagactggaagctcccagatttaaacattctgagcatactaaatcattacaaagcatatctttccttagttatccaaatgattatggaaataaactacaaatccaataactgctgatcaaattcagggacttaaaaaaaaaaaagcatgaccttataaccagcatcaagaagaaagcatctacaggagggagcatgctccatgctcaccttataaccagcatcaagaagaaagcatctacaggaggaagcatgctccatgctcaccttataaccagcatcaggaagaaagcatctacagggagaaatcatctacaggaggaagcatctacaggaggaagcatgctccatgctcatgaccttataaccagcatcaggaagaagcatctacaggaggaagcatgctccatgctctgctttggcaaagcagccaatccatccatgagaacaaattatatacaggacagcggcaggcacagggcaagggccagaggctcagatgtgcaaagtgggaatgaaaaggaacagagaaggtgagtggatgaggaagaacaggaaaggagggcactcacgcaggacaagggtgtgagctgaggtagctgaaggctacacaatgaccaagtgaggccgcctggtggacagatggtgcagcttccggggagaaggcaggaatggagacaggtgtgggaatccttcatgtctggcataatcatctatgatgccgaaagtagtagggtcccgagacaaaacagaacaggagaacagcaggagaccaacaagagtcatgtttaagagtgaggaggaaggagtggcagaacaggagcgagtggcaggctggtcacaggactgggggctggaatgctgcccgtgctccaaaagctcaggaggcaagcaagggccatgatgccagcactgccgagctagaggtgtgacaacagtgggggcagcctgtgggctgggtgtgacgtggtttcaggagagtgagaggaagggggattgcaaactggagttaattataagacaagcctcttgaaggggaggggatcaaaggatgcagaaaagagtaggcactaagagggtgctaaggaaagccatcgttaggagggccttgagcccatcagaaggcagaagactgtgagatgggggagctgggctgtgggggcagacactggaggcataagccccagaaaagacatggggtgaggggaacatgtgggcaattaggaaaagggacttgagacaaatggaaggcacaggttggaggggaccaggaataaagcccgaaatacaggtatccaaagggttagagacatgaatgcaaaaccaagagagaaagcaaaatatctagaggggaatgcttgtcccctcctgaggagctcagagaagaaggtcctgctgatccatcaggccaggcgcagggaagtcaggaaagagcaggagcacagacacactccttttctctgtgtctacagatctgcaaagctcaggactccctgaatttgacaaaacgagtgccaagatgtgactctactcaggacccaaggctacactccctaccttatcaccctagagcgacagccacttctgtgcatctgctggctgcctagactaagagcctactaaggagcagaaaaacaagcccaacagcacacacatcaccttaaagaataatctggtaggaagtggaagtgttcaatactcacaggaacaataagcccttgccaagtcaataaattagcttcatcaacctggatgttacggaagtttttcatcccacatttgcggatttcttcaagctcctgttgattgacaaagcataaaggggtgtcaaataggggaaagcaccacatattaagatccctcctgatgccctcaaattaaaccaagtgccaaaaatgctaatgacaaaattggacagtgaggactaaactgtgcttggagtggttaaggaggcatggagctgccatggcggtcccctctgcaaggttgttgcctctccccatgccccagaccaagacaagcccccacctcagtgaacccccctgaataggacagggggaaccatgcttctgcagacgtaccacctcctctttgggttggtcaccatggctgtttaaatccctcagcaccctgcatagggcagacatgtggcaggagctatcctgaggtgctctacacctgataccttccaatcaagattcattaagcactgattatgcaccggatgctgagaagctaaagatgaataaaactggggactgggaacaaaccagacacaaacgcatatccagttttctacccagtgctataagtgtgatttcagaaggactccacctcaacatgggcacacagcaaagagaaccatccagtctgggactggggtgggagtgggggggtggggacgggaaaccttcactgagcctgtttcctcagctgcaaaacagacccagagtgcagaaaaggaaagggaagccatgttgtgggcaacaggaccccttgcaaatatgtggggttattgttgtataaacagtcaatgcagcaagtgccatttcacccagaaagcacaactttacgacttcagggtcctgcctgagatgtcttcagaactgtctgtcacctgtttttcaactgtgcaccagcctgacatttcccattgcctccaacatctcagtgaatgcctggcaggcgctataacccaaaccacccagcaatgccctcctgccagaacaccagcctcgccaacattcctccactctgacacatgaagtgccactctacccgcctcagcccggcctcccatccagtggcacaaaagccgcctccacacctgtcaggcaccttctcttctgcagcccgagcaccatccagctgagccctgcctccttcgccaggctgcttcctctggcccagctccagcaccctccagaacctccttacgtggtacttcaactcacagtggcttgggggctccctatcagcccccacatcaagcccaaaagatccttgcacctcatacttccatcacacagtggtagtttaaaaggcaccctgaggctacacaggcagggaaggaaacaattggcaaggaagggggaaccggagcccaggttactggttctgagtaggaagatgtgctgggcgcccggcccagagcagcagagagggagagtgcagtgaatgaatacacggaagaggtggaacacactggtgcttcatagcaggcaacaggcacaagtttccccccacagggtgctcctgcctgtcaccctcatctgcccaccacaatcacctggacttgggcccagccccagaaattctggtccagcaagtgtgggtggagcctgaacatagggatttctcacaggctatagctgtggtgagagaagaggcactgctgggagcgatgatggatccatttctccctgaggaggcgttagcggcatgggctgcaacctcctgcagtgaggaatggggtggcctggcccctctccacctgcatgaggcccctctttccctgcataaggaggtacggaacctgagggaccactccaacctgccaactgccacctggtcctcctgctcacaagactcataagaaatgctcccctggggattatgaagcctgggcagactcagaaaggggaagagatctcacacccacactgccacctccttccactctccaaatagaatgtaagctcaacaagggcagggatcaggaagccctggtcctgccagcgcctggctcacagtggtgctcaaacatgtgcttaatgaccaggttggtgggtggatgggaagctggggctttgggaggaaaaaggaatctggggtgggaaggattttctataaatacagttccaatgctgtgtttggcttttttgaccttggctcaagatactagagtaagattcttggctaaggacagggtataccatgcacgtcccttaaggctggagtcctagcaaacaaaatgttttaaaccaaatacagataggaaaaaaatatgccacacagaactttgaaactagacaactaaaaaaagaagaaacaacagtgaagatatctaacatttatgggacaaaacaaattttaaaatcatctgtaaatatactttatggtttcagaaatccacactccaacagtataaagtatgggtgatggctgagtgcgttggctcacgcctgtaatcccaacactttgggaagccaaggtgggtggatcacctgaggtcaggagttcgagacaagcctggccaacatggcgaaaccccatctctactaaaaacacaaaaatcagccgggtgtggtggtgggcgcttgtaatcccagctactcgggaggctgaggcaggagaatcgctcgaacccgggaggcagaggttgcagtgaactaagatcgcaccactgcactccagcttgggcgaaaagagcgaaactctgtctcgaaaaaataaaaaaataaaaaaataaagtagggatgataaacacaaggtaaatttcacaagaattataaaaatatggcaagatggaactcaactgtaacatgagagtgaaaaactgtatcttgctcaagaaaaaggagaggaagcagtcagtgaggagcactaagggcaggggtgcagaaaggacacttactggtgctttggtatcaaggagatccaggggatccacagacaaagataaaagaaatactgccatgggagtgagccacacacctggccagaaagaagaatgggcaaccctgaggatgctaatgacagcagggttgggaagctcagagaatcctaagtagggttatcacataaactcccaacttaccttgccgtcaagttaagctctccaaagacagaaaaggcaacctcctttacatgattctaaccaacaaggaagaactgattataaggcaaaagtgagagaaacaggcaaacaaacaaacaggccctgacatcttcagagaatgatgagcataccatagtagaaagtttctcaacagggtgttgctggcatccagatacgactctgcacttgagcctcccaagcccttaccctgagacagatgccaggcactgtgaccaacccaccccaatttcccaacatcctctacagcttctactgagaaccacgggcactatgagtggccaggatgctaaaagacctgcactgcacaagacggtcctgtggacagaaactatttagcccaaaatgccaatcatgccgggcgcagtggttcacgcctgtaatcccagcatttcgggaggccgaggtgggcggatcacgaggtcaggagatcaagaccatcctggctaacatggtgaaaccccgtctctattaaaaatacaaaaaaaattagccgggcatggtggcgggcgcctgtagtcccagctactcgggaggctgaggcaggagaaaggcgtgaacccaggaggcagagcttgcagtcagccaagattgcgccactgcactccagcctgggtgacagagcgagactccgtctcaaaaaaaaaaaaaaaaaaaaattccaatcatgcctccactgaggaaaacaacttcaagaagataaattcaggccaggcgcagtggttcacacctgtaatcccagcattttgggaggccaaggcaggcagactgcttgagcccaggaattcaagaccagcctggccaacatggcaaaacactgtctccactaaaaaaaatacagcccgggtgcagtggctcacgcctgtaatcccaacactttaagaggccaaggcaggtagatcacgaggtcaggagttcaagaccagcctggccaagatggtgaaaccccgtctctactaaaaatacaaaaaattagccgggcgtggtggcaggcacctataatcccagctacttgggaggctgaggcagagaactgcttgaacccaggaggcggaggttgtagtgagccaagattgcgccactgcactccagcctgagtgacagagcaagactctgtctcaaaaataaataaataaaaataaaaaataaaaaaaagtagccaggcatggtggtacatgcctgtggtcccagctacttgggaggctgagaggtgaaagcggaagaatcacctgagccctggcagtcaaggctgtgcagtgagtcaagattacaaccactgcactccagccagggcaactagagtgagaccctatctcaaaaaaaaaaaaaaaaaaaaaagaaagaagaaaaattggaatcattcagagatcagttccatctgaatatctgagactcaaaaggccagatgactcaaaccctcaagatggttgtaaaccctcaagcaaaactgtgccccgataactgagaatggtcctgacagtgaagaattagggaaggaattgaaggaaaccaatgtaaattccaagaagtggaattcaaaaggatgttacaaatgacagaagaaaggacctgataaaaaccgcaagagcagcccagctctagaacagagttaggaagaccaaagccaagaatgacagatgcttacaaataacactcccacaaaggtttgtttcagttctgctcagagcaagaagcaacccaagtcagctgctcagggctgatggtgcagtgctgacaaagagagagttcaagggaaagcaccaggcagctcacacattccttctcttgatggggacagcaggcttcccaaccagggcaggtggtgcaggagaaagagagcaatgcttctcagaatgaggtccacttcggagcccaagtagacttcagtgtatagaggggaactgaaaaagcccaggggtgccacccagctcctgaaaatggaaaacacccatgccccaaactcaaccccagagagcttgatgcccactccagggcaaagtgtgaagcatggcagagagggatggttacttaacagctttgcaagcactaacaggagagatgggccctgggccccagcagaaggccacggactcaagtcctgagaggagatgggagaacaggacactgctgtatatagccagtgctcagtcacacagctcagatgtacacacctgcgtcttggcaaagcagttaacaaagttcctcttttgcttctttttggggtctacaatgaggcctagaaaactgttcaaaatctccccaggtaaccctcacacaaggccaggtttcagaacccctcaggagccactaatcaagaaatctaggcgaggcgcggtggctcacacctgtaatcccagcactttgggaggccaaggcgggtggatcacgaggtcaggagatcgagaccacatggtgaaaccccgtctctactaaaaatacaaaaattaggtggacatggtggcgcctgcctgtagtcccggctactcgggaggctgaggcaggagaatagcttgaaccagggagtcggaggttgcagtgagccgagatcgcgccactgcactccagcctggtgacagagcaagacttcgtctcaaaaaaaaaaggaatctatgccagcgccaggcgtggtggttcatgcctgtaatcccagcattttgggaggccaaagcaggtggatcacttgaggccaggagtttgagaccagcctggctgacatggtgaaaccccatctctactaaaaatacaaaaattagccaggcataggggtgcatgcctgtagttccagctactcgggaggctgaggcatgagaattgcttgaacaagtgagacagaggttgccgtgagccaagatcacaccattgtactccaactccagcctgggcgacagagcgagaacctatcttaaaaaaaaaaaaaaaaaaaaaaggccgggcacagtggctcacacctgtaattccaacgcttcaacactctgggaggctgaggcgggtggatcacttgaggacaggagtttgagagcagcctggccgacatggtaaaacactgtctctactaaaaatacaaaaattagccgggcatggtggttgactcctgtattcccagctacttgggagggtgaggttggagaatcactggaatccgggaggtggaggttgtggtaagctgcaatcacaccactgcacttgagcctgggtgacagagcaagactccgtttaaaaaaaaaaaaaaaaggctgggtgcagtggctcaagcctgtaatcccagcactttgggaggccgaggtgggcggatcacttgaggtcaggagtttgagaaccagcccggccaacaaggtgaaacctcatctctactaaaaatacaaaaattagctgggcatggtggcgtgcacctatatatagtctcagctactcgggaggctgaggcaggagaatcgcttgaacctgggaagtggaggttgcagtgagctgagatcacgccagtgcactccagcctgggtgcagactcccagagtgagactccgtctcaacaaaataaaataaataaaataaatctaggccaggagccaggggcggtggctcacacccgtaatcccaacactgggtggtcaaggcaggaggatcacttaagcacaggaactcaagaccagcctgggcaatacagcaagaccctatctctacaaaaataaaaaaattaaaaaattagccaggtgtgttgatgtatgcctgtggtcccagctactcaggaggctgacttgggatgaccagttgagtccaaaaggttgaggctgcagtgagccatgatggtgccactacactccagcctggtcaacagagcaagaccctgtctcaaaaaaagaaaaactagaaaagaaatccaacagcactagacgacccttcccccaacaaaatatgtaggaatcctcccatccaatatttccagctaaaactctttggtgcaacccagtaattccaactaaagctcttggtgcaacccaaatgagcagtgtgcagaatcctaccaagtcagcctggtgacttcccccctctatgtctttccccaggatgtcttctggaaggatgtccctaactgtcctgcctatcaccagccccacatccccaacatgctcatcattgaaagcctctctcaaatgcctgttcctctaaggagctccccaagccctggctaaaagggatgctcctttctctcaacagccactacaatgtttctgtacaaaatggataaacagaggctggatcaagaagagctgaggagaatcgaatggctttagaactggtggcctgaagtcaccctggtgggaagtgggctgagagagatgtagttaggtaccacatatcagggaaggaacgaatacaggcttaaagaccaaacctctaaggatcctggatagcaaaaccacaccccaagtcacagaatgaaatattttagagatccagtaaagacctggacttggttccaaacacttaatttttcaccaagcacaaggcatgaaccttagcagcagcatgaaaaactgactggtttagctgaccaatcgtttgtgccatgtttagcgtccaggccaccctgaactattcagagccaaatgctgtgtccagttctggacaccatactttagaagaccacatcaaataagggctgctcaggacaagaacagcaaggaccatgtcctaccaggaacaatcaaaaggtccaggaacctatggcctaaagaaatgtgaagatgacatacatctgtcttcaaacgttaaaaagttcacctgctggttggacgaagtggcttatgccagtaattccacattttgttgttttttgtttgtttgttttgagacggagtctcgctctccaggctggagtgtggaggcgtgatctcagctcactccaacctccgcctcccaggctcaagtgcttcttatgcctcagcctcctgagtagctggggctacaggcacgcaccaccatgcccagctcatttttgtatttttagtagagatggggttttgccatgttggccaggctggtctccaactcctaacctcaagggatccacccgcctcggcctcccaaagtgctcctgtaatcccagcactttgggttgccgaagcgggaaaatcacttgaggccaggagttggagaccagcctgggccacacagtaagacctcatctctacaaaaaaattaaaaaatgaagcggaaggattgcctgagcccatgatcatgccactgcactccagtctgggtgacagagtgagaccttgtctcaaaaaaataaaaataaaataaaacttaaaatttaaaatttaggccgaggccgggtgtggtggctcacgcctgtaattccagcactttgggaggccaaggcaggcagaacacaaggtcaggagttcaacaccagcctggccaatatggtgaaaccccatctctactaaaaatacaaaaattagccaggcgtggtggtgacacctgtagtcccagctactcgggaggctaaggcagaagaatcgcttgaacccgggaggtggaggttgcagtgagctgagatcaccccactgcactccagcctgggtgacagagcgagactctgtctcaaaaaaaaaaaaaaaaatttaggccagacacggtggctcatgcctgtaatcccagcactttgggaggccaaggcgggcggatcacctgaggtcgggagttcgagaccagcctgaccaacatggagaaaccccgtctctactaaaaatacaaaattagcccagcatggtggcacacgcctgtaatcccagctactcaggaggctgaggcaggagaatcgcttgaacccaggaggcaggaggttgcagtgagccaagatcgctccattgaactccggcctgggcaacgagtgaaactccacctcagaagaaaaaaaaaattaaaatttaaaaagttcacctgcaaaggattcaaccttctatatgagtaaagaagaaagaattggggccagtaagtgttcactatcccaggcagcttttgactcagtgccaaactctttaatgctaccttcacgtggtctaagcccccctgactcggggcagcagtcgtcatgtcattatagatactcaaatgggtggggcagacagggctgccagtggccagggctgtcagaaagaagccacctgcactgggcaagactgtactatacaccctcttgagtctcctctgaagtcagtgccaggagcaggtgaacagacgtgcagaagaataaccagtggggccagtcagggatgcttcagatgtcacagcagtactatgggcagcaagtctcaatgcaaggacactggtacaatgtaaacaagcatattccataccactgtgtcattttatatctgttaaatggcaaaaggcctgtagtatccctaaaggaaagtaaagcttaaggccacttttcttggctgttgagggtgggttaaaagaactgagaaacgctgctctaggaacctttaggtcacagtgaggaaagtctagcagacaccagtggagggaacagctttgtggaagacaggctctgagatgggccttgaaagacgggggaagacagaactgctagagaacaggtgtccatgtgtgggaaatgtgtatgcagagacatggagggcagaaatcagtgggggcgttagggaagcagaaaggaaaccagtttagctgcagtgtttaccaactcagggcactcatgatcagggccagaactttcagccagggtgcatggccaagcccctgggggctgtttaatacccctatgcagagaggcaggggaagggcttagatgggtacaggggagaaggaaggagagctgactgtgcctaggcgccatctaggacctgcttattgcatcagcctccagtacaagatgggtacctttctgaggggagtgctcccagatgactgtgatgtgcaacccctgctctgcttaagaatcaccatattgagggccgggcacggtggctcacgcctgtaatcccagcactttgggaggctgaggcaggtggaacctgaggtcaggagttcaacagcagcctggccaacatggtgaaacctcgtctctactaaaaatacaaaaattaactgggcgtggtggcaagcgcctgtaatcccagctactcgggtggctgaggcaggagaattacttgaacccatgaggcagaggttgcagtgagccgagatcgcgccattgcactccaggctgggcaacaatagtgaaactccggctcaaaaaacaaaaaactacaaaaattagccaggagtcatgatgcatgcctgtaatcccagctacttgggaggctgaggtaggagaacagcctgaacctgggaggcagaggttgcagtagaccgagattgcaccactgcactccagcctgggtgacagagcgagactccatcgcaaaaaaaaaaaacaacaacaaaaaaaaacccaccacattcataccacccagtttcttggcaaggaaaaaactggagccttgatgaatgcagtgtcatttctacagctagaaacaagctcctaaaaggactaaaacctcccactgagctaagcacatggaaaaaatccctctgactacaagtctataagcaccgaaacccagacgttgttctgaactgtttttttttttgtttgtttttttgtttttttttttgagatgaagtctcactctgtcacccagactggagtgcagtggtgcgatcttggctcgctgcaacctccgcctcccaggttcaagcgattctcctgcctcagcctcctgagtagctgggactacaggcaggtgccaccatgcctggctaattatttttgtttttttttttcagtagacatggggttttgccatgttggccaggctggtctggaactcctgacctcaggtgatccacctgcctcagcctcccaaagtggtgggattataggcatgagctactgggcacagcttgttctgaatttttttttcttttttttttgagacagttacactattgttgcccaggttggagtgcaatgttgtgatcttggctcaccacaacccccgcctcccaggttcaagtgattctcctgcctcagactcccgagcagctgggattacaggcgcccgccaccatgcccggctaattttgtattttcagtagagtcaggggtttattcatgttggtcaggctggtctcgaactcccgacctcaggtgatctgcccatctaggcctcccaaagtgctgggattacaagtgtgagccaccgtgcccagcctgaaggtttttttttcctttaagtgaacaccggccagcacagtggctcacacctataatcccagcattttgggaagtcaaggtaggaggatcgcttgaggccaggagttcaagaccagcctaggcaacatagcaagatcccatctctacaaataataaggataacaaaatggccaggcatggtggctcaaatcccagcactttgggaagccaaggcaggtggactgcttgagcccaggggtttcagactagcctggaaaacatggcaaaaccccatctctaccaaaaaatgcaaaaattagctgtgcatggtagtgttcacctatagtcttcagctacttggggggctgaggtgggagaattgtttgaacctgggaggcagaggttgcaataagccaagattgcaccactgcactccagcctgggcaacagggtgagactccatctcaaaaaaaaaaaaaaaaattagccgggcatggtggcacacacctgtagtcccagctacccaagaggctgaggcaggacgatcctttgagcccaggaattcgaggttataatgagttataatgagttatgatcatgccactgcactccagcctgggcaacggagcaagaccttgtctcttgaagaaaagaggccaggcatggtggctcatgtctgtaatcccggcactttgggaggctgaggccggcagatcatatgaggtcaggagttcgaggccagcctggccaacatggtgaaactccatctctactaaaaatacaaaaattaagtccggtacaatggctcacacctgtaatcccgcattttgggaggctgaggtggggggatcacaaggtcaggagttcgagaccagcctgaacaacatggtgaaaccctgtctctactaaaaatacaaaaaacttagccaggcatggtggcacatgcctgtagtcccaactactcgggaggctaaggcaggagaactgctttaactcaggaggcagaggctgcagtaagccgagatcgcgccactgcactccagcctgggcaacagagtgagagtctatctcaaagaaaataaaaagaagaaagaaaagaaaagagtaattccaacaagaacagaaaacaaagagatgctgggaaaggggtagccatggcttgagaggaagtggtcaattataaggccattctgcactgtttacaattcatagtcctgagatgggcaagtggggcatattagccccatttcacagatggtaaagccaaggctcagagatgtccaagtcaaagaacttgtatagagcatgcccaggactagaacctgcactgaaattgctcttttttgactatctcagccacccaaagcagtgagttaatgctcccattagaaacggacagagcaggttttcctgtttactctgtgggatcccaggagggcttagcttgctctggaatagtattgaccaatatttacatcaacaaaaacatgaacatattcagtattttccctagtcctgcacagctagtcattatgtgcctgtgttgtgcaaggaatatttctaggctcctactgctcaggcaaaacaaaacctggcagatggagctggacatctgaggaaagttacataaacctgccttaaatctaccaaattccagtataactggtctatcaaagtaaataattgtaacagaaatgcaaactttccaagcttgcataagacaaccgttagcaatgacactaaaatcatgacttttttttttccccctgagacagggtcttgctttgttgccgacgctggagtgcagtggcatgatcacggctcactgcagtctcaacctccagagctcaagtgatcctcccacctcagccttctgagaagctgcgactacaggcatgtgccaatatgcccagttaatcattttattttttgcagagacagggtctcactatgttgggcagactggtctcaaattcctaggctcaagtgatcctcctgcctcagccttcctaagtgctgggattataggcatgagccaccgtgcctggccactaaatcatgacttaaatgtaattcaatatactgaaaatctaaacataagcctcatggccttctaatgcaattctctcatttcaactaacatttagctaagggggcaggacccatgccaagacatcatcccttccataggtcagcagtatggtagctatcttacatttagttatcatcataactaattacacctggggctgggcatggtggctcacgcctgtaatcccagcactttgggaggccgaggcaggtggataacctgaggtcagaagttcgagaccatcctggccaacatggtgaaacccccgtctctactaaaaatacaaaaattagccaggcgtggtggcgggcacctgtagtcccagctactcgggaggctgaggcaggagaattgcgtgaacctggtaggcagaggttgcagtgagccgagatcacaccattgcactccagcctgggtgacaagagtgaaactccatctcaaaaaataaataaataaataaataaataaataaataaataaataatacacttagctatgatcataactttatgaagtcatctcatcatctgctggacaaatcagggcactgaggctcaaaggcacaacactaaggagtcaaaggcagaaatctacatctgaactcttactctatcacagcacagtgcttctcagaggttacagcacactccttctcaggtggtcattctaagaggacatgacaaagaaaacactcaacagaggcttagaggaacgcactgcccacaacctccacagtaagcatgggggaagcatggccaaagctccaactcagcaggccttgacaccagcttctggctgccgggcctcattcctggaaggtgtttccgtgtccatctgtacatgggtgtgcctggcattcctgacctccattacaaactccagagtccagcacccccctaccagactgacagctccttgagggctgggacaccgacctcttcaagtctgtccacaacagactcaaccacacaaagcctgacacaggacaaatgggcacgacgggaactgcctgtgtaaaactcgtggagaatccttcaggaagcttaggttttcttatgctgactgttcttttttttttttttctttcgagacagagtcttgctctgtcacccaggctggagtgcagtggcgcaatcccggctcactacaagctccgactcccgggttcacaccattctcctgcctcagcctcccgagtagctgggactacaggcgcccaccaccacgcccggctaatttttttttgtatttttagtagagacagggtttcactgtgttagccaggatggtctcgatctcttgacctcatgatcctcccacctcagcctcccaaagtgctgagattacaggcctgagccaccgtgcccggccgctgactgttcttaatgagaggcgtgctggtgtgaaacacttttttataagccatctcagacgggttcagaggctattcaacctctgagttacaccctcttcctcaccgtgagtcaggtggtctcctctcagaaagatggagcatcacatgagccctgacattagcccatgagccctttgacattagcacctgctttggttgcagatgtgcctgctgggataagggctgtcaaaagagaatgttccccgctctgcctacctatgctaggaaagtagggacaaaatctgacaagaaagtgaaatacagaaaactataatcaacacagccctggaagtgttaaaaaccaaaacaaacaaaacccaaacagccaccgaatctgaaatgaaccctcttcttctccatcttgtcccttcctcaagaccaaaagcaaccatctaaaaagcaggagcaaggcccagagagcaggggaccttgatgttgggcctggctccaccactgacttcagcctcctcatctgtaaacagaggccactggtgtctgctttccaagatccctcacacagctctggaattctagagtatgtgtgcagcaagggtcagaaggagaaactacacagccaccagaagcaactttcttaactttctgcttcaaggttgaaagagaagacaagggctgggtgcggtagctcacgcctgtaatcccagctatttgggaggctgaggcaggcggatcacctgaggttaggagttcacgaccagcctggccaacaccatgaaaccccgtctctactaaaaaatgcaaaaatcaggccaggcacggtggctcacgcctgtaataccagcacttcgggaggccaaggtgggtggatcatgaagtcaggagatcgagaccatcctggctaacatggtgaaaccccgtttctactaaaaatacaaaagattagctgggtgtagtggcgagcgcctgtagtcccagctactcgagagggtgaagcaggagaatggcgtgaacccaggaggcggagctttcagtgagccaagactgtaccactgcactccagcctgggcaacacagcgagactccatctcaaaaaaaaaaaaaaaattagccaggcatggtggcacacgcctgtaattccagctactcaggaggctgaggcagggagaattgcttgaacccagaggtgaaggttgcagtgagccaagatcgtgccactgcactccagcttgggcgacagagcgagactgcgtctcaaaaaaaaaaaaaaaaaaaaggaaagagaagacaagaagcaagaatattacatctgagacctcaacttctcaatcaagagttgctttcggccaggcgcagtggctcacatctgtaatcctagaattttgggaggccgaggtgggcggatcacaaggtcaggagtttgagaccagcctaaccaacatggtgaaaccccagctctactaaaaatacaaaaattgggggccgggcatggtggctcacgcctgtaatcccagcactttgggagaccgaggcaggaggatcataaggtcaggagatcgagaccatcctgactaacatggtgaaaccccgtctctactaaaaatacaaaaaaattagctgggcatggtggcgggcacttgtagtcctggctactcgggaggctgaggcagaagaatggcgtgaacctgggaggtggagcttgcagtgagccgagatcgcaccactgcactccagcatgggcgccagagcaagattccatctcaaaaaaaaaacaaaaaaaaacaaaaatgcaaaaattagccaggcgtggtggcgtgcgcctgtaatcccagctactcaggaggctgaggcagaagaattgcttgaacccgggaggcggaggttgcagtgaaccaagatcacaccattgtactccagcctgggtgaaagagcgagactccgcctcaaaaaaaaaaaaaaaaaaaagttgctttcaaacctccacccctgccccagttcagcacctgtgggagccttccatagcacctatgctcatctttggacacagtgactgtcacactacactggatgtttacaatatgcaaggtaaatttctgagatattagaaagacaaattttgagttcaagagctattcaattttaagctgggcacagtggctcacgcctgtaatcctttgggaggctaaggtgggtggatcgcctgagggcaggagttcgagaccagcctgggaaatggagaaaccccgtctctactaaaaatacaaaaatcagccgggtatggtggcgcatatctgtagttccagctactcgggaggctgaggcaggaggaatggcttgaacatgggaggcagaggttgcagtgagctgagatggtgccactgcactccagcctgggtgacagagtgagactccgtctccaaaaaaaaaaaaaaaaaaaaaaaaaaaagctattcaactttgttgggaaaagtaaacttttctcttttttctttcgagagtctcgctctatcacccaggctggagcgcagtggcaccatctcagctcactgcaacctccgcctcccggattcaagcgattctcctgcctcagcctccagagtagctgggattacaggcatgcaccaccacactcggctgatttttgtatttttttttttttttttttagtagagatggggtttcgtcatgtttcccatgctggtctcctcaagtgatccacccgccttgacctctcaaagtgctgggattcggatatgagccaccacgcccagccaagtaaacatttttctttttccttttctttttttttttttttttttgagatggagtcttactctgttgcccaggccagagtgcagtggcatgatcttggctcactgcaacctctgcctcctgggttcaagcaattctcctgcctcagcctcccgagtagctgggattacaggcacatgccaccacacccagctaatttttttgtgattctagtagagacggggtttcaccatgttgaccaggctggtctcgaactcctgacctcaagtgatccacctgccttagcctcccaaagtgctgggattacaggtgtgagctactgcgccaagccaacattttttgagacagagtctcactctgtcacccaggctggagtgcagtggcacgatctcagctcgctgcaacctctgcctctcaggttcaagcaattcttctgcctccccctccctagtagctgggattacaggcacgcaccaccaggcctggttaatttttgtatttttggtagagatgggttttcaccatgttggccaggattgtctcaatctcctgacctcatgatccgcccacctcggcctcccaaggtgctaggattacaggcatgagccaccgcgcctggcccccagccaacatttttaaacaaacattcacacagctgtctcagtaactctttctccaacctacagaataagagagtaccacaggtaagagaatgggctctcagtgatgagggtatgtccaggcagactggccccaacctgtcccgaaaacacctttgcaataccatctcctatcactcctccaaatcctcccctcctgtcaggctggtcacctccctgccctggaacatgtcttggttattcccaataatatctacaagtagctcacacttactatatgccaggcactcttctaagcagttggtatatattaactcatttaaccttcacacacggacgaagtaactaaggcacagagaggtaaagtaacttgcccagggtcactcagctaagacatggcaggcccaggattgaaactccagaacctgagcttttaactgctatgctgtagtcttcctctaaacagctttgctctgagcaaaagccccttcctccctttcttataggggtggggggcttggggaggttaggcttatttatgtcccccaagaacaggcatgatgaagctggccacaggagatacatgcaaagccctttctgagtgagtggcatgccacttctcctggatagctgtagcatccaggagatatgtagatctggcccctcaacctaaaggctatggcatctctgccacctgtccttaaatccatcagcactgccctcagtgacccctctatagagaggtagctcaccctccaaggctggcctggcagagggaggtctcctagctctggaggaaccaggtgcactggacatgccaatctggggtaaaatcaagccaatgcctcaacacttctggaaagcatctcaggggctggcctaactaaaacccaaagcgggacggcacaaggtcagacgcaagcagcactggggagtaggcagatggtctctggggctcctcaaagcatttcccataggcactgcccacagccctcctgagggatgagagagactcaacctcactggccacccagtccgtcttcttcaactgctgaaaccctactcgtgcttaaagggccaggccaagttcgacctcctcctcagtgtcagagggggtctttccctctcctgcaagccattattcaggtggcagacatctagcacacagtggccagcccaggatttctttgttccaggtacgtgccatttttctcctttgttgagctcctcaagggcagaggaattgccccttgagctgagtctcaaaggtcaaaaagttaccctggtacagagaagagacagggatgccaatcacgagatccagagtgtgtgtgcaaagcatgctgtttttaggggactcaacgggcaagtggggagagacaaggctggtgagacaagaccttgaaggaaaaagctaaggaatgtgcacttgtaatccagagtcccagcctcatcctcaccctactaaattctgctccaatctctgagagcagggcctgctcatgtgcacttctctactgcacaccacaccatacactactctgatgcactgctggttaggagtagtgtgggacagagagtgcgctgaccagtaaggagtttagatgaaccattaaggagctcgatgcaggtgtctaccacaaacagggatggcctgaactgaggcagtgggagtggcagtggcattgggagtgggagtggggatggagagaagacaggcagagaagagagactgaaggcatagttcagcagaatccgccaggtgactagacaagggaggaagagccgagaagggctccgctggcgttttttccttgagcaactgagtagacaagtgaaccattaactaaggtgggacaggaggagatgcatggggccagagggagagagtcacaggaggagctaagactcagatgcctacagatctatgtgccgttcccaagaaaactctggaagtggttggagtctggctcaggaggaacgtctctgtggctctctaatgtgcacagtgtgtgcagtgtgtgtgcagtgtgaagctgcaaagaaatgtggctctcacatttactgctgtagcaaagaatatagaaatatcttaaacgtaataaatgttccaataaaatgagaatactttcaagtgtcctcttataataaaattttaaagcaacagtctcctaatttagagttttaacaagatcagaaaaggccccagtaccctgagacaagagtttttgtctcagggttttctttttttttttttttttttgagacggagtctcgcactggaatgcaatgacacaatcttggctcaccgcaacctctgcctcccgggttcaagcaattctcctgcctcagcctcccgagtagctgggattacaggcacccaccaccacgcccagctaattttttggatttttagtagagacgggggtttcactatgttggccaggctggtctcgaactcctgacctcatgatccgcccacctcggcctcccaaagagctgggattacaggtgtgagtcaccacgcctggcctgcctcagagttttctagtaaataccttaaaaggtcccaaatgttgcaataattgagtatactccttcccatcacctgtcccaaacatttacaaagaataccattaagggaggctgaaacagtcccaacttactggaatgcatgaatttagaaaaaaagacgcaacgtttttctcaattcacaaagcctcagtggattcaggacatttacactggcataacatcacatataaaactcccctcacctcctgaaacatgtgacatactcattgctctatctccttaatcacccaacctcagaatctaaacctatactcaaaagcaaactacctcactgcttaatacaacgaaacccaaggaatgaacttttagaggttcctcctactatgactatgaactgggagaaaatataacaatatgaagttctgagtgaacatttttaaatagcattaggctgggcgcagtggctcacacctgtaatcccagcacttcgggaggcctcggcgggcagatcacctgaggttaggagttagagaccagcatggcaaacatggtgaaacctcctttctaatacaaaattagcagggagtggtggtgcacacctatagtatcagctacttgggaggctgaggcaggagaatcgcttgaacctgggaggcagaggttgtagtgcacagagatcgtgccatcgcgctgaagcctgggcaacaagagtgaaactccttaactcaacagttatgtcatgataagtaataagacattacacacacacccctctaaatccacagatttcccctctgagaaaagcccttctgggaagctactcaacaggagggcccttaggggaaatgtgtgcagtgtgaagctgcaaagaaatgatcagatggcaatcagttgcctaagccacacataaaggtttcacttttggcttttgcagcaatttccccatcctgattgaagcaatggttacaatctggttgtagccaacaatgctaaattagctgcttgcaaattaaaatgtacttaatgttttattaacactgtaattcctaaaaaggcttctaaaagaggttaagcctcctggcaagtgcttttgaaataaaagactttatcatactcactttgcctaaaataacttctcagtgtagtatatgtaaatcactctacttttaataatgtgttttacactatctgcagacagtccattgttacaaagaaatctttgctgtggaatgtcctagaaaacatttttaacagaaatctaaagttctttaagatgtaattaatttgatcattcaacatttgctagattgctatgcctaaggcactgttccatgcactaagccccaacttttcaccaacgaaaatcactttattaccaccctatgtactgaaaagactgtttatcaacttgtatcaataatttttcttcctttaaaagaaaaaaaaaacagtcttaaacattgattctcacagccaatgatcagcattacataactggtgttcccctagtgaactgaaagcctttccatcctcaacttaagaaacaacacaccgctccatgcagcctttgagtaagaaagacagcctgacaagaggcatggaatttggatcctggagccaggaagagtcagcgtcttctctctccccaccacgttccacaattctaccttaggtaactcccttaacctacttaacctcacaatgtcctcatttataaaaaatacaaatgacaatacactaactttgagtgttgaaaagatgacttacgtaaataacctaatacttaataaatactcagttaatgttacaatttttttccaaggtctgtttttttttagaaacagagtaataattttaaaaccataataagtcccctcttagacccctgagagcctggagattccaaactgggtcaactgggataggctagggggctaccaggatgaattaggtcaagatccctgcccttcgggatctcagaacccagtacaggaaagacaagtctgtaacacaaagagattgtgacaagtgctcaaagagaaatataaagaaagcgctgtggtcacacaaaggaggaaacaacacattctgaagggggatgtgggagcacgggctcacagagtagttggcactggagttgaacctgggacttctctggaagggagaagtgaggagaaggcagcttttcttgggtagagcaaacaacacgtgcaaagggacatcagacagcaagtaagagcaggagactttgctttggagaaagaaccgaattcgatcacaactcactctccctagctaggtaaccctgggcaagccaaagaatcttttctcatcgacaaaatggaaatcacaatgtctacttcacaggaaggattaaacatgatcatgcatataaagcacgaagtaaaagctggaaaaatagtagctactgtgattaggtgcaagaactgtgggaaaccaaagggcaggaggtgaggctcaagggattgctttcagccagtctcagaaaggtcctgcatgccaagtaagaggttaggattaactgctgaggacaataacaccatagaggtttttaacaggagtgaaagaattgagttatctgctttaaaagaactctggtgtccgtcaggggtagtctggggaggagagcacttgggagggcacctgagagatgaggatatagattcagagtaatttcagtaacattagaaagcaaggcatgcactccagaaatcttttttttttttttttttttgacatggagtctcactctgtcgccctggctggagtgcagtggtgcaaacttggctcactgcaacctccacctgccgggttcaagcgactcttccacctcagcctcccgggtagctgagattacaggcaaatgcaaccacgcccagctaatttttatatttttagtagagacagggtttcaccatgttggccaggctggtcttgaactcctgacctcaagtgatccgcccgcctcggcctcccaggagtgctgggattacaggcgtgagccatcgcgcccggcctgcactccagaaatctttctaaatttaaatccacaagggttaatggacgactgcacctgggagtagggtaggaaagaaagccattaaccgaccccttatctggtgaatggtggtgtcactagcttaagagatgaggagaggtctgaagtcctctgactgttcttttgtgcccacttccactccagttttataaagttaatgtcctctctagcccttagggaacaaaagaaaggaaacgttcccagggacggagggaatgctcagagactgtggctccaagttcaatgtctagctctaccaagcactgctccgcctagaacgaaccccagctctttatctcccctcaggaaactggctcctgggcctttttttaatttccggcccgttgcaggccggcagcactacccagccgccgactcacagatgctggcggggtgggctacagaggaccttggcaaatccactggcaaaagtactaagccaatttagcatgtgttcctcaccaaaaggtgccaattagcgagaaagcaccctgctgcattcaagatccaaagtaccaaattattattataaactttggcccgttttgattcgaacgactgaaatcaaccgttatccccccaaaaatggcactttatcagggaggggagatcgggatgactgagtggaggagagggaagcagaaccgcgccgcgatcggggccgacctcaggccttcctggagttggaacttacccgctgtgtgactctgcagtcacaaggcgacagtttgctaggacccagcgcaattccaaacgacccaccaacaaactgacctaactttggccgcctggcctccttctctctttcctagcccgaacctcccagactcccgagctgcggccgggccaagcggagctgcaagcccggcgcgctgcggcccagggcggggcggttccgcggcgcgggctccgggcaggggctccggcgctcgggccttccccgaaggcgcccggtttggagcctcccaaccgggctctcacattaacgacgccctcagatcggaccgcggcctccgcgacagggggacgcggccaagctccgggcggagagtggcgtgaacgccccgggccgggctgaggggccgacagcggctcccagcgcggccttgcgctcccgcccaggctgcggcctaggccagccccgttagcaccttgagcctgcgcgcggcccagggaaccgacgaggccgtgtagggcaggaagccagacggcagcgccctgagaagccgccgcctgcctcggggatccggagcctaggacgccgccccacgcccggccgctgccagagaatggcttttaccttcatcagcctcctgctggccgccatcttggatttggtgctgctccttccccagaatgcatcgcggccggccgggcggctggagcccccgcacttcctggagcgggggaggggccgcggggcggggcacaggagcagagcggagcacctactgtgtgcttcccactgtgctggggggcgcgtggaggaacgcaagtgaaccgcacagactgggcctcagcgtttacggatcgtccaatcagatggcagttacaaccagtgcctggcacatagtaggagcataataaatactgattgcataaaatagttgaccaggcgcgggggctcacgcctgtaatcccagcactttgggagaccgaggcgggtggatcacgcggtcacgagttcgagaccagcctggccaacgtggtgaaactcggtctctactaaaaatacaaaaaattagccaggcgtggtggcgggcgcctgtaatctctgctactcaggaggctgaggcaggagaatcgcttgaacccgggaggcagaggttgcagtgagccgagatcttgccactacactccagcctgggtgacagaggaagactccgtcttgggggaaaaaaaaaaagttgaataaccaaggttacttcacactgccaagctctgtgaagaaaactgggtgataggaaagtgactgtggggacatactttgagaggtcaaggaagccaaattgaggaaatggccctactaagtgccagacctctctctagtgctttattttctttaacccttgaaaccatcctctgggatacgttagcattaacatcctcatttcacaataaacagaagcacagaagaagccagtgacttgcccaaggtcacacggccagctaggagcagagccaggctcctgtcacaggtgggctgctggctccaaagccaatgctgggacctggaaaatgggaaggaacagctgggaggactggaggagaatgtttcaagcagaggaagcagcactggcgaagaccatgaggctgtctcagtgtccagaatggagtaaaaggattatagggtgggagggaggcaggggacagaccatggagggtcttgtagaaaggggaggagttggtttctattccatgtgctgtgagaggtctttgatagatatgagtattgactccatggtcagatgattttttttttttttgagacagagtcttgatctgtcacccaggctggagtacagtggcacgataacagctcactgccgcctcgacctcctaggctcaagggatcctcctgcttcgcctcccaattaactgggactacaggcacgttccaccacaccctcctaagtttttttttattttttgtagaaatgaagtctcactgtcttgcccaggctggtctcaaactcctgagctcaagcagtcctcccgccgcaacctcccaaagtggtgggattacaggcatgagccaccacacctgggctgagacgcatgttttaaagagtactttggggcttggcacagtggctgatgcctgtaatcccagcactttgggaggctgaggggggtggatcacttgaggtcaggagtttgagaccaccctgaccaacatggtgaaactccgtctctactaaaaatacaaaaattagccaggtgtggtggtgggcgaacgtaatcccagctactctggatgctgaggcaggagaatcgcttgaacctgggaggcagaggttgcagtgagccaagtccgcgccactgcactccagcctgggcgacagagtgagactccatcttaaaaaaaaaaaaaaaaaaaggagtactctgattggaaaatggggaatggaggtgggtaagaggataagaaggggagcaggggccacttggaaaccggttgcaatcattcaggcaaagaggtgacagtggtttggacctcaggtagcaatgcagagagaagaacatagcttcagaatatactcagaccttcttaaggagtttttctcttttttttttttttttttttttttttttttgagacacagtttcactctgtcacccagggtggagtgcaaaatggcatgatctcagctcactgtaacctctgcctcccgggttcaagtgattctcctgcctcagcctcctgagtagcatagattacaggcacctgccaccatgcccagctaatttttgtatttttagtagagacagggttttagcatttttggccaggatggtcttgaactcctgacctcaagtgatccacccaccttggcctcccaaagtgctgggattataggtgtgagtcactgggcctggacatttttctccatttctaagaacagtgggtttctcctgaaaggagagaaggaaagggaactggaaataatatatcctggggccgggtgtggtggttcacacctgtaatcccagcactttgggaagccgaggtgggtggatcacgaggtcaggagattgagaccatcctggctaacacggtgaaaccccatctctactaaaaatacaaaaaattagccgggcgtggtggcgggcgcctgtattcccagctactcgggaggctgaggcaggagaatggcgtgaacccgggaggcggagcttgccgtgagtggagatagctccacagcactccagcctgggtaacacagcaagactcagtctcaaaaatatatatatatagatatatatatcctggaataaggctggcctcacactcatcttgggagcccaggcttgacacggtaaaggagggagaaactagatgacaagcctcatgtgatcagcgattctgcctgccttttacctcccccaaggccagtacactgagtgttcaatacacattcagcgtatgcatgagggaccccatcagatctctagggtcatggtgggacttagaagtctgggactgactctggggtctactgtgagcacagaacctgcccttactgggcccaggacaaataaaaaacatagctgtattgggaactgctttcctctgtggagaattacggaggaaggggacgcttacgctgagaaattccaagccagttgaggaagcacagttcatacctttgacccggatgtgctaagctgagaatacagagtgggatcatcagaggctcaatgtcaaggactagcctttgccatggcatcttcttacatcctcaccgctgcctgcaagatgactcccttgcactttgcaggtggggagtcaagccgctgagctacaaagtgcttttactaaacaagcactcaggaaatgtacccagtcccagtggaagggctgcctggcctttggggtccctctcctgctctaaaaccttcattgctccctctagcaggcctggcttctagtcatacccgatcccctccactcagccaaaccttgttcatacagacctatcctttctgtgccatctgcccaagcctcccatcagaagtaaccttgtggtgactcatgcctgtaatcctagcacttggggaggccaaggcaggaggattgcttgagccaaagagtttgagaccatcctgggcaacatagggagaccccgtctcaacaaaaaataaaaaaagaattagccaggtgtgatggccaagtaattctagctacttgggaggctgaagtgagaggatcacttgggcccgggagagtgacactacagtgagccgtgatcgtgccactgcactcaagcctgtgtgaaagagtgagaccatgtctcaaaaaaaaaaaaaaaagaaagaaagaaaagaaaaagaagtagacttttttggctgcgtacagtctcacacctataatcccagcactttaggaggctgaagcgggagaattacttgaggcccggagttcaagaccggcctgggcaacatagaaagactaccatatctacaaaaataaatagtccaggtgcagtggctcacacctgtaatcccagcactttgggaagctgaggcaggcggatcacaaggtcaggagttcgagaccagcctggccaacatagtgaaatgccgtctctactaaaaatacaaaaattagctgggtgtggtggagggtgcctatagtcccagctacttgggaggctgaggcgggagaatcgctcgaacccgggagggggaggttgcagtgagccgagatcacaccattgcactccaacctgggtgacagagtgagagtccgtctcaaaaaaaaaaaaaaagtattaattttttttttttgagacggagtctcgctcttcgcccaggctggagtgctgtggcgcgatctcggctcactgcaacctccgcctcccgggttcacgccattctcccgcctcagcctcctgagtggctgggactacgggagcccgccaccacgcctggctaattttttttttttttttggtattttcagtagagatggggtttcactgtgttaggcaggatgctctcgatctcctgagctcgtgatctgcccgacttggcctcccaaagtgctgggattataggcgtgagccaccacacccggccagtaataaatttttttttttttttttttgagacggagtcttgccctgtcgcccaggctggagtgcagtggcgcaatctcggctcactgcaacctccgcctcctgggttcgagcgattttcctgccccagcctcccgagtagctgggattacatgtgcacacctctatgcccagctaatttttgcatttttagtagagacggggtttcaccatgttggtcaggctgatctcgaacttccgacctcctgatccgcccatttcggcctcccaaagtgctgggattacaggcgtgagccgccatgcctggcaataaattttttgaaaagaagtggcttcttccttctcctggactaccaggcccttctgctcccattgaccacatgctattccttcctccagtcagcatggagtcctgggcactcacctattaggccttgggcccaggtccagaaaaacagatacacagggccaggcgcggtggctcacgcctgtaatcccagcaccttgggaggccgaggcaggtggatcacgaggtcaggagattgagaacacggggaaagcccatctctactaaaaatacaaaaaaaaaaaaaaaaaaaagcccaggcgtggtggctcacgcctgtaatcctagcactttgggaggccgaggcaggcagatcatgaggtcaggagatcgagaccatcctggctaacatggtgaaaccccgtctctactaaaaacacaaaaaattatctgggcgtggtggcgggtgcttgtggtcccagctactcgggaggttgaggcaggagaatggcatgaacccgggaggcggagtttgcagtgagcggagattgtgccactgcactccagcctgggagacagagcgagactccgtctcaaaaaaaaaaaaagaaaaaaagaaaaaattagccgggtgcagtggcgggcccctgtagtaccagctactcaggagactgaggcaggagaatggcatgaacccgggaggtggagcttgcagtgagccgagatcacgccactgcattccagcctgggtgacagagcgagactccgtctcaaaaaaaaaaaaaagaaaaaaaaaagaggtacacaggcaccacctgcccccaaggagctcacagcatcttgaagaggcaccaaggaaaacaccagacggtgttgagggtttgatgaggtgtgggggctcagaggaggggcctcgcagaagctgggggaggaaccagggatggaaggagttccccagtaggcaagaggacaaggaaaagaaagtgcctctgctggggcaggaaatgggcactggacacttatacccttcattggcaccatagagcagtactaacatgttctatttgataggagagaaaactgtggccctgggagaagtggcccatcactgggctaggaagctgggtaccaggaattggacctcatctagagcatgcaggtgaggctttgcctcaacctccctctgactacctgaagcctcatctcccacatccctcgcttcccacaatcagtgctgtgccacatcacaccccccactgtgcccaggctgttccctctgcctgtggtgcctttgccattccctcccactacactccccatgtccatcgtggcagggactcaatttatcatgctcccttaggtaagctgacaggaagatgcatgctggacccccttttttttttgagatagggtctggctctgtcacccaggctggagtatagtggtgtgatcatggctcagtgcagcctcaacctcctgtactcaagttatcctcccacttcagactctcaagcagctagaactacaggtgcacacctccatgcctggctaatttttgggaaaagaaaatttatagagacagtttgtctctatattacccaggctggtctgtaactcatggactcaagagattctcccacctcagcctcccaaagtactgggattacaggtgttagccaccacacctagcctggacccttttgagtgcaaaggcagcacccagcatctctgtgactcccccaaaagccctctgggtcagaactgctatcaaccccatttacagaggaaaaaactgaggctcaagctgttcctcagcttctcagtcatctggctggtcagaggctcaagcccaagtctgttcttggactgtgagggccagaccaagtcctgagggggcttagataacctaaaggactccctctttctttcctttctccctcccaccttccttcctttctatcctccttcttctctcttttccttccttctcctttccaccttccttctactccattctctgtgcttagtgaatgaagaaattaacacattacttggcccttgtcatcccctggctagattgcatgcttaacaaacatttgatgaaggactgtcctctgacctagagctatggccaaatgacagaacaaatggtcattgctactcgtgcctttgggaagtgggcaaagcctcaagtttcaggctgcagaggaaggagggtgattgaaatagatccagcccgggagcggtggctcatgcctgtaatctcagcactttgggaggctgaggtgggcagatcacctgaggtcaggagtttgagaccagcctggccaacgtggtgaaacctcgtctctgctaaaaatacaaaaactagccaggcgtggtggcatgcgcctgtaatcccagctacttgggaggctgaggcagaagaatcgcttgaatccaggagacagaagttacagtgagccaagattgcgccactgcactccagcctggatgatagaacgagactccatctcaaaaaaaaaaaaaaaaaaaaaatagatctaaagggaagagaaatggagatgctacaagacagaagatacgtctgtcctggcagcagtgtggagctgggaaacagagacgctgatagcagcaatggggatctcaggaagcagtgcctgcttgttcaaaggctcagggattacagtaacactcaggctgccagagccagagggcaagaccctgcaagcaccagttcagagcccagactcaggtcacacagacctgcccataagtccctgtgtgaccctggacagtttccttctctggagaggagagtgccaggctctctggctatggggaggattcagcgatgaggcttgtaaagtgcagatgggaaggggctgaccactcgctgcagaggcacatgagctggggagctgggccagggccaccagggcaggaagccagcccagtaggccagggggccccagccagagagctagaagctcgcaccatactaccctcctggcccaggaagatgtggaccagccaggcaggctgcagggcccaggaagagcagcacggtccctctccaggtatccagccccatccagtgctgggggatgaaaggaactccactggaactcagcgggttagggtctggccaggtgaccctccctctctgagctccagtcctccctgcaccctcaaacgagggtcatgataggacgggaaaatatcagtgcaagaagggatgtgagtgccctgagggtggtgggcatgggtgagggctggtacagatagccagactgcaggaggctgggggtttgcagctccagttcccactgcctgaaatcgcctcccagctcctctggcagccctcactccctctccttcagctctcagctcttgtgtttcctccttgcctcatgcaggaagcctgctctgatgcggctcttctccccatgagcaccacattcctcacccagagcactcgcccaagcgccaatgttactacattccattgttatttgtatttaacctttgcattctcccccaaactgagccctgaggaacccagtttgaaaaccattcatgtaatccatcactttcatttattgtttgtttgtttatttatttatttatttattttgagacagagtcttgctctgtcacccaggctggagtgcagtggcacaacctcagctcactgtaacctccacttcctaggttaaagcaattctcctgcctcagcctcccgagtagctgggattacaggcacctgccaccacgtccggctaatttttgtgttttttagtagagatggggtttcaccatgttagccaggctggtctcaatctcctgatctcaagtgatccacccaccttggcctcccaaactgctgagattagaggcgtgggccaccatgtccagcttcacttttatttcataggtgagaaagctggaccgggagagggtaggagcttggtgagcccatgctgggacacctgcctcccagtctgcagctcattctcatagatcatggactgtcaattccctaaggacagcagccacatctggcctgtctgcctctgtcttcttcagtcctgtatttactgagcacctatcatgtgccaggcactgttctagacatggaggagacagcaaagaacagacagaaaacacatagaaacaaaaataaaaaatatgcggctgggtgtggtggctcatgcctgtaatcccagccctctgggaggctgaggtgggaggatcactcgagattaagagtttgagaccagcccaggcaacatagggagaccctgtctctacaaaaaaaaaaaaaattaagtgttttttttttttttttttttgagacagagtctcactttgtcgccaggctggagtgcagtggtgctatcttggctcactgcaagctctgcctcccgggttcacgccattctcctccctcagcctcccaagtagctgggactacaggcgcccgccaccacacctggctattttttgtatttttagtagagacggggtttcaccgtgttagccaggatggtctcgatctcctgacctcgtgatccgcctgcctcggcctcccaaagtgctgggattacaggcgtaagccactgcgcccggccaaaaattaagtttttaataaataaaaataaaggatatggaatgaaaagctgggggagctactgtagcaatgggggatgggaagcttaaaccctcctgcaggctctcaggatggagcccattcccctcctcaaggccaggcaggctccacaaagcttggggctttggtagccgaacagaaatggagccaggccatgccggcaggagaaggatgtgaaccaggttgcccaggaacccagactccgtggcccaaaagtcatagactggggttgtagagagagggaaagtggaatacagagctggcgatgtggagccaactgagacgtaagggggacatattgccttctctccgggtcagggaagtcattatgtactgggatggtgtatgtgtgtgttgtgtgtgtgtgagcacacaatgggcaagaggtcctctaacccaggggttctcaaacttgtttcaaggagcataatgctttattaaaccaaaacacttcttcgaatctgataaatgacacttaagagtagatctgccggccgggtgctatggctcacacctgtaatcccagcactttggaaggccaaagagggtggatcacgaggtcaggagatcgagatcatcttggctggcacggtgaaaccccatctctactaaaaatacaaaaattagccgggctcggtggcgggcacctgtattcccagctactcgggaggctgaggcaggagaatggcataaacccgtgaggcggaggttgcagtgagccaagattgcaccactgcactccagcctgggtgacagagcgagactctgtctcaaaaaaaaaaaagagtagatctgcccattgaagcaagtatgggcactgtctctccccatccgcttcctgcatacctcctcccaacaggcctatggtatttctgtttaatttatttttatttattattattgtttttattttggggggttgggtttttcgtttttttggttgtttgaaacagagtctggctctttcgtccaggtggaagtggagtggcacaatctcagtccactgtaacctctgcctcccaggctcaaggtatccttccatctcagcctcccaaatagctgggactacaggcgtgcaccaccatgccaggctaaattttgtaatttttttatagagatgcagccttgccatgttgtctaggctggtcttgaactcctgagctcaagtgatctgcccgtctcagcctcccatagtggtggaattacaggcatgagccgtcacatctggcctgttgttaatttttttttcttttttttttgactcagactctcactctgttgcccaggctggagtgcaatggcgtgatctcagctcactgcaacctccacctcctgagttcaagcaattctcctgcctcagcctcccgagtagctgggattacaggcacctgccaccatgcccagctaatttttgtatttttagtagagacagggtttcaccatattggccaggctgggctcgaactcctgacctcgtgatctgcccacctcggcctccttactgggattataggcatgggccactgcgcccagcctattaatttttttattggccaggtgtggtggctcatgcctgtaatctcagtactttgggaggccgaggcaggtggattgctcgaggtcaggagtttaagaccagcctgggcaacatggtaagaccctatctctacaaaaaaaaaaaaatacaaaaaaaaaaaagaaaaaagaaaagaaaaattagccgggcatggtggtgctagcctgtagtcacagctactcgggaggctgaagtgagaggattgcttaagtccaggaggcgaacgttgcagtatgccgagatcacgccactgcactccagcctggatgacagagcaagaccctgtctccaaaaaataaatgataaaacaattttaaaatttattttattttactttttttttagagatggagtctctttgtagcccaggctggagtgcagtggcatgatcattgctcactgcagctttgaattcttgggctcaaactattctcccacttcagcctcctaagtagctggggctacaggcacacgccactatgcctggcctttttttgtttgttttagaaacagggtgtcactatgtctcccaggcaggagtgcggtgactcactcatggctcatttcagtcttgacgtcccaggctcaagcaatcttcccacctcagcctcccaagtctctaggagtacaggcatgcaccaccatgcccagttaatttttgtgttttttgtagaggtgggtgtcatgttgcccaggctggtctcaaacttcagagctcaagtactccacccatccccgcctcccaaagggctgggtatacaggcttaagacaccattctgggccacaattattttatttctctttgagatggagtctctctctgttgcccaggctggagtgcaatggcacgatctcagcccactgtaacctccacctcctgggttcaagtgattctcctgcctcagcctcccgagtagctgggattacaggcgtgtgccaccatgcctggctaatttttgtatttttaatagagacagggtttcaccatgttggccaggctggtcttgaactcctgatctcaagtgatccacccaccttggcctcctaaagtgctgggattacaggcatgagtcacagcgcccagcctacaaaaaaaaaattttttttttttgagatggagtcttgcactgtcacccaggctagagtgcaatggcatgatctcggctcactgcaacctctgcctcgcgggttcaagcgattctcctgcctcagcctcccgagtagctgggattaggcgtgcatgcgccacaatgcttagctaatttttgcatttttagtagagacgggttttcaccatgttagccaggcgggtcccgaactcctgacctcaggtgacctgcccgccttggccccccaaagtgctgggattacagacatgagccaccgagcccggccaacctgctccttttctaacctgggccagttcacctctccttagacaagctggtggtttcctgctcccaggaagtcaccaatttatgccaaatttagtgcagacaccccatcagtatagtacattacaatccagaagtcctggatccaagcaagcctcctgcctcagcctcccaagtagctgggagtataggtgtgtgcccagcagttctatatttccaaggaaccctggagccctaaagaacccagtttgaaaccaccactttcaggctgggcatggtggctcatgcctgtaatcccagcactttgggaggctgaggcctgtggatcacttgaggtcaggagttcaagaccagcctggccaacatggcgaaacctcgtctctactaaaactatgaaaatcagctaggcatggtggcaggtgtttgtaatcccagctatttgagaggctgaggcaggagaatcacgtgaacccaggaggtgaagattgcagtgaaccgagatcatgccactgcactccagcgtgggtgacagagtgagactccatctcaaagaaaaaaaaaagaaaccatctctttcatttaataggtgagaaagttgaacctggagaaggcagcagcatggtgagctcatgcagggactcctgcctccctgcaactcattctcatatgtcctgggcaccagtgatgtgctaagtcacatgcagggatgcaatagggacaagggaaaacatggcttctgctctccccaagatcagagttgatgggggtgacaggcaggtcactggacaatcactgcacaacatgatgagaacagggatggcagaaacccagccctggggaagcctggctttgctcatccactcaaccaacattcccgaatgcttttgacatactttggggcagctgctggatggtaaccgtggggttcccagagacccatccaccccagtgtcctttttcttggtgacagcctactctctttttttaattttaattttaatttttatttttgagatggagtcttgctctgtcgcccaggctggagtgcagtggcgggatctcggcccactgcaagctccacctcctgagttcatgtcattctcctgcctcggcctcccaaataagtgagactacaggtgcccgccaccacgcctggctaatggctaattttttgtatttttagtagagacggggtttcaccatgttagccaggatggactctatctcctgacctcgtgatacgcctgccttggcctcccaaagtgctgggattacaggagtgagccaccgcaccaggctttttttttttttttttttgagacagtcttgctttgttgcccaggctggagtgcagtggtgccatcacagctcattgcgactttgacctcaccttgcaggctcaagcaatcatttcatctcagctggaaatgcagactgggtctcgctcactctgttgcccaggctagtctcaaactcccgggcttaagtgaccctcccatctcagcctcctgggtagctggcactacaggcatgcaccagcacgcccagctaaaattttttttgtagagacagggtctctctatgatgctcaggcaggtcttgagttcctgggctcaagtgatcctcccaccctggtcacccaaagggctgggattacaggtctgtgccaccatgcccggcccagcctgccctcctgacctgacagttgaggccctactggagactgcagcagggcatccaggctgtgaaaccccacccaccagctctgcctcagttgcccatgtgccctggcaagccagtggctctcactgagcctcaggttctcttccgtaaaacagggctgtgatgaagattctctcaagatagtcctccctgtggctaccatgtccaggagcccagcaccagttcaaggctaaggccatccctgcatctcacctccccttcctctcacatacacactacatctgcctcacctctcataaagaacatctgggctgggcacggtggctcacgcctgtaatcccaccattttgggaggccaaagtgggcggatcacaaggtcaggagatcgaaatcatcctggccaacatgatgaaaccctgtctctattaaaaatacaaaaattagctgggcgtggtggcgcatgcctgtaatcccagctactcaggaggctgaggcaggagaatcacttgaacgagggagtcggaggttgcagtgagccgaaatcgtgccactgcatgccagcctggtgacagagcaaaactctgtctcaaaaataaaataaaataaaataaaataaaataaaataaaataaagggccatgcgcggtggctcacgcctgtaatcccagcactttgtgaggccgaggcgggcagatcaacagggtcaggagatcaagaccatcctggttaacatggtgaaaccccatctctactgaaaatacaaaaaaaattagccaggcgtggtggcgggcacctgtagtcccagctacttgagaggctgaggcaggagaatggcgtgaactcaggaggcggagcttgcagtgagcagagattgcgccactgcattccagcctgggcgacagagcgagactccatctcaaaaaaaaaaaaaaaaaaaaagaacatctggagccataattcccgatgttcttgttacttgacactgcctaaaggcatgttctgtgggttccggggaaactgatttgaaaaacttgagtgttgtaaaggagggccataagctgagtgaacacagcagttgtgagaggtcccaggtgcttcctggggacagggagacacgacagaccaagaagcaaaggggcctctgatgtgacttcaatatcaaggtcttgtcgggcacagtggctcatgcctgtaatcgcagcactttaagaggccgaggcgggtggatcacttgaggtcagaagttcaagaccatcctggccaacatactgaaaccctgtctctactaaaaagtacaaaaaattagctgggcatggtggctcaagcctgtaatcccagctacttgggaggctgaggcaggagaatctcttgaacgtggaaggtagaggttgcaatgagccaagattgcgccactgcactccagcctggcgacagagtgaggccccatctcaaaaaacaaaatcaatgtctcgatgcagactgccaggtatcaggtgtccatccatgtctccaaaaagccacttggcaccaggagcagacaggaagggcaaagaggagccagactgaagcagggcttcttagctcccaagccacacaggtggccaccagtcagagaggcagtgtgtgtgtgtgtgtgtgtgtgtgtgtgtgtgtgtgtgtgtgtgtgtatttcttcagttcagtgtgtgtatgtatgtttcttctgcagctcagtgtatgtgtgtattccttcagctcagtatgtgtgtgtgtgtatgtttcttctgcagctgtgtgtgtgtgtgtgtgtgtgtttcttctgcagctcaggatgcctccaacatttctgctgaagcctcaccctcactcctggcccatcctgaggcctctacctaagatgccaatgagtagcccagacactggggctccagtgtttgtcaccaggtggtacctggatgtgggaggtagacaggccagatggccagtttgggcagtgcccccatgcctatctggccctgggtccctatgccaccttgctggggagggtcttttcgcttacacctcctctgagccgactctgcgcagtaacacaaatgtgtatcaggcacatcctttcctcaaaaggtggatgaccagttgggtgatcagggctgttagggggctgaagggtcctggggagtccaggtctagccaagttgaggcctatcctgctgcattttccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcatcatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgcgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatagaaaaaacatattttagaagttgaagcacaaccaaggaaacatgagcctggctttcctccctctcacttctgcgcactgggtccgcaagggctacagaaatgttttcctggctgaggaagggagggtgcacccttctgctttttttttcctggctgcagtctattcccagaacacattccatcacatggttcccagaactcagattgtgcggtggccacgtcatcattggctggggctcacagtcacagcagcagaggcctccctaaacctccctctcctctagccccacccgctgtcccctgctcctcatgcccccatgctgtgtcccctggcctcacttccgttgccatgttttcataatcctctcaggctctgggcagcagcgctgcccacagtaggaccagatcatgtaaggaaaatactgcaggctcatcttggggctgcactggggacctgagaacaccttatcctactgtacctgcggcacctcatctgacaccagcttctctgctttgcccaaggtccctaggccctgaatgcttactttttaaggtcagcctggctcaggatatgctagtttggctgcagagggtcctactaagagccaggactgaggagcaaggcccaaaaaactcctctgggccacatcttccccgagggcatccccgcagggaggccgtgtgctgctgagccctttgctaggagtgggtagtcagtgtctcccacatgacgatcttgcttcattcagatagctttcgtagctcactgcttttctgagtcacttcctgtgagggatcaccttgggatggcatttcttttccttttttttttttctttggagacagagtctcgcactgtcacccaggctggagtgcaatggcacaatctcggctcaccacaacctccgtctcccgggttcacacaattatcctgccttagcctcccgagtagctgggattacaggtgcacaccactacacctggctaattttttgtatttttagtagagacagtgtttcactatgttggccagactagtctcaaactcctgacctcgtgatccgcccgcctcagcctcccaaagtgctgggattacaggcgtgagccactgcgtccggccttcttttccgtttttttttttttttttttttttgagatggagtcttgctctgttgcccaggctggagtgcagtggtgcaatctcagttcactgcaagctctgcctcccgggttcacgccattctcctgcctcagcctcctgagtagctgggactacaggcgcccgccaccacgcctggctaattttttgtatttttactagagacggggtttcactgtgttagctaggatggtctcaatctcctgacctcatgatctgcccacctcagcctcccaaagtgctgggattacaagcatgagccaccacgcccggacctttcctttttttgagacagagtcttggtctgttgcccaggctggagggcagtggcacaatcacagctcactgtagtcttgagcttcagggctcaaatgattctctcacctcagcctcccaagtagctgggactacagatgtgcaccaccacacctggctaatttggtgtgtgtgtagaagcaggggtctcactgtgttgcccaggctggtctcaaactcctgggctcaagcaatctgcctgcctcaacctcccaaagtgctgggattacaggcctgagccaccacacctgatgcctggctaatttttaaattttttggtagagatggggtcccactatgttgcccaggctggtctggaactcctgcgctcaagtgattctcctgccttggcctcccgaagtgctgggattacaggcctgagccactgcacacagagggcatttctttatttgccccattttgcagaagagcttcctgaggctcagagaggcccctcatctaaggtcacatcatggctcaaagtcacctcctccatagactccccaggctgcccctctgggagggcgggaatgaggggtggtctttatccttctctccctctctttgatacccttttgtttccccacgtccaacaacactgtcagaggaaagacacttccagaatacccaggtaaaaaaaaaaaagagacaataaggaaaggacactgccttctccggtgtcatcagaaatgattgaaagaggccgggcgcggtggctcacgcctgtaatcccagcactttgggaggccaaggtgggcagatcacgaggtcaggagatcgagaccatcctggctaacacggtgaaaccccgtctctactaaaaatacaaaaaaattagctgggcgtggtggcgggcgcctgtagtcccagctactcaggaggctgaggcaggagaatggcatgaacccgggaggtggagcttgcagtgagccgagactgcaccactgcactccagcctgggtgacagagcgagactccgtctcaaaaaaaaattaaaaaataaataaataaataggccgggtgccatggctcacacctgtaatcccagcactttgggaggctgaggcaggcggatcacaaggtcaggagttcaagaccagcctgaccaatacagtgaaacactgtctctactaaaaatacaaaaaaattagctggacgtggtgacatgcacctgtagccccagctacttgggaggctaagcagaagaatcacttgaacccgggaggcagaggttgcagtgagccaagatagcgccactgcaccccagcctgggcgacagagaaagactccatctaaaaaataaataaataaatcacattaaaaataaacttaattttttttaaaatttaagtttaaaaaagtaggccaggtgcggtggctcacgcctgtaatcccagaactttgggaggccgaggttggtggatcacgaggtcaggagttcaagaccagcctgaccaacatggtgaaaccccatccctactaaaaatacaaaaattagctgggtgtggttgtgggtgcctgtaatcccagctactcggaaggctgaaacagagaattgcttgaaccctggaggtagaggttgcagtgagccaagaatgcgccactgcactccaggctggtgacagagcgagactccgtctcaaaaaaaataaaaataaaaaatcactgggcatggtggcccgcgcctatagtcccagctactccggaggctgaggcaggagaaatgcttgaacccaggaggtggagcttgcagtgagccgagatcgtgccactgcactccagcctgggcgacagagcgagactccatctcaaaaaaagaaaaggaaggaaggaaggaaggaaggaaagaaggaaggaaggaagattaaatgtcaatggctcatacttgtaatctcagcactttgggaggcgaggcaagtggatcgcttgagcacaggaattcaagaccagcctgggcaacatgttgaaaccccgtatctactaaaaatacaaaaattggcctgatatggtggttcacacctatggtcccaactactcgagaaggtgaggtgggagaatcgcttgagcctgggaagcagtggtttcagtgagccaagattgagctactgcactccagcctgggtgacagagtgagaccctgtctcaaaagaaaaataaaataaaataaatgacaatgtaaaggcaaattttgtctataacaacatcataataggacattgaattattacagtgcagttgttataattaagtttacaatagaatattcatggctgaaacccagacaaactaaaatcaccaactgcttacaaaccaactgcttactagtgaaaacccaaataggtaaggcttttttttagcagtgagtctctgctcagtgaggacctgggcaccctcgtttttttgagtcttggtatttctttccatctgaaaggatggagcggatgtgtggatccccaacgttttcagttcttccacctggtcctcattctgtcatggcgtgatcatggctcactgcagcctcaacctccagggctcaaaccatccttcccgctcagcctcctgagtatctggaggcatgcgccaccacacccagctaattaatgtgtgtgtgtgtgtgtgtgtgtgtgtgtgtgtgtgtgtgtgtgtgtgtgtgtgtgtagagatgaggaattctcgctatgttgcctagcttggctccaactcctggcctgaagccatcctcctgcctctgcctcccatggaatagttgatttttgttgttgttgttgttttgagatggagtctcactctgtcactcaggctgtggtgcagtggttcgatcttggctcactgcagcctcctgggttcaagcgattctcctgcctcagcctcctgagtagctgggcctgcaggtgcatgccaccatgcccagctaattttttttttctttttttttgagacagagtctcactctgtcacccaagctggagtacagtagtgtgatctcggctcattgcaacctccgcctcctggtgcaagtgattctcatgtctcagcctcccaagtagctgggattacaggcatgcaccaccatacccagctaattttttgtattttagaagagacggtgtttcgctatgttggccagactggtctcgaactcctgacctcagatgatctacccgccttgctccaaaactgctgggatttcaggtaggagccactgcacccggcctatggaatagttttcaatgccttgtctagctagggatcattgaacatgttgtatgcggggtagactgcagctgcaggatctgtaccagggtgttggtgaagacgcaatggggttgccccagcgtccttgagaaagactaccaccttgtggccgggcgcggtggctcatgcctgtaatcccagcactttgggaggctgaagcaggtggatcacgaggtcaggagttcgagaccagcctggccaagatggtaaaaccccgtctcttccaaaaatattttaaaaattatctgggtgtggtggctcgcgcctgtaatcccagctactcaggaggctgaggcagagaattgcttgaacccgggaggcagaggttgcaatgagtcgagatcatgccactgcactccagcctaggagacagagtgagactctgtctcagaaaaaaaaaaaaaagcaaaaacctaccaccttgcacttcgttcaacagagtgtccagttgctccacagagcctgcactccacagtctgccgccacccgtgccacactcacagcaaagcagagttcccactgctcagcccagggacctgctcaatcctgctcgctcactggagcccttgacggactgggacctcggctggcaggtctttggcttccttcccttagcataatgtccttgagcttcatccatgttgcagcatgtgtcagaatttccttcctttcatgaataattgtttaaggccagggtggtggcacaagcctgtagttccagcactttggaaggccaaggtggatggatcgcttgagccaaggagttggagaccagcatgggtaacatggcaaaacctcatctctattattattatttttatttttattttattttattttattattattttttgaggtggagtttcgctctgtcgcccaggctggagtgcaatggcacgatcttggctcactgcaagctccgcctaccgggttcacgccattgtcctgcctcagcctcccaagtagctgggactacaggcgcccaccagcacacccggctaattttttgtatttttagtagagacagggtttcaccatgttagccagtatggtctcgatctcctgaccttgtgatctgcccgcctcggcctcccaaagtgctgggattacaggtgtgagccaccgtgcccggcctattattattattttgagacagagtcttgctctgtcacccaggctggagtgcagtagtatcatcttggctcactgcaacctccgcctcccaggttcaagtgattctcctgcctcagcctcccaagtagccaggattattggccgcccgccgcaatgcctggctaatttttttgtatttttagtacagacagggtttcaccatgttggccaggatgctctctaactcctgaactcaggtgatctgcctgccttggcctcccaaagtgttgggattacaggcgtgagccactgcacctggccttcatctattttatttattttattttattttattttttattttattttattttattttattttattttattttatttattttattttattttattttttgagacagggtcttgctctgtctcccaggctggagtgcagtggcgctatcttggctcactgcagtctccgcctcccgggttcaagcgattctcttgcttcagcctctcgagtagctggaactagaggcatgcgtcaccatgcccagctcaggtttgtatttttagtagaggcagggtttcaccatgttgcccagactggtctcgaactcctcacctcaagtgatccacccaccttggcctcccaaagtgctgagattacaggtgtgagccaccacacccggcctcatctctattattttaaaaaacatattttttggccgggtgcagcggctcacacctatagttccagcactttgggaggccgaggcgggtggatcacaaggttaggagttccagaccagcttggccaatacggtgaaaccctgtctctactaaaaatacaaaaattagctgggcgtggtggcgcgtgcctgtagtcccagctacttgggaggctgaggcagaagaatcacttgaacccaggaggcggaggttgcagtgagctgacatcatgccactgcactccagcctgggcgacagagtgagactctgtctcaaaaaaaatcccatattttttaattgtttaaaattattattaatatttatttattttatttatttttttttttgatggagtctcgcactgtcacccgggctggagtgcaatggcgtaatctcggctcactgcaacctccgcctcatgggttcaagtgattctcctgcctcagcctcccaagtagctgggattacaggtgcccgccaccacgcctggctaatttttttctatttttagtagcgacgaggtctcactatgttggccaggctggtcttgaactcctgacatcatgatccgcccacctcggcctctcaaagtgctgggattacaggcatgagccactgcacctggcctattatttttttcttgtttttttatttccatatttttttttcttcttcttcttactttttaaaagttttatttatttatttatttattttttgagacagtttcactctgtcacccaggctggagtacagtggggtgatcttggctcactgcaacctccgcctcccaggttcaagccattctcctgcctcagcctctcgagtagctgggattacaggtgcccaccaccatgctcggctaattttttgtgtttttagtggagattgggtttcaccatgttggccaggctggtctcgaacttctgacctcaagtgatccaccccgcccccaccttggcctcccaaagtgctaggattacaggcgtgagccactgcacccggcctatttcttttttatttttatttttatttttatttttatttttattttttggagatggagtttcactcttgttgcctgggctggagtgcaacggcacaatctcagcttactgcaacctcaccttgcgggttcaagcgattctcctgccttagcctcccgagtagctgggattacaggcacacaccaccgcgcccagctaattttgtatttttagcagacatggggtttctccatgttggccagactggtatcgaactcccgacctcaggtgatccgcccgccttggcctcccaaagtgctgggattataggcgtgagccatcgcgcctagccaattattattttttaagagactggggtctcactatatttaccaggatggtctcaaactcctggcctcaagagatccttccgcctcagcctcccaaagtgctgggattacaagcatgagccattacgccaggtctttatctaggtttttctattgtctgtatttcatcatccaaccatcccctaccagagtgtgcctggccaattttcttcccttcttccaccacacgtttctttttgtttgtttgtttgtttgtttgagacagtgtctcactctgtcacccgggctggagtgcagtggcatgatcttggctcactgcaacctccacctcctaggttcaagcgattctcatgccttggcctccagagtagctgggattataggcatgtgccaccacacctggctaacttttgtattttcagtagagagggggtttccccatgctgtctgtgctggtttccaactcctggcttcaagtgattcgcctgcctcagtctcccaaagcgctgggattataggtgtgagccaccacacctggcctccttcctttttaaggctgaataatagtccattgtgtgtatgtaatgcattttgtttatccattcatctgtcaatggatactttggtcgtttctaccttttagctattgtgaataatactgctgctctcctttacactttttcaaagcactagatccctgatgagcccacagcctagaaatggagtctgagcacagtaagccacaagacagctgcttctgccgagaggacagcctgggaccttttgggtcaggggcaagagacttggaggttggcaggctgctctctgactgagaagtggggacaagtatggttcccacacactagggaagcaatgacagactagcaagagaatagaaactttaattcatgcactctcaggccaggcatggtggtgcagacctgtaatcccagcactttggaaggccaaagtgagccactgtgccctgttgtgttttgatttttgagacagaatctggctgtcacccaggctggaatgcagtagcacgatcatagcctcaacttcctgggctcaagtgatcctctcacctcagcctcctgagtaactgggactacaggtgcatgtcaccacacctagctaatttttcttttttttgaaacatagtcttgctctgtcacacaggctggagtgcagtagcacgatctaggctcactgcaacctctgtctcccaggctcaagcaattctcttgcttcagcctcccgagtagctgggattacaggcatgcgccaccacgcccagctaatttttgtatttttagtagagacgaggtttcaccatgttggccagggtggtctcaaactcctgacctcgggtaatctgcccactttggcctccctaagtgttaggattacaggcatgagccaccatgcctggcaatttttttgtacagatggaattttgccatgttgcccaagctggtctcaaattcctaggctcaagcaattcacctaccttggcctccctacaggcatgagccactgagcctagcctccagctaatttttacattttttgtaaagacagggtcttgctatgttgcccaggctgatctcaaacacctggcctcaagagatcctcctgcttggcctttcaaagcacttggattattggtgtgagccaccacttcccacctagcctgttccatcactttttacttaatttcacaactttccctgaccgttgcctcaaatcagctttttttctgacagctgcgttgtagtctttgtcagagttatgaggggcacccccactcttcactccagcccccacctgttttattttcctccataaccctcatcaccccccagcatgttacctaggtttttatcttttttttttttttttttaattaagacaaggtctcggccaggctcagtggctcacgcctgtaatcctagcactttgggaagccgaggcgggtggatcacgaggtcagcagatcgagaccatcctggctaacacagtgaaaccccgtctctactaaaaatacaaaaaaattagccaggcgtggtagcgggcgcctgtagtcccagctactcaggaggctgaggggcgcctatagtcccagctactcgggaggctgaggcaggagaatagcatgaatccgggaggcggagcttgcagtgagccgatcgcgccactgcactccagcctggatgacacagtgagactccgtctcaaaaaaaaaaaaaaaaaaaaaagacaaggtctcactctgtcacccaggctacagtatggagtacagtggcgcaaccacagctcactgctcactgcggccttgacttcctgggctgtcgatcctcccacctaaacctcccaagtagctgggactgtaggcatgagccaacatgcctggctaatttttgtattttccgtagagacagggtttcgttcaagccactgcacctgatcgtgtgttttgggcaactctgggagcagtggcacaggaaagaagaaagggactggggacaggtgccaacccatcagctggtgtggacctcctccccctgggagggttacaagtccagggaggaggacctcatgctgccgccagggggcagcctaggtgcacttaagggtcattctccaggggctgcacacctggcagagctgcctgggccacacctgcctgcccagtgtaagggggaataggaaatactgtatctttttgaccaagcaggcctggaatccacaccccacccgaccagccccattctctccctcccttctccccagagcaccctaggcagcccaccccccacataaccgagaggggctgtccttccaggggagcagggaccagtgtcaggcccggtcattctgacacccacccacagaaagatctccttcttcacccctctggcagccctgctcccctaaatcctcaacttcagaggccatgggcagttttaaagaagcataaggctggagaggcagggccacagagccactgggctccagaacccagtcactggatccaaatgccagcctgctcacagacagctgcaaggcctctctgagcctcatgttcccagactgtggcagaactggttttgttttgagcaggtcaggtgtgcagaacacttggcctggtgtcaggaccccgagaaagacccagacagctgatgagaaggggggcgtcatggcttgtgcctgcaatcccagctacggcggaggcagagaggggaggatcacttgcgaccaggagttcgagacaagcctaggcaacatggtgagactctgtctctacaaaaaaaatttaaaacaggccgggcacggtggctcacgcctgtaatcccggcactttgggaggccgaggcgggtggatcaccaagtcaggagatggagaccatcctggccaacacggtgaaaccccgtctctactaaaaatacaaaaaattagcggggtgtggtggcacgcacctatactcccagctactcaggaggctgaggcaggagaattgcttgaacccgggaagcagaggttgcagtgagctgagatcgcaccactgcactccagcctgggcgacagagcgagactgtgtctcaaaaaaaaaaagaaaaaagaaaaaaaaagaaagctgatgagggcacaggtcgggggtgggggcaagggagcacagttctaagccccagcttggctccccgtgcagagccctgagaatctggagactttcagcagaagggaaggccgcacaggtctagcaagttggcaggctgctggggggtaggggtgggctgggaaggaggtggatgcctggctgtggcctgcaccaggccccttccctgactgactgcacgacctggaggcccaaaacctgtccagtccagacctgcccaggaggggaacgagcggggatgggcagcccagccggcccgaaggcagaggagcctaacgagtgggcgaaggggcggtgtccggagagttctggtgcaagggtcactaagcctgtccaggccccatccacccctgcccaggcgcctctggcccatctgccccctccacctctagctgacctgccccctctcgctcactgcggctatggattttgaaagcatgaggctaactgatcaatttcagagtcattgtaaaaaatctggagaagatttcacaagaacacgatatgaaagatacgactttttaaaagctcagagatatctctgcagcctattttaagctcattccaccttctggtcacaccctactctccctgtctcactactggggtggttgaatttggaggctgggtggggtgtgcaggaggtcaggtgttccatctgaggcggaacaagatgggccaactctagtcttgtgaaacaaagcacattgccaggtggagctggctccaggaacctaggcacagagggttccacacacggtggcattgctgacaccgcagccggccgcacaggtcctgccagcctccaggctcagccccacctgtccctgtcttcggtgctgggtggggtctataatgggttgttcccccaggctggaatgctctgtttggaagatctcctaaacatcccccgcccacagggcccatccaccctccccataaagccctagccctcactatctatatctgatatccacaggcttctgtgccgtctttttgccctttcacggggtccctagaagccccagtaaatcctcctgtcactgacggcctggctggttgtacctaccttggtggaactccaggacctgggcctcagtcttagggttgccacggtgcacagcctcttggtcagggtgctttgggtcgaaggtgccctcctgagggcaaagtaccttcctgcccagcctgagaatggagtgggggctgaatgtgaaccctggcccactcacttctcagttgagagacctcaggcagttcctttgttttttgactttcagcctcaatttcctcttccctaaaattggccttccagctgccctgtgcctacagccagctcactcccaggtatcctttgaaagcaccctccaccacctcttgcaggcagccttccccattctcccctcccttacaggatttagctacccctcccacgtgctcggacagcccttaggcataatcccaaaacgcacccaggaattactcattcatcctgctacctctcccttcagactgtcttactccaccctgcaccctgaatgcaggtacctggacctggcatggaccaggcaacgggatctgtggactaacccatttccaacttaggaaaggcaccaaccagctcgtgaatgagaagcactagactgaggctctcagcggccatacttcccctggaaaactgacctttcctgagctcacatattgctcagcacagcatacccagctagtttaattatttcccccttttacatagggaataactcagatttggagaggggtgtggtcatttagcaggttgggggcagagctgggggcccgaacccaggtgtgtccctttgaccaatgcccttatctgtaggattccttcccccaccctggggcaggacctgggtctagggaggaggccagagggagagataggaattcaaattggtggtgctggtggtgggggaaggcgaggccctgggagtggccagcactcagggcttgggcaacagggtgctctgcagagccactgggtggggggaacagcaggggcaggcacagacctgctgagtcagagacgccgcagggactccagggggaggtgtttggcagatggctgtgggctggggcccggcaaaagcaccacagggtggtgggtcaaggagtagaattgggtgctgaggccctagccaggaccaggggatgtaagaaggaggaggccttggagagggcagggggcaacgttttccagaaggagggagtggtcagtctccacaaggtcaggcgagataagcgctactgcacccagcctccctcatgactgtgaccagaggctgttgccccagctcaggggcttcctagcatcttggccatgagggatatgtgtagcccccgccccaccccccgccatctgaggccctgctgggccctggtgatggaggaaggctccccagagaaaactaggaagataaagtttgcaaattccatgccattaggccttggtccactcccaccctcttttttattattattattattattttattatttgtttgtttttttttttgagatggagtttcgctcttgttgcccaggctgcagtgcaatggtgtgatctcagctcactgcaacctctgcctcccaggttcgagagattctcccaggttagcctcccaagcagctgggattacaggcgcctgccaccacgcccgactaatttttgtacttctgtagagacagagtttcaccatgttggccaggctggtctcgaactcctgacctcgagtgatctgcctgcctcggcctcctagagtgctgggattacaggcgtgagccaccacgccaggccctctttttattttagacacagggtttcactctgttgcccaggttggagtacagtggtgctatcatagctcacttcagcctcaacctctccaggctcaagcaatcctcccacctcagcctcccaagtagctgggactacaggtgccaccaccacgcctggctaattttttaaaaagttttttgtagaaacagggtcttgctatgttgcctaggctgttctggacctcctgactctgtctcccaaagtgttgggattacaggtatgagttcattgcacacagcccatccctttcactacaggaggcaagccagagccccaaagaggttcttggtgcctcaagaaccctgttcctcagcccagattgaggaggggatgtgttttctccactcctgccccacctccaaactgctagagaggaacctcagcagggaaatgaagcattgcttcaccttgcctctacctctggccctggggtaccctctctgtccacttgacccccactcctccaaccactgaggctgtgctgaccttctgcctgctccatcctgtaactacctcacattcacacaacccaatgaagtagatatggctctgagttccatttcacaggtatgaaaactgaggtccatagaagtcagttctagggcgtctggcctagtggcacagccaggacttttttttttttttgagaccaagtctcgctctgtcaccacactggagtgtagtggcacgatctcagcgcactgcaacctctgcctcccgggttcaagtgattcttctgcctcagcctccggagtagctgggattacaggtacgcgccaccgtgcccgcctcggcctctgaaagtggtagggtcataggcgtgagccactgagttcggcatttttttttttttttatttttggacttttttttttggagactgagtctctgtcacccaggctggagtgcaatggtgcgatcttggctcaccgcaacctctgcctcccagtttcaagtgattctcttgcctcagcctcccgagtagctgggattacaggcatgtgccaccacgccaggctaattttgtatatatatgtatattttttttttagtagagatggggtttcaccatattggtcaggctggtctccaactcccgaactcaggtgatccgcccacctcggcctcctaaagtgctgggattacaggcgtgagccaccgcgcccggccggatttggttcctggttcgactatctccccatgggtttcaccgagaaacagccctgctggcccttgtctccacctatcacagaagaacaactgggtcccctcctttacccatcctggggccactgtatcctacacacagaccccagaagacagaccctgccagtctaatggtggagacaactctgagatcaaatggcacgtggcagattgatcaggagcaggagacccaggacctgggagagacagagcactgaattcacaaactaccccaagcagagggcaagcaaagctccctaagaaagtggagccaggccagacacggtggctcacgtctataaccccaacactttgggaggccgaggccggtggatcatgaggtcaagagttcaggaccggcctggccaagatggtgaaaccgtgtctctactgaaaatacaaaaattaggccgagcacggtggctcacgcctgtaatctcagcactttgggaggccgaggccagcggatcacgaggtcaggagattgagaccatcctggctaacacggtgaaaccccgtctctactaaaaatacaaaaaattagccgggcatggtggcggacacctgtagtcccagctactcgggaggctgaggcaggagaatggcgtgaacctgagaggtggagcttgcagtgagccgagattgcgccactgcactccagcctgggtgacagagcaagactccatctcaaaaaaaaaaaaaaatacaaaaattagcttggcatggtggtaggtacctgtaatccagctactgaggaggttgaggcagagaatcacttgaacccaggaggcagaggttgcagtgagccgagatggcaccactgcactccagcctgggcgacagagcgagactctgtctcaaaaaaaaaaaaaaatagctgggcatagtggtgcacacctgtagtcccagctgcttgggagactgaggcaggaggatcccttgagcccatgagtttgaggctgcagtgagttatgattacaccactgcactccagcctggatgacagagtgagaccctgtctctaagaaacagataaaaatacaaataaaaaagaaagagcatggccaggtgcggtggctcaagcctgtaatcccagcgctttgggaggccgaggctggtagatcacgaagtcaggagtttaagaccagtctggccaagatggtgaaaccctgtctctactaaaaacacaaaaatgagccgggtgtggtggtgggcgcctgtaatctcagctactcgggaggcttgaggcagagaattgcttgaacccaggaggccaaggttgcaatgagccaagattgcgccattgcactccagcctgggggcgacagagtgagaatctgtctcaacaaaaaagaaaaagaggccaggcgtggtggctcaagcctgtaatcccagcactttggaaggccgaggcgggcggatcacaaggtcaggagatcaagaccatcctggctaacagggtgaaaccccgtctctactaaaaatacaaaaaattagccaggcgtggtggcgggcgcctgtagtcccagctactcgggaggctgaggtgggagaatggcgtgaacccgggaggcggagctggcagtgagccgaaatcgcgccactgcactccagcctgggggacagagcgagactccaaaaaaaaagtggccgggcgtggtggctcacgcctgtaatcccagcactttgggaggccaaggggagttgatccggaggtcaagagattgagaccatcctggccaacaaatatggtgaaaccccgtctctactaaaaatacacaaattagctgggcgtagtggtgcacacctgtagtcccagctactcaggaggctgagacaggagaattacttgaactcaggaggcggaggttgctgtgagccaagatggtgccactgcactccagcctgggtgacaaagcgagactctgtctcaaaaaaaaaaagagcagccagagaaaaccacactaggagtgaccttagagcaggcactgaagaacagcaaggcatggcaggcagagggcatggcaagggcacggccccttccttggctcctcagaccagggaagtcagttcccctcttatgaccagacaaagcagcctgcacctttttgcccagccccagcacccttgtgagtattctgtcgtcttctccttagtctgtgggcttctgaggccagggaacacatctgtgctgttcactagcccagtgcccacctcatcattgctgtcagcatctgttggttgaatgacagttccatgagtggcctcccttgggctcaaggtgcctggctctgctaggggtgaaggagtggtgacttgacagggaggtgtgtggtgaggagcggggcacccatcacaggcctggcctttgctatagggaataggcttgctggggatgcattcttcagatggtgttcctaagagggtgaactgagctcatgtcagtctgaggggctggagtctgaggttagctacggaccttgggcaggtgacttaacctctctaaccttggttttctactgggtcttgccctgtcatcatggctaggctgcagtgatgcaatctcagctcactgcagccttgacctcctgagctcaagctattctcccacctcaccctcctgagtagctgggacttcaagcactcaccaccatgggcctggcttttttcttttttgtatttgtagagacagggtttcgccatgttgcccaggctggtctgtaactccagggctcagctgacccacccacctcagccttccaaagtgctaggattacaggcatgagccaccacccctggcctcattcatttgactttcattttcgtttttattattatttgttttagactcagggtctcactcagtctcccaggcgggagtgcagtggtgtgaccttggcttactgcagcgtcaaattcctgggctcaaatgattctcctgtcttagcttctgagtagctgggactataggtacatgccaccaagcccggctaattttttttttttttgaggccgcgtctggctgttgcccagctatagtacaatggcgcaagtatagctcactgcaacctcgaattcttgggctcaagcaatcctcccacctcagcctcccaagtagctagtactatagacgagtgccaccatgcccggctaattttaaaaattttttgtagagatgagatgtcactgttttgcccaggctggtatcaaactcctggactcaagcaatcctcccgccttggcttcccagagtgctgggattataggcgccagctaccatgagtggtctcatttgacttttttttttttttttttgagacagagtcttgctctgtagcccaggctggagtgcagttgcatgatctcacctcactgttacctctgtgtcccgggttcaagcaattctcctgcctcggcttcccaaatagctgggattacaggcgtgcattaccacacccagctattttttttttttttttttttttgtatttttagtggagacaggatttcatatgctggccaggctggtctcgaactcctgacctcaggtgatcctcctgcctcagtctcccaaagtgctgagattacaggcgcgaaccactgtgcccgacttcatttgacttttttttttttttgagatggagtcttgctctgttgcccaggctggagtgcaatggcgcaatcttggctcactgcaacctctccctcccgggttcaagtgattctcctgcctcagcttcccgagtagctggaattacaggtgcctgccaccacgtctggctaatttttgtagttttagtagagatggggtttcaccatgctggccaggctggtctcgaactcccaacctcaggtgatctacccgccttggcctcctaaagtgctgggattacaggcgtgagccactgcacctggcccctcatttgacttttaattgagaacctactttgtgccatgtataagctggatacaagagtgaacaagaccaagccttcctgccctcatgccaactgctcagcagtatttcaggactgtatcagggtgattagcctgggatcacaggagacttcctacaagagatgatgtctgaactgagttgttcaccaggcacaggtgggagaagggagaaggctggcctggacaggaggagccctggtgtgaatgcccagagatggcaggagaaatcatggcgtatataaggtgtcttgagcttgggatatgggaaggtgagaagtgatattgtatgggacatacttttttttttttttttgagacggagtctcgctgtcacccaggctggagtgcagtggcacgatctcagctcactgcaggctccgcctcctggggttcacgccattctcctgcctcagcctcccgagtagctgggactacaggcgcccgccaccgcgcccggctaattttttgtatttttagtagagacggggtttcaccgtgttagccaggatggtcttgatctcctgacctcgtgatccgcccgcctcggcctcccaaagggctgggattacaggcgtgagccaccgcgcccggccgggacatacttatattaagcattattggttgtttatccgaaattcaaatttgggcatactgttaaatgctaaatctagctgtcatagtaagaagctgaaatttactgtttgggggtattttgtatatttgttttctttctgttttttattgaaaacagataatggtaaaataacagacccttcctacatgacacaacaatcatagtcactgtaccagggctcaccagagcctgagttccgtgctctgcctgctcaacctcctgtcattcaagcctcccaagggggtggtgccctgattcccaaatggatgaggaaagcagatcatagtggttagatcttggactagacacacagagaatccggagggagtgaggacacaaaatgaacccatttctggcgggtcttcccatccctgctaatctgtagtttttatatttccatattaccttccgcccagatctagctttactgggttgctgccagggagaacaaatttttgaaatctgctattttatttatattaattaattaattaattaattactttaagacgaggtctcgctctgttgtccagcctggggtgcagtggcatgatctcaactcactgcaacgtctgcctccctagttcaagtgattctcccacctcagactcccgagtagctgggattatccgtatgtgacaccatgcctggctaatattttagtagagacagggtttcttcatgatcaccaggctggtctcaaactcctggcctcaagtgatccacctgcctcggcctcccaaagtgctgggattagaggtgtgagccactgtgcccagcctaaaaatattttttaatagcaccacagtgtaggctgggtgcggtggctcacacctgtaatcccagcatttagggaggctgaggcgggtggatcacttgaggtcaggagttcaagaccagcctggccaacatggtgaaaccccgtctctacgaaaaatacaaaaattagccaggcatggtggcagatacctgtaatcccagctacttaggaggccgaggcaggagaattgcttgaacccgggaggtggaggttgcagtgagcaaagattgtgccattgcactctagcctgggtgacaggagcaagactccatctcaaaaaaaaaaaaaaaaaaaaaaaaaaaaaacaaagaaaaaagaaaacaaaaagcaccacactgtaaataaactgaacaaccatggttaacgaagtgtgaataaattacagaagctccatactctggaacatttgtcagctcttaaagaatgaattatgatccttttgtagttcataagcatgatgattatgtgttcacacacgttcccatgtaagatgtgccaccttcaaatatttttttttttttttttaagagggagtcttgctccgtcacccaggctggagtgcagtggcgcgatcttggctcactgcaagctccgcctcccgggttcatgccattctcctgcctcagcctcctgagtagctgggactacaggcacccgccaccacgcccggctaatttttttgtattttcagtagagatggggtttcactgtgttagccaggatggtctcaatctcctgaactcgtgatccgcccgccttggcctcccaaagtgctgcgattacaggcgtgagccaccgcgcccggccgccaccttcaaatcttgttacgacataggcacattacccgtctgacatgaaaaaaaaaaaaaagaatgaattatggaaatgaactagaaaaatgtctatgatttcaaaatagtaggatcttttttgtaaggtgagtagatacatattgatgtcagagaagagagttaaactgttaatgttacttcagaaaggactgattagggtggaggaggagggagaatttaactttaaaaaattgctgggcatgggctgggcacggtggcccacgccggtaatcccagcactttgggaggccgaggtgggcagatcacgaggtcaatagatcgagacaaccctggcaacatggtgaaaccccatctctactaaaactacaaaaattagcttggtgtggcggtgctcacttgtaatcccagctacttgggaggccgaggcaggagaatcgcttgaacccgggagccggaggttgcaatgaacggagattgcgcctctgcactccagcctgggtgacagcgcgagactccatctgcacaaaaaaaaaaaaaaaaaattaccgggcatggtgtctcatgcttgtaatcccagcactttgggaggctgaggtgggagaattgcttgagtctgggagtttgagatcagcctgggaagcatagtgagaccctgtctctacagaaaataaaaaattagccgggtgtggtggtgcatgcctgtagtcccagctgggagaatcacttgagcctaggaagtggaggctgcagtgggccataatcacgccactgtgctccagcctgggcaacagagctagactctgtctcaaaaataaataataaaataaaaataaaatgtgcttcagcatctctagaattgttccgattagaaatgttactttcataaaataaaaataacacacacgctaaagtatacatgtgtagaaaaaaaaattcccaacttccagagagaacctccgtaaatatttttgatttattttcttcagttgcttttccatatatcaatatttttgcatgcatttaaaaaatgcaattaaaaaaaaaatttttttttgaggcggaatctcgctctgtcgcccaggctggagtgcagtggcgtgatcttggctcactgcaagctccgcctcccaggttttcacgccattctcctgcctcagcctcctgagtagctgggactacaggcatctgccaccaggcccggctaatttttttgtacaaaaaatacaattttttttaagacagggtctagctctgttgaccaggctggagtgtgcagtggtgtgattttggttcactgaaacgtccacctcctgggttcaagtgatcctcctgcctcagtcccccgagtagctgggactacaggggtgtgccaccatgcctggctaatatttttgtgtgtatttttagtagagatggggtttcaccatgttggccaggctggtatcgaactcctgacctcaagtgatcctcctgcctcagtcttccaaagtgctgggattacaggcgtgagccactgcacctggcctcttcttttttttttttttttaattatttttggctgggcgcagtggctcacgcctgtaatcccagcactttgggaggccgacgcgggtagatcatgaggtcaagaggtccagaccagcctcttgtaaaaatacaaaaattagctgggtgtggtggtgggtgcctataatcccagctactcaggaggctgaggcagagaattgcttgaacctgggaggcagaggttgcagcaagctgagatgatgccactgcactccagcctggatgacagagtgagactctgtctcaaaaaataaataaataaataaataaaaattttattttttaattaaaaatttacttatttattattattattattattattattattagagacggagtttcactcttgtcacccaggctggagtgcaatggcaggatctcagctcactgcaacctccgcctctggagttcaagcaattctcctgcctcagcctcccaagtagctgggattacaggcatacgtcaccatgcctggctaatcttgtatttttagtagagacggggttttaccatgttggccaggctggtctcaaacttctgaccttgggtgatccacccgcctcggcctcccaaagtgctgggattacaggagtgagccaccgtgcccatcctattaatttaattaattaatttatttatttattttctgagaccgagtctcactctgtcgcccagactggagtgcagtggtgtgatctgggctcactgcaacctccgcctcctgagttcaagcgattctctgcctcagccccccgaatagctgggattacaggtgcccgtcaccatgcctggctaatttttgtatttttagtagagacggggtttcaccatcttggccaggctggtgttgaactcctcacctcgtgatccacctgcctgggcctcccaaagtgctgggattacaggcgtgagccaccgcgcctggcctatttatttttttaaaatggagtcccactctgtcgcccaggctggagtgcagcggcaccacctcggctcactgcaacctctgcctcccaggttcaagcaactctcgtgctgcgcctcagcctgctgagtggctgggactacaggcatgtgacaccatgcttggctaattttttttttgagacggagtttcacttttgttgcccaggctggagtgcaatggtgcgatctcagctcaccgcaatctccgcctcccgggttcaagcaagtctcctacctcagcctcccgagtagctgggattacaggcatgcgcaatcacgcccagctaacttttcgtatttttagtagggacggggtttcaccataatggtcaggctggtctcgaactcccgacctcaggtgatctgcccgcctcggcctcccaaagtgttgggattacaggcatgagccactactcctggcctaatctacattccattatgtggactatttaaccccattgtgagaaatttgtatatgcttttttcttttttttttttttgatacggagtcttgctctgttgcccaggctggagtgcaatggcaggatctcagctcactgcaacctccgcctctggagttcaagcaattctcctgcctcagcctcccaagtagctgggattacaggcatacgccaccatgcccagctaattttgtattttcagtagagacggggttttaccatgttggccaggctggtctcaaactcctgacctcaggtgatcctcccgcctcagcctcccaaagtgctgggattacaggcgtgagccaccgcctgtatatgctttctttcactattatacatgacacttaaaaaatattatcatatattagttatcttttttgttgttttttgagaccgagtctccctctgttgcccaggctggagtgtcatggcatgatctcagctcactgcaacctcagcctcccagattcaagcaattctcctgtctcagcctcccgagtaattgggactacaggcatgcacctcgatatccggctaatttttgtatttttagtagagacggggtttcaccatgttggccagggtggtctcaaagtcctgacctcaggcgatctgccggccttggcctcccaaagtgttgggattacaggcatgagccagccacattagttttcaaatgcagatgaaacaagggaccgtggaatgcctgttgtctcaggtgtgctcctaggcatgggttccaaacttacaggtacaaacttacttatgggtagagagacagataataagtacgtggtctgcaaacgtggctaatttccccagaacagaatcctggaatactggtctgagagggtataattattttaaaatatttttggggccaggtgcgttggcttatgcctgtaatcccagcactttggaaggcaggaggatcacttgatcccaggagtttgaggctacactccagcctgggcaacagagtgagactccgagtctccaaaaaacaaaaaaagacaaaagaaccccaaaaaaacaacttttggctcataccgccaaactcatgtccaggaattttgaggtgatttatgtgcttccaaaagtatatgagagtgattacctatcagaccttgtgtttgaaggttatcacttgaaactgatttttaatttgtttaggagaaaacccagcttcttatagttttattttatttatttatttatttttttgagacggagtctcgctgtcgcccaggttggagtgcagtggcacgatctcggctcactgcaggctccgccccccggggttcacgccattctcctgcctcagcctcccgagtagctgggactacaagcgcccgccacctcgcctggctaattttttgtatttttagtacagacggggtgtcaccgtgttagccaggatggtctcgatctcctgacctcgtgatccgcccgccttggcctcccaaagtgctgggattacaggcgtgagccaccgcgcccggcctatagttttaatttatatgtcttgggttagtagaatggttgactttttttttcagtcgttccttcaaatagtgagtcctctgctaggctctatttgtggaatattcttgttcttcttcagggatgtttgatagctcttttttttccacagatgtttgatatttcctttttcatctattgtgttcttaccatttctaggatgtttctaggctttctattctatttcctgttctgtaccacactgaaatgcctgcggtagctttacaatttgttttgatatctgttagggcaagtctaccctcatgcctgcttttgttcccaaggggggaaaaccatagctgttttcggctatttatttttccaggtgaacttagaattttgtgaagtctaagaaatgttgttaggatgacattaaacctatacatccattaggaaagaaaggttgcatcatcagcttggcgaagggttattgaaactggtttttgatcttgactggagctggggcacaacttccctgtaaggcagacctgggctcctcttggacttgggcgacctcgatagtggtgtgttcctttgtttggtgttcaaagtagagagaggtccattaactagctccctagagaagcagtggcggctcaggccagcccagcccctgggaaggctatctgcatggcggccgggagcccgggtcctggtgggccggctcgggcaggcgcttgacccctggggcctgcgaggggctgcggccaccggaaggggctggctgagcgcagcgtgctgggtcctccgcgccctcggagcaggtagggttcgcgggggtgcgcccgcgggggcccgaggggcgctggggtcacgggaggggcgccccttctcttttgcacccaaccagcccgggcttccccaggagcccagacccccgagcttgcagtcactgctggctgcgcctttgagcctcgggcaaccgcagggagcgtcgagcaggggtcgcaaaggggtcggggagggggcgcgtaggccgatagaggtccctaattcggggctcctaggggtcagggtagggctaaaagggggtaagtccaccagagtttgagggggtgggcgtcagcctgtcggggggggccagggtccctgtcccgggggccggtatgcggtccgggtatttcaggggcgaggtcgcggtcctgccctggcgcttgaggtcggagtccggttagatgtccggggtctgggtccccggctcctcccgcgcacccctcccccacggcgccggaccccggcagcccgccccgcctagtgctgggaccgctgtccggcccggccccgcccccgcaggccccgcccctgttcacaggccacgcccccagctgctgccccctgtccccgccccgccgctcgcccattcagatgtgggtcaggggtgagcgggcggcgccgacgtcacaagcttccaagatggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaggggcggccttgtggggcgggggtcgcggggagcgggcgggggccggggccgcgggctgggcgcgtccccggggagaggggcgtggacgcgcgcgcgcccgggcgacgtgggactgcgcgcgtgggggacgcgctagcgtctggcgggcctgggctggggcgcacgcgggacccctggcaggcccgggctttgtgggccagatgcccggaggggcgcgggcggtggggcacccggggcacaaagcccaccgggccgcgccaggcccaggcggcgcgggtctgcggagcgggggtcggcgggcgagcgggcgccggctctttgtgccttttcattagcaatctaatccgaacagcgtcgggcgagctgcgctgcctgacaggcgggagggctcccattatgcaaacggccctgcgcccgcggccgccccctcgctagaggattttgcgatttccaggactgcggtcctgcaccgtctgcggtctcctctcttgcctcctccccgcgggaagactggccacggcaggggcaggggcgggcctggaggggccgctcccagagggccgggctctgcggctggtgggctcgctgccctgcccccagacctctcctgtaggcagccgcttggcaggaagagagatgggcttgggggagggggtcggctttcagggggaagggaccggctggctgagggagggggctgaggggccccagcttgtcactctctgtttatcttccaagatggttcatattcacacaggcctgggtgtgtgcgtggttgggggggggggggaatgcctctccctggggggcagtgacttgctgagaggagggaatgaggccagataatgctcccaacggccccacccagaactgcctgggactgcctgtgtaagggagcccagtgctgagccggatgggttggagcggtgttaaagttatttatccatgtcttctcctgtcccccgcacccctagtcttttctagtaggagttgccaagcacatctggaaagctgtgttccccgaccccccactcccccaacagcaggaggggtgtaacccagggaagccacccctctgacatatgtgctggggggaggggcagagccttgcccctaggaatcctgtggcggtgggttgttgactgatgtgggattgctgtgtctcttgtgctgtcggagagctggcaggtagtggaggggccttgggagctcctaggctgaacttggggctgtcctccaaggatccaggatggagggatggagctgggtcactcaaacctaaggcctttctgggtctagcatttattgcttcctggcttctggcttggcttcttttcgtccattctcatctgccagtgtctggactccctgggccttcaggcaggcattttcaggagcacaggccatgtggttggtctggagccctgtgtcaaggagagtgtgcgtgcttggtggagcagggttgctggagtagtgtgaaaaaaagcagatgagctggcctctggagacaaagctgtgtggcaagactgctggtttagtgggctctgaacaccaagaacagggccgggagtctgatacttgggggctgaactgagtcctgtggcccaggattgttgcctggaagtgaacgttccgtcttgtgccattgagactgtgaagatctctgggtcccacaggacgagcagtagacttggaaggctgggaagaggctccccagctgcctgccttgggaggtcagagctctcaggtgggtcggcaggccagtgtcgggctgggggagggaggttgtagtagagtgcctgtggcccagcttctctggtcagttggctctgagtgctgctgtgtgcccagcaacctctccctgcggtgtttttctgccagttgttggaacttgtagattagtcactgagtttttacgaccgattcctgaaaagaaaaatctccctctggttgctgcctctgtgtagaggaagaagcagcccgagggagtcaggcctttaattaaagcaaaaccgaaatgattgtcgaagttgctggaaggagaagagaaggcgcaggtggggcaggggtgatgagtcctgttgtgctgcatgatacctgctctggggacaggtaggcacgatcccatcctcgatccttggtcttggccagcagcccagccttctccacaagctgcagtcgcggattaatcctcacgtagtgttttctttccgtagatcagatttctcattttgttaataagcgcagcctcccatccacttgaagtcagctgttgtggacgaggagcaacagggttttgcattattgagctgatagcctgccgcctcccctcaagtccttattgtttgcggggtcagatctgaggggtggggaagtgccatttaatcagcagccagcccctggagaagagctggcggggcagttctggagagtgagagccgtgaggaaggaataaagttcagtttacccaggggacttgtggttccaaccttattgcttggtctgttggcctggagcagtcagccccaccccataccttgtcctgcccgctgcccccagtacctgatccctgggagagtggggcacttcttctgggctgctcttgctggcctgggaggcagctttcaccgcgggaagaaagaacacattgggttcctcccttcttgtctcctccgagcctggcctaggacggacccctgtggggcagtgagaggggaactggacttggtcggtcgcaaagtctgtagtgcattgctggctctgccatttactcccgtcatgaccttgagcagtgattgactctcctgcctggtttctacaatgggaacagaactggagtttacattcatgtatcgctgttttctggagctcagcctagggaaggcagacactcaacaaatgattataagatggggtgataagggctggcatctagcggagcgcagagggcatagcggtggcgtgggaggagccggccgtgggctggctgagaaccctggatgccatgtgggttggggttggcctggaggggaggggttttaaccaggaagtgactgctactgggttttaaaaggcagtggtagggtagagggtggcagtggagacagctggagagcactgaggacgcggacccacgggtactgtgtgagctgtgaagcccgcttgggagaccccactgccagccaggcatgtatgcggctctttttcaagctttttattcattccgccacattttctgagcgcaaagtcagtgcctggcccccttggtttagaccaagtcatgttggcccctgctttctggtgctcacagacttgcctgggcggggtgatagaggcgcttgcagttcagcacgcggcccgttctcctctggaggagggaaggagctgcttttggaagttaagtagcttgctgggggctggagggtaaatgcctttgactccaccgcctgtggaggcccatatagtgtggtgtctggagagatctgagatcgcactagggaggagtggggctgaaagccccctccctaagagaggtcctggctcccatttaggggcttctgaaccagcccttccagtttgactctgcctggcaccgccagggttcgcttcctgctgggaggggccttgccctaagggttagggacctgggctgggggagggctctgaggaggggctgggccccgagggactgagggactgcaggcttgcttgccttgagcccagttttagctgggagtggcaaagcgagaaaagctggtggggatgggagctctgtgtgggcccccagtgagcttgataagggaggcgaggctgggagctggttccagcccgccaaagttcaggagggaagggccagactgcctgagaggggtatggcgggactgagtggggagagggactccaagaaactgcttgggaccctcgggaaggtggccaggctttggggagcccctccttctaactattcaatttattttttatggtaatgttagtgggtggagagtgggagtgcagcctcggtgttagaacagggggacttgggggtccttctaatggtgagagggcacagggatgggtcagctaggtgtctcttacctagaggcaccggttttttgtgaggtgggcagcgcatcgtaggatcttaggtgcatgttttctgtttaagggtgatcacacatgggttgtggtgaggagggagtatgtggagtccccagccttcttgtggcagttcccagtgtgactaaaagaaggcagggattgggtttggttaggtgggtgcttccaggtgagagttggcctgctgtggaaatggaagagctcctggctctggcaggggtgtggctgctgtacagacttgtcccctgccgtcccgggctgttgccctgcggcttgggcttcggcttcattccaccgggtgggtgggttctctgacaagtgtgggaaggggccgctcccattaccacactgaggcctgagcccctttgagggggaggatctgttgcatggcctttgcaagccctcacccctgctgcgggtcgggcggtgaggccgcagcactcggaagacggtaaactgttggtgagctctcattcacaaagtaaatgagaagggagagtggggactgggacttcggtggcctgtccttgtgtggacacagtggggctcttctgggtgatgagtgcaggccgcacattcacccagcacacgttgcccatgctgcctggcagaggcctgcctgctggtgctctggttctcaccttgagctatacctgtctctggggtgggcccaaggcactagcttttcctgaagcttttgaagtgaacctgatgtgcagccaagtttgagaaccgctcttctagcaggtgatgcatctttgttgataatagaatccacaggcggagggatgagtagcccgcgcttttacctgcggttctcactaactgctttactccgagggcctggtggggtcagcggttacccagtgaatgagttggcagaatcagtcatgcctgttcctgggtagttactgggcacagagggtgaacagcaggaggaacctagcccatgtgcactgttggcttctcctgggaggtcctctggagagctgcctatagccctcagctgtaggcgggtcctactgaccccgtagcacgggcttttggagtctgcctggcctggtttcctggctgcattcttgggctctcgttggcctgtatgtagtctggcgggacctcacatagtgcagtttgggttgagcggaggtggccagtaatgggggcccctgggactcctgggacctctgtcttcttctccctggaagagaagagatttgtccctgaggttggtttcttgggctgtgttatctgggcaaggtatatgaggccactaataggggcagagaaggaagagtgggaggggactgaagggggacgggagacagagagcttcaggtagggcctggctgggcctggccccctttgctggaacagaacaataggttgttctggggttttgtttgtatttgagggagagaggctataagacggctcctgccagctaggagcagcctatcatgtgaggggacgggtaggcccctgggtgtggttttggtcagcatcctgggtaggaaatcttgcctcttagagatgggacagcaacctggccaggggcagtagaggagatgggaaaaggggctcagaaggaagggggtggtgcacatcttggtagctgggtccaggtggtcctgtcctgagtgagtgatctgggggtggattcctgccctaggtcttgcgccccttcaccccagccctgtccgggaccccatggcccttcccctttatggaagcagctgctattatagtttctgtctggcttgtaccagggtacttggcttagaagatgggaagaggatggtccccacggagttctgacagaaggctaggaaggtagtggtgaagagggtaagcactcatcctgggctcgttcctgggctcagcctggcagtgggcattctatgcccggttcagttgtcagaacacaccggtgtggtcctcatcattttgtcagtcctcgttgtacaagtggctcagagaagttagagtcgtacatctaagaagtgagtggcgaagctccaggtgaagtgtgtgaaagcctcggacacatttgtgagtgaggactccttactctgcgcagtgcttgggctggagggcagctgaggtgttcattttgagtggggtagtgggttggctgctctggacaaagccagggaatctggctcccagagtgggaaggtggtcccctgcaggtcccccattcctccccaaggaccaggggccagagagcgttctctgggtcgtcctcatccttccagtcacacgcagctccttactgtctggtatgtgggaatcttctgccccacggcagcctgtgcctttgccgaacacctccaggagagccatgtgggggatggtctggacgttgcagggaccagagccgagctcttgagattctctgagtgtggacaaacgaggtgctcagacatggcccttggtggtgtggggacacaggcaggatagctcctctcggtgactcttggtagattgtcttctggtagatgggctgggggtgcgggttctggtgcttcaaggtggttgtcctctgactgtgaaccagagcccagggaccaggcgtcagccccgtgctggccgaagggagagggttgttgccaaagtcccacattccaggcatgtgttgatgctgataaggcagcctagggctggcctagccactttgggcaggaggggactttgacttcatgcccccagcaggcagcatgcacatcttgcttcctggtagcacccctcccccaccgaccccctctgcttccaggtgcagggcccccgccgggtcctggtcacacagcctgcagaggcagtgccgctttcagcagcgttgctggctcttagtagcaggcctctggaggcctgttgatggattctgccagccccacctcttagagtattcgaggatgccattggaaatggcacttccttttatttgctgaaatttgttactcttaggtttggcagtgggctccttgtccaagagttcagcttttggggaagtgtagttttgtggaaagatgactcctgcttcctccgtgggccagtctcttaagctctccaggcctcattctccttgcctgtaaacgagttgttagaaatatttgaggcagtgcttgtcagctattctcaaagttgtttgcagaccctgagggtccccgatacctttttcagtatatttagaagttacaaggtcagatgcggtggcccacgcctgtaatcccagcactttaggaggccaaggcgggcggatcacctgaggttgggagttccagatcagcctggccaacatggtgaaaccccgcctctcctaaaaatacaaaaattagctgggtgtggtggcgcacgcctgtagtcccagctactcaggaggctgaggcaggagaatggcttgaacctgggaggcggaggttgcagtgagccaagattttgccactgcactccagcctgggtgacagagcgagactccatctaaaaaaaaaaaaaaaaaaaaatcactggcctctgccctgggtggacacttgcactgccagagttgtgttccccactgttagccagcactgggggctgagacccaccagttctacacatgtccaggggaggcagtacagatgactgagtattaaatctagacctttaattacacatatttttacttttctgtgtgatgaaataggaaggatgcatgaggctttttttttttgagatggagtctcgctgttgcctaggctggagtgcagtggcgcaatctcagttcactgcaacctccgcctcctgggttcaagtcattctcgtgcctcagcctcccgagtaactgggattacaggcacccgccaccacgcctggttaattttttcttttttttttttttttttgagacggagtcttgccctgtcgcccaggctggagtgcagtggtgcgatctcgctgactgcaacctccgcctcctgggttcaagcgattctcctaccccagcctcccgagtagctgggattacaggcgcctgccaccacgcctggttaattttttctttttttttttttttgagacggagtctttccctgtcgcccaggctggagtgcagtggtgggatctcgctcactgcaacctccgcctcctgggttcaagcgattctcctgcctcagcctcccgagtagctgggattacaggcatgcgcctccatgcccagctaatttttgcatttttagtagagatggggtttcaccatgttggtcaggctggtctcgaacttctgacctcgtgatccgcccgcctcagcctcccgaagtgctgggattacaggcattagccaccacgcctggtgtaattttgtctagttttaataaagtctgggtttcgccatgttggccaggctggtcttgaactcctgacctcaggtgatccacccgccctggcctccggaagtgctgggattacaggtattagccaccatgcccggcatgaggctttacaattttttttttatttttaatttttttttggcgatgtggtctccctcagttgcctaggctggagtgcagtgatgatgtaatcacggctcagtgcagcctcaccttctgggctcaaatgatcctcctgcataagcctcccgagtagttaggaccacagtcatgcgccaccacagccagctatttttttttttttttttttccagagatgggatcttcctggtcttgaactcctaggctcaggcagtcctcctaccacgacctcctaaagtgttgggattacaggtgttgagccactgtgcccagcctacatagcaactttgttttttttttttttgagatggagtctctgttgcccaggctggagtacagtggcacgatcttgggtcactgcaacctctgcttcccgggttcaagcaattctattgcctcagcctcccaagtagctgagattataggcacgtgccaccacacccggctaatttttgtatttttagtagagactgggtatctccatgttggtcaggctggtctcaaactcctgaccttgtgatcgcccacctcagcctcccaaagtgctgggattacagatgtgagccaccgtacctggcctacatagcaacttttatttatgtttttccttgaagcggagtcttgctctgttgctagtctggagtgcagttgcgcaattctcctgcttcagcctcctgagtagctgggattacaggcgcttgccaccacacctggctaatttttgtatttttagtagagacgggatttcaccacgttagcgagactggtcttgaactcctgacctcaagtgatccacctgcctcagcctcccgaagtgctgggattgcaggcgtgagccaccgcgcctggcccatagcaacttttaagaaactcatttgtcgagctttagtgtaatatcaatgaagaatagacagttttctgaaaaagttattaaaatactccttccttctttctgtgtaaggccaaatttctttaaagactttaatcaaaaccgcatatcctaacagactgaatgcaggagatatgagaatccagcttcttctattaggctagacattaaagagatttataaaagtgtaaagcaatgctatccttctttttttcttttcttttctttttttttttttttttgagacagtctcgctctgtcgccaggctagagtgcagtggcgcgatctctgctcactgcaacccccacctcccgggttcaagtgatttgcctgcctcggccttctagctagctgggactacaggtgcgcgccaccacacctagctaatttttgtatgtatatatatattttttagtagagatggggtttcacctgttggccaggatggtgtggatctcttgacctcgtgatccgcccgcctcggcctcccagagtgctgggattgcaagtgtgaactaccgtgcccagccctttttttgttttgtttttcggatagagtctcactcttatcacccaggctggagtgcagtggcacaatctctccttactgcaacctccgtctcctgggttcaagggattctgctgcctcagcctcctgagtagctgggattacaggcacctgtcaccacgcccagctaatttttgtatttttttaaatgttgttgttttttttttttgagagggagttttgctcttgtccaggctggagtgcaatggcgtgatcttggctcactgcaacctctgcttcccccaggttcaagtgattctcctgcctcagcctccccagtagctgggattacaggcatgcaccaacacatttggctaatttttgtatttcaccctgttgggcaggctggtctcaaactcctgacctcaggtgatccacccgcgtcggcctcccaaagtgctaggattacaggcatgagccactgcgtccagcctatttttttttttaagacagagtttcgctcttgttgcccaggctggaatgcaatggcacaatcttggctcactgcaacctccaccccacaccctcccctggggtaaagccattctcctgcttcagcctcccaagtagttgggattacaggcacctgccaccacgcttggctaattttttgtatttttagtagagatggggtttcaccatgttggccaggctggtctcgaactccagacctcaagtgatccacctacctcagcctcccaaagtgctgggactacaggcgtgagccactgtgctcagcctttaaaaaaaatttttttggccgggcacggtggctcacgcctgtaatctcagcactttgggaggctgaggcggcagatcacgaggtcaggagatcgagaccatcctggctaacacggtgaaaccccgtctctactaaaaatacaaaaagaaattagccaggcgcggtggcgggcgcttgtagtcccagatactcgggaggccgaggcaggagaatggcgtgaacccgggaggcggagcttgcagtgagccgagatcacgccactgcactccagcctgggccacagagcgagactccgtctcagaaaaaaaaaaaaaaaaactgaataagagggcactgttgtagtacatggtaacatcaaatacagcaacagcccagatgcagtggctcacacctgtaatcccagcactttgggaggctgaggctgcaggatggcttgaagccaggagttcgaggttgcagtgagctatgattgtaccaccgcacttcagcttgggtgacagagcaggaccctgtctcagaaaaaaccccacaaaacagtaatagagaagccacataagcagatgctcgttaggagccctgactatttaagaatgtaaacaacacaattttagaaccagtggcaaggagggtactggacatttccatcttccccacgtgcctccttatctttcacatgttgtttcactctgtctcttctcagcattgggtctgaccagcatttgctcacctaatgaatgtttatgagtgcctgctgcatgcctgctgctgtggctgcttgggacacagggtctaactttgggtactggtctatggggtggtgggggtaggcaggagggaagcagcttggcagctggtgctgacgttggaagcggggggacaacagaggcagttctggcttcacagaggagggagtcgtgagggggcaggctcctcccagagtagggcacggcctgcaggagctctcaggtgtgtctgtggaagggatgaggtgggcttgatgcccctgtgggaagtgctttgcatgccaggcctgagcatggactttatgctaggcatcaggaatttattgaaagctttatttatttttttaattttttttttttgtattttgagatagagtttcactcttgttgcccaggctggagtgcaatggcgcgatcttggctcactgcaacttcctcctcccgggttcaagtgattctcctgcctcagcctcctgagtagctgggattacaggcatgcgccaccatgcccagctaattttgtatttttaatagagatggggtttctccatgttggtcaggctggtctcaaactccagacatcagatgatctgcccgcctgggcctcccaaagtgctgggattaaaggtgtgagccaccatgcccggcccattgaaagctttaagcaggggagtggcttgatgagatgggtgttgagaaagataactcagggttattggactctgaattggagggtacagggactaggcgagggttggctggaggggttgcaggggggtgactgtgttctaaacgctgatattttcacttagagtggctctgattctgcccttctttctcctgtagaccttgggaggttgcctgggatttctccctcctggacaacttctgttgagtgaagcatacctgctaccccaggtgtggaggccccaggttcttttgctttgtatgattaggacagggtgatattttctgggttatctcttgtgggaactgagccctccaaagccctcatttgtgcattgttgtcatagctgcccaagtgtgtggccttgctgagtttgacggctgtggaccaggtgatctctcgggtggtgaaagggaggtgctctgtgagtgcacctcagctttagcctcttggcttctccctggattgggatttccagggaggtctctttcctctttcttttttctctttcttttctctctttctctctctctgtttttttgtttgtttgtttgtttgttttttaaatgagacagggtcttgccgtgttgcccaggctggtcttgaactcctgggctcaagcgatcctcctgcctcaatctcccaaagtgctcagattaaaggcatgaaccaccacacccgactttcctttcttttgagacttctgcacagagcaggctcagcttccttagtagacttagccattgaactctaagaagttatttacaaaggtgtaaataggccgggcatggtggctcacgcctgtaatcccagcactttgggaggccgaggcaggcggatcacttgaggtcaggagtttgagaccagcctggccaagatggtgaaaccctgtctctaccacaaaaattagctgggtgtggtgatgggtgcctgtaatccccagctactcgggaggctgaggcaggacagtcgcttgaacccgggcagcagaggtcgcagtgagccgagattgtgtcactgcactccagcctgggcgacagaggaagactcaaaaaaaaaaaaaaaaaaaacaaaggtaaattacatgtatatatgtgtgtgcacaaatcttaaagaatagagagataagtagtggtaaacctactattggttgaatcgtgggtgtcccactaagcgtgacaccgttgttccctcatggccacataagaaatagcctcccaagttcctgggacacctcatgcacttctccctggcttattcccacttccctctagaagccaacagtcttctgaattgcgggtcagccattcgctggcttttgtcggtttcccacctttgtctggatcctgaaactgcgaatgattttggctcagttcgctgggagccgggtgtcctgcactcttgggacaccaggagcagcagttcctgtgttcccattctccatttcagtgtccaaggtggcgccatccacacataatcacctgtcctgctggcagtgagcatttgggtgggtttctgggttttgtttttgctgccttctaagtagctgacttttcacccccaagctatgcttcttgaggcagagaagtgccagtttattttgttttctgtctctaaatccagttccttaatgcaccactgagactcagtttagaagtacagtgaaactttgtgagcatttttctccctgagtttgaatggatccctctctcattctttgagttcttgggcacttgtctcttagacactttcaagttacctactggacaggagagacctcttctctataaagtatcacacttggaggcttttcaggcacaggaccatagattgtaatattttccatagcagttgcccaattttatctgtaaaaattgctttttaaggcctggcacagtggctcacacctgtaatcccaacattttggaaggctgaggcaggaggatcacttgagcccaggagtttgaggccagtctggaaaacatagtgagacctcatctctacaaaaaattttaaaaattggttgggcatcgtggcatgcacctttagttccagctactcaaaaggctgagacgggaggatcccttgagcccagaaattagagctatgatcgcgccactgcactccagcctgggccacagagcaagaccctgtctccaaacaatcacaaaacttccaatggatgccgaacgtataactttttttttttttttctttcttggagtaaaataacttgatccttgatctttggctgtagctcctgagccatttgaggcactggggggtttgtgtgttgattacctatgaaggagcaagtgggctgtttccttctcccagcggcttcctttgaccccaaatccctgagagtctcgcccattttcttcttggcttcctccctttgatatgcccagccggctcctgccctacctggctgccaccaggacctgctggaggcggttgctgggaattatttggtgtcctgtttgaacctcgcttgccgtgctcccagatttcctgtttctcctgggcttgcctttcaggatttgcagaaccccttctcctttagaagtgtcaactggggctgggtgtggtggctcacgcctataatcccagcacttttgggaggccgaggcgggcggatcacctgaggtcgggagttccaggccagcctgaccaacatggagaaaccccgtctctactaaaaatacaaaattagccaggtatggtggtgcacacttggaatcccagctactcgggaggctgaggcaggacagtcgcttgaacccgggaggcggaggttgcggtgagccgagattgcaccatggcactctagcctgggcaacaagaggaaaactctgtctgaaaaaaaaaaaaaaaaaagtcaattggaccttaggacaacttaaaaacattatcaggtttttatcttttagatagcagagatgagtctgctcttaataaggatttacagtagtctctctgtttcctgtgggctcctggctggcttgtgtgagctccctcctctaggatgggcactccatcctggacattgccgcgttgccagctgtcctgccaatattttgcttcctgtgttgttgttattggttgggggtccaggagaggttgctgcctggactgagtctacttgctgatcaggatgaagttgatctctgcttcccttctgaaggtttctgtgcacgtattgaattcaaggacagcctacgtaagaagtgtgcacagctccaagagttcttcacaaatgattatgcccttgtaactagcatccagagtgcgaaacacaaccctggaagcccctcacgtatcctgaagcttgtagtcactctcaacccccacccataagattagtgctgcctgcttttgaatgtatgcaaatggaactgtaatagtctttttggctctggcatctttgctcaaaagtatatttgagagattcatctgcgttgtttgtaagtcaaaccatgtgaaattatcagcagccagctgtttttttacccctaaaaggtaaattcatacagttcaacctaaacgttctgtcctgttcactgctggctcatagtcttttatacctgcagctgtcccttctcagggtgggcatagttgttttccattgttgggccttcatgagtgtgcctgcctgtttggtgtgcattacgtgtgcattcttgttggcgtataccttgggtgagtttttgggcccacagctagctagctagctagctagctagctagcttgttggctttatttatttagagacgaagttggctcttgtcgcccaggctggagtgcagtggcgcagtctcagctcactgcaagctctgcctcctgggttcaagtgattctcctgcgtcagcctcccaaatagctgggattacaggagcctgccaccacgcccgactaatttttgtatttttagtagagacggggtttcaccatgtttgccaggctggtctcaaactcctgacctcaggcgatccacccaccttggcctcacaaagtgctgagatcacaggcgtgagccaccacccacggccttgggcccacagttttagattgtgccatccaagggttttctaaaccatgtgagttttctggccaggtgcggtggcttatgcctgtaatctcagtactttgggaggctgagatgggcagatcacttgaggccaggagttggagaccagcctggccaacatggtgaaaccccatctctacgaaaaatacaaaaattatctgcgggtggtggcgcactgcacttctgtaatcccagctactcgggaggctgaggcaggagaattgcttgaacctgggaggcgaaggttgcagtgagccatctcgccactgcactccagcttgggtgacagagcaagactctctctcaaaaaaataaaaaattataaagtatgtgagacttctggttgccttactgcctggccaacatttggtgttacctttttcctgatgggctttgacgttcttattgtttctggaacagtcctggtcttgtttaaaaacatccccattttcctttcatccctgggagatactcttttagtctttgtttggctagtcaaaatcccgtctttagtatctgttgttgaatttttgtgtttttgttttttctgattccctttcagcatgtcatctcagtcttgtcccagcccgggggtcaggcggtgttgcgtacagacggtgcagtggctccttcatgctggttgcctcagagcctttgccaggcctggagaactgcataggtgcaggactgccagtagttcttcctgctctttgatcattgaaatgttttcttttgtgaagtaatgatggtagaagatgatagggtttctgtttgtttctaattctagtctttacttggcattaagaaattgttagctgctagggttgattttgaaattgtgaagttggagagtccctcctggagctgtgggttggatggctgcagctctgtgactcagctgtgctgggtgcctccctttggggctcagttacctccttttaaggtgtccctagggtgagagagatgatcacgatagtcccttccacctgggcggcccaggctttcctcgcccatttagtgcctttcatgtagaatttccacctgttgtctgctgtgctgccactgcttgtcctccctccctgccacacagagctgtgttctctgcctgccactcacgcctacttctctgatcagggtttgtggaaccctccagcgtggtcaccattctggtacctgtggtaacacgctcagccttggtgtggcacattctaggtctaccgtttgtattcaccagcctgtgagcttgtgtacatgggacatgtatcttcgttttgggggctttctccttccacttgatgcccatcccttgagcgtttactacttgtggagcgcttggctttcaggccgtagagagctttccaatcagtggtgtccaggtaaaaacaaaagaaggaaaaaaagcttctaacctaacccttctcagacttgactgtgtgtttgagcccccagggttctggtggttagggctggatggagtctgagcctctgcgtgtctaacaagatccctggtggtgctgctgctgtttcttgggtcatggccagtgagcaagaagagcagggaagtgggctggagaggactgcagaaaccagcacagggcctgttttgcctcctgacatgtgtggatgccagattcctgctttttcctcacctactaggaacagcggctgcacatcctctggtggtcttgcgtgggctcctgctctgtggctgtcagcgagccttttaccccatgctcaggcccctcttagggggcagggtagtgttgggatggagtttggaggtgagcacagcattcgtagtcactatcacaaccttaaattgttattctgcttcttttttttgagacagagtctcactctgtcacccaggctggagtgcagtggcgcgatctcggctcactgcaagctccgcctcccagggtcaagcaattctgcctcagcctccggagtagcggaactacaggcgcgtgccaccacacccagctaattttttgtatttttagtagagatggggtttcacagtgttagccaggatggtcttgatctcctgacctcatgatccacccatgtcagcctcccggagtgctgggattacagaccgcacctggccgttattctgcttcttaaagcaatgttcccctgcctgtctccaatatcctgtctcagaactgtcagccagactgtgccaggcctggggccctccttggtgccagcactagcaggggaaatcagctgcaggtctccaaggtcttcctggcctcattccttgctggctccaaacccggaagtgatgaggagagggaggggactgaggctgtaccttctgggggaagcacagtttggaggcactttcggtccagctctcctctcagcagcccattccagccttttccttgtgctggggtgttagcccgggcttcctcacctcagaagggacagtacccatgggcgggtggctcggaccatgcagggcttggccctgctgtgggcagtacgaggtcatcagtaggtcccatgggcatttcaggatgggcttgggaaagtcactgggctggggtggatgctacctccctcactttaggccacagggctggcctgaggagcagaggaggaggaggccagcctcaggtcccaatcgctgcatcaccaatgtgttgagtggaacccgagtgtttattttgtagaagctgcgttggagagagctgggctcctggcatttgtggagcctgttgctttccaggaggatggtctgggaggagagccaggagctgctggccggcatccaggtctgggctggattacatggctgggcttgcccagagcagtgagccccacccaccaccagcccattcctgaagggacagggaaggaggtcatggagggtgggggtgttcccagaggagcagcaagcacaacctgggcctccaaagcaggctgcatgggggctccaccttgtcacttctggtggaggagctgggcagaccccatgccctcacagtgagtttgggagaatacacccaggtggggccctgctgtggataggcaggtggtgctggggggtgggggagtgagggtggaggtgcagactggagtccctgctcctggcacaccagtgcatggagggcggtgcctcctctagctcccccaagcagcttggcagttggaagccatgtgtgagtggcatccctggccctgcctgcgttgggcgggggggtcatcagactacaactctggagtcaggctttaggtcctcactctgctacctacatgctcttgtgaccctgggcaagttgcttaacccccaagaacctttaatttcttatctgaaactgcagagataacgccccgctcactgggcctgtgggaagattgaggagatcagacctgcccacatgtaggctgccatctcatacagggctgtggcggtgggcgaggtgcagccttcgccccttggagctatctcttgtctaccaaggcttcctcagggaggactccaggccatggggataggatgaacaaagtcctgggcttgtgactgtgcagggctggttggtgtgtccaggggctgggccttggggcacttctggatactggctgcctcctgcctggctgccttgtgccttccaggcagtctctcccatggcttaggggctcctgggaagaggctgagctcacacagggccacccgttgcagctgcatctgtcccggccacacctgaagtatgaggtgactatagttgggggttggtctggaaccagggccgatgctgaccttagactgaagtttgggagcagtggcagcaagtctggggctctctctgaccctggtcagatgtacttagacctctgggttgtggaagttgcctggtggccctgccctgcctagcatggcttctcagcctggcatgcttgtccctcccacctgacagtggagctcgggcgggccgtgggcggccctgctcactctcagctgtcttggcgtcagctggagggttctcatttcactgttacttttgtttaggctgggaggtggttaaggtgctgctccttgggagtgggctggggggagcttctcctcagtcctccagcatagctccaggcctcctgcaggaagcccctttcttggtagtaaaggatagcttccagggaggaaggtggatgagaaggatcctaggagggctaggcgggatggcctgcttggggtggcgccctttcctggtcttcacccttctccccaggcctccctcctggctgggcgtgagccagaagtttcagtctgaaggcaggggtatcatgtggctgagatgagtttgaccctgagtttgacccccgcctgtgggcctggacgtgggcgtgagatgtgttcctgtctcccagagtcatggcctccagaaggagccatgtggaggcccagcacctggagcagttctgaatgcctggcttcttggaggccaaggttctaggcaaggtgggtatccaggctgggttggggcagtgcctctcagaattggggctggagttttctgctttctgcctcagcagggatcactttgatctgaaaacctcctctctcctggcctttgaaagatgctgactagagcacactctcctgccctttgctgggtgcttagaagaaaggccttgaggtaaccctgttccagcctccccacaggcccctgcagccacgtggactgaccagaggctccacacacgggcaggtgtggcctgacctcgctcgcgtaggatcatgggctagtgggtcccccaatggggggctgcttcgagtgtcaggaggcagcgaggggtgcacagtgccctggcctctgccatccccgttggttatttggctggtctgtgtttggtgagcgagtagagggatccagagtgcagggtggtcttggcctggggcttttgactgccctctggagatgcactgagggccacccagctggggagcagccgggagggataggaacctgttcccaccgtggcgtctttgcccttccaatctgcttcaccgtcgcccttgatctctgtgccagttggaaaattgaggcagaaccaatacccctgggtgatctggaaatcatcagtgggaagggttgcctttgcccaaggctaaagatgacatgtccctgcacactttcagccccaggttttcctaccttgtggggaggtgagaggtcagggtgagtgctgggtttgaggctcagctgtgctgtgtgaagattgagaggagcccacctgatcacatggacagaacgcacaggctcctgggtggccctgcggctccagtgacatagcacatggtcgggcatacaacagtgcccaggaaaggttagctggtggtgtttccagggtatcgtgctgagcttctgagatgagaatgtcctgtgaaagcctctgtctggaggtttcattggaagtaaagtttacatacaattaagggcctaaaattgtattttcatttaccttaacccagattcccagcaagctagagagctgccctcaccccaaagagttcctcatgccccgtcctggataggcctgtcagggccaggcagtgggcgcttgtccctcgccccatcctggacagtcctcacctgtcgctcacagcctgttctgctctggtttttaccctcagtccgttttgcctattctagaacttgatgtaaatggagtcatgcagtctgtactctcgcaaaagtcttcttccactcagtgccacgactgtgaggttcatccatgtctctgcatcatttctgccctttgtatttttagggttttaaaagtaatacttttggctgggcacggtggctcacacctgtaatcccagcactttgggaggctgaggcaggcggatcacaaggtcaggaggtcgagaccatcctggctaacacggtgaaaccccgtctctactaaaaatacaaaaaattagccgggcgtggtggcaggcggctgtagtcccagctactcgggagactgaggcaggagaatggcatgaacctgggaggcagagtttgcagtgagcccagatcgccatggcactccagcctgggggacagaatgagattccatcaaaaaaaaaaaaaaggtaatactttttaaaatgttgagtattacagaaatgaacataatatacagatactatggtttttctgtaatcccgctccccagagataatcttacttagcagttgggtatgtgtgtccccaaggtttttcttgccacagaatggacttgctgggccgggtaggctctgactgggccttgcagagcagctgccttactgtaagttctttgagggcgaacagagcgggggtggggctgctgtggctggcccagttctacagagcttgggcatgtgccaccagtggcttgagaggctggagtatctgagtgctgttccagcccgctagcacctgcctgggccctgggcctgccctcagtgtctggggacatggctttctggcttttttgtggcggggactgggaggggaaggaaaggagagcagttggcatgttggctgttccgtaaacagggccgtgtgtctgctctaacagatggcctgggaaggtaaccccgaggctttgtgttccttcctgcagaccttcaggattccgcagagagagctggccctccctccagctgctggggctcttgtccttcccagctggggccagtccacctacagggggaatcctggagctgagggatcctaacttgggagatagtttctgtgctacccttcttgcctctcccctggacccctgaaggctctgtcctagggaggggatgggtcacagccttaggcgaatgcccagctggccccgatagcccaggcctgctgccctactgcctcagatcctgggcgtcctgggagccagcgtttctggatgggcagtaggccagggctgggcgtgctagcctcggggctgataggcgtgctgcccgggcctgctgccaggggctgctgggtgctaggtggcattctcatcgcagcctgcagtcagctgcttccagggctgagcaccagcatccgggccagcacccagagccgtgtttctagttacctggcactccccaggcggagccctccaggataggcacttgctgtttcatgtccagcggtgagcgggtagggcagagctctgtggctgagaaggaaggagcagtgcttagtaggcgtttcgcagcaggatggcgtgtgccacccccctgccccgccatggggtgaggctgcattgctgctcgcagacacagtggcggcctagatgtggcccagacttggcccagctggtgtggatggcacgcatggtggcattgtgcttgctgtgaactttctgcaggtggctctgacaccccctaactcaagtggagggttcagggaggagccctgccctgttctacatcacagctgacccagcctggggccatccttccttggtggggagacctagtgctagccttgggcttgtaaagtgcccgacagggccaggcagtgggcactgacggagggtgttcccacccccatggcactcaggtgccccccagtcctattctgccacccactccctgcgcggcatccagtagctggcctggcctctggcaaggtcaggtgacccctggctgcagagtttggcatgcgctctacccatggttgactgggtcctgaggggcagtggttggggagcagatgaagtggcacagggctggatggtggtatctgattgcctccagtgtgccaccgagaccctctacccagtttttcgactgctcccgccagtgtttcagtggcccctgccctactggcctcatcccagcattagcccactgggcccaacccttgctaactgtggacgcccttgggcttcctaccaacagagctgattctgctgccctctgggcctttggtggggtcctggaccagccatgcaccccctcccctcacaccccccacccagaggggagctgcactaggggctggagagacagctggccagctgcagcctaggcctcccagctctgggccggcaccccgggtctggtcacattcctgagggacctgctgagcctccctggccctgggggtggagtgggggaaggggaaacggggacgggccgctgcacgccccttccccgaccccggctctattccgtgggggcccaggctggcaggtgtggggtgcaaggacccaccacctcaggatcccccctcctgcaggacccagagctctgggggtgggagggaacccctcgtttcctggcggcagctgcccaaggctttggtgggccggtattgaaagcccaggcctgcagcttgggtgagcccttaggcagtgaaacctctggagagggaaggccatgtggtcaggccaagcgggctagggggctgggccctctgggcagggaggcggtgagagcagatcaggaagggaaggaacgggggagccaaaagcggttgagactggttcttataaatagcccttgcacaagtggctccaattttgaccttttgttatgtaaatgtggccagcttgggaagggccctgcccaggcctcctgctaccacacccgcaggccaagaattgtgtgtctgccaccagcgccccctggcctaggtggcccctgggtgtccttaatctcctgtgtgtgttagaggggcaggcattgcacccaccgaactccctagacctgttcgctggtccttactcttcctggctgtcagatccaactaccaggctctgtggccacagtctcctgctgggctgcccctggtgccccagccagagacccccaggtgcgtcccttcatcgcccttccctcccttcttcgctgatggctgtctgggtgactgtgttcgtcttctcttccccaggtgaccaggcattgatgcacccccaggaaggccacgcgctcaggaggcccccccgccccgctggctgctgctcacatggtgtctgggcccttggcactctggtgaggcgcaggggaggggggaccgccactggcccctttccccggagtttctgggtggcacacagccccacagctcggcctctatctgtctgacccgtggtcctttgtgtgcacacagcactgggcagtgtggagggagcctggaggccactgccctcttccagtccccttgccagtctcagggtaccaggtgtctgggtgctggcagagccggcactgatgttttctggggtcaccagaaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggcagaggcgggtgggtcacctgaggtcgggagatcgagaccagcctgaccaatatggagaaaccctgtctctactaaatatacaaaattagccgggtgtggtggcatgtgcctgtaatcccagctacttaggaggctgaggcaggagaatcgcttgaacccaggaggcggaggttgcggtgagccaagatcgcaccattgcactccagcctgggcaacaagagcgaaactccgtctcaaaaaaaaaagaaaaagagtaggggctgtagctgttcccatttcacagggcactgggggtgctcctgaccacgtgtcagccctcacattgtacctggggctctggagcccagatctgtctctctcctctccacttccttagttcaggtgcccttgaacctctggcctctctgtctggtcctcagataggagtgggtcctcagataggagtgggttggttgacccctgggggcagggcagttggagtacagatatcactagcaggtcccagatggtaggaagacagatcagctcagggaaagctgctcacagcctccttcagagttctgggtcttgaaagcagctgttttgggagcctaactgcttttcccagggacttaaggcctttgtaatttttgtagccctttcatcctccagaataaagggaccttcttgagctcagggccttctcagtactggcatgccccagggctcctcctccctgcctggctactctggccagctccactgcttacccagcccagtcactcctagtccaggtggatcccttcagtggcttggcccatggcctgcatggtgaactgattagcagccccaactaatgggtccaacctcagctccagacaccgctgcgctggtcgcccatccgccatcactgttgatgccagggtggttcttcccttcactgttgatgccagtggggcccctccctttactgtagatgccagtgtggcccctccctttactgtagatgtgagcgaggtccctcccgtcactagatgccagctaggtccctccctttactgtagatgccagcgtgacccttcccttcactatagatgccagcgaggtccctcccttcactgtagatgccagcgaggtccttctctctgctcagacatctttgactccctcttatgcacatcccactgatgactctcagcacatcccatcaccttcacctttgaggtttatccaggatctgacaagtcccagcatcccagctgctgccccctggcctggcctcctgctccccaaccccaggcatcttccccttctccacatgcggttggcgcaagccaggggggaatcagagcccccctacagactcgaaggtgggcttgtttctgtgacctgcaagcccccttcccacctgacttccatcctctctcttcccctcgcttgctgtgctgtggccatgctggggtcctgcttgcacttcccacggatgattctcagcacatcccatcagtttcacttttgaagctgccctcctgggctgctcccaccataggctgcgtcatgcattccctcttctcagatggccatgccttgcgcctcactcctgcgtctcctccagggctcatctcagatgtcccctccttgccagggctctccctggccacctggccacacgctcactcgcactgctgtttcttagtgtttctcagtgtgtgtagcttatttcttgttgtctgtggtccccaccatagactgtgtggtcatgtttgtcttcattcagagcaccatgcccagagtccacgaggccctggcacagaggcagccaccaggatgtggttgtttaacaaatagatgggagtgtgtttcttcgatggcttcttgtccgtggcagttctggggtcccccccaccgccatttttttgctcccttgtctgcttccataagactaatcagtctgcaggaaacagaaagcaggctgtagtgcctcgtcccccaggagtcctcaccccatgggcagattagagggaagcagcagacagagccccgccccgggctcccgtcggctcctggccatcctgggcttatgtggcctttgtctccaccctcacagcctccagatggcttctgtgcctcccagcaggaaggaagacaaggacagagtgcaaagggcagaggccagctgccttgaccttatgaagctcaccctggcatgtgttcccagggccttgcccagttcactctccctggctcattagagtggccggggagaacagtggctgcctcagccagcagggaccctggctgagagccctgtgactggccacgtggccaccctgatccacctcatgaggaagaagggaggggatggtactggggagggagccgcggtgtgtgttctactcattaggcctcgttgccacctctgcacaggcgcttggagcccttgtagaagctggtgctgctgggacaacagagggatagaatcctctttggccagatgccaaatgctgtttgttggtctccttgtaaaaacacccagaaatcatgggggctttccatgtgtgagctgcacctcttactctctgcagcacccaggtgtctcccgggcaccatgctgctccctctgggcacccctcatgcccccccacggaatggggacctggctgagcatgactgggccatgggagcagcctgaccctgggctcccaggcctggccatggtggctgcaggctcgcctcggctccatgggccttcctaatctggttagcgggatgaaggtatcgggtagggtctgtgtggggtggagaggaggagccaggccctggatccagaaccctcttctgcccttgccagctcagcagcccacagaggggtcttcccgctcacagccacagagggttatcagggttatagagaagagtcacctacccagtgcctgtcagggcatcaggtacatcccgggtgctgccacctcacacctgcaatgtccacacggtgaaccgggttgaacagaatgcagcctcgagaggctggagaaaatacaccaagcactgacacagatgaccctgggatgtgggactataggcgatcttcaattttttcttcatacttttcttggtttctaaatcttattcagtgagcacgtgttcctttttttaattagagaaaacttgacagtagcccctttttgtgtttcacagaggagctaacattccttctgtacctgtagttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacgtacgtgcctgttcccccacgaaggctgtggggtgctccacctggggggccaggactgttcctggggtgggggtagccgagcccaaggccttcggcaagctcggccagtcagcccagaacccctcctcagctgtctctgccggccccagggttagcccggctcagccccaccaccacagcgtcttcctcttttcgctcagttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagtgagggccctcttcctggggagcacagggcccctggtgtgtacagtgtgtcatggggcgtctgtgtatcacggtacttctgtagacggggaacacatttcagtgagctgctcctggaagggcagggaagagagtccataaggtgaacttggccccaggccaggctcctgctctgaccgggtccggggctccctcacaggctgctgaccctggggctgtccctcctgcatgccgatgtggttccaaatgcaaccatccgcaatgtgcttcgcgagaagatctactccactgcctttgactacttcaggtactcccccaagatgtgctgtgcagcatccagggacggcccagcccctccaagtgctccatcgccccagacccccaggaagtcactcacaggaatacacagttgcccagttgtgctcaccaacctcctccttcagtatccctggccctgtggatttaaatacctttcagccctgtgcatgtgtcccgtgtacttagagctagcctcccagcgagatgtaggcaaattttccctcagttcaactgatttaggagattaagtgcgtccatttaatttccctgttaatgtgaaggcttattgcacgaagaattgcaaacacccactgcctggggctctgcacccataggctgtgctgttgtgtgagtgcagcttccttgccctgatctgccacaagtgcagcttcagtggaaagctgtaggggctgctgtgggcagtgagggaggagggcataagagggctcccgagccaccacaccttcccatgggaatgggccagatcatccttgctaatgactggctttgggctgaccttttgtcattaagaaattgtctgcatcaccttctcactgctttgtgtgactggcctctagtccctgactccagacactcagccgttgtcctcttatggttgtttgaagctgtcccccaaagtttcctactcaaggagagaagcggctgcgtgaagacataagcatcatgattaaattttggaccgccatgttctcagataagaagtacctgaccgccagccagcttgttcccccaggtaaccctcaacagtgcagctgctcatggtggaggcaggcaggacaggggtgcaacgtgggcagccctgagggtgccagaggtagggacggaaaagcagttagacccccctgagccctggccttgactgtgttgcacggtcattggaggccggtgcatgcctggctctgcttctcctctggcctgagctgagaagcataaacacgcacccgaggcagctgagcagactccactcaccgcactttccctgcactggcaccagctgcgttcacacacccctctgagcagctgacggcccaggattgggctgaggctggtgcacacctacatgactggggtatggtctgttgttgtcttgtaggaggcagtcaaatggacaggtgatttcaatttgagggaactgtgggagcactcctccggtacagacacttggcccatccagagttggggaatcagagatggttttctggaaaagagacagttgagctgagtctgaaaggctgcaccggcatgcagggcggacagggcaaagcattccagggaagggaatgccaaatgaaaacatgccacgcaaagaagcagcaaacctctgtaaggaggccatgccctgttctctcagcgcctagctgattactaagcacagactgagagacgagagagggctttctttttttttttgagagacagtctcactctgtcgcccaggctggagtgcagtagcgcaatcttggctcactgcaacctctgcctcctgggttcaagcaattctcctgcctcagcctcctgagtagctggaattacaggtgctcgccaccatgcctggctaatttttttattttatttatttatttattttttaatttaatttttttttttttgagacagagtcttgatctgtcgcccaggctggagtgcagtggcacaatctcggctcactgcaagctctgcctcccgggtacatgccattctcctgcctcagcctcccaagtagctgggactacaggcgcccgccaccacgcccgcctaattttttgtatttttttagtagagacggggtttcaccgtgttagccaggatggtctcgacctcctgacctcgtgatccgcccgccttggcctcccaaagtgctggtattacaggcgtgagccaccgcacccggacttttttttaaatttttttttttttgagacggagtctcgctctgtcgcccaggctggaatgcagtggtgcagtctccgctcactgcaagctccgcctcccgggttcacaccattctcctgcttcagcctcccgagtagctgagactacaggcgctcgctaccacacccggctaattttttgtatttttagtagagatggggtttcactgtgttagccaggatggtctcaatctcctgacctcgtgatccgcccacctcagcctcccaaattgccaggattacaggcatgagccaccgtgcccggccaatttttttattttttagtagagacggggcttcaccatgttggccaggctggtctcaaactcctgaccttctgatccgcccgcctcagcctcctaaagtgctgggattacaggtgtgggccacattgcctggctgagaccttctgatccgcccgcctcggcctcctaaagtgctgggattacaggtgtgggccacattgcctggctgagaccttctgatccgcccgcctcagcctcctgaagtgctgagattacaggcatgagccaccgcgcccggcccagaaagagtttttaagggaagctattgagctcacagcagcagatccaagttttccaaaaaaatgtttcagttcctttgagtggaagatttattttttgttcattttcaggaaaacatctgccacatccctaagtctgaatagctatatgttgtctgtcagtcatttcttcaagtaaaaacaaaggtctgtgaaaaaggttagtccaggctccaaaatcagacaagctccaggtgcttcttaggacagcgcctgccttagatgcggcaagagtgcttcgtgcacatcccgtttcatcacaaaggatactttaaaagccagatgtggtgatgcgcacctgtagtcccacctactagctgtagtcccagcaactcaggtgactgagacaggaggatctcttgagcccaggaatttaaattcagcctgggatttgaatagtgagaggcactatttaatatagagccccgcccactgtgtgcctctattaaaaaaaaaaaaaagacatgtattcagggtagagtttaataagaattagttttcattgcttcacctgtgacattcataaatgacacgggctcttttctccctgcgtgtgcagcagtgaggattctatgccctgtgacattcataaatgacacgggcttttttcttcctgcgtgtgtagcgtgtgcagcagtgaggattccacgtccacttgtgcgcttggcccctaccttgagctccgcttaggcaccagcttagcttcccagcagtgtcggctgtgtcaacacagcaaaaggggcacacggcagctgttatggtctcaccaagcctgcagagcatactctgggcaccgccagtctggggcctgggaaacagggctggtattcctgaggggcctctgccacagccacagagactcagcctctttgtttccttggcagctgacatcggcgacctcctggagcagttagtagaggagaacacaggctccttgtcgggcccagcgaaggacttttaccagcgggggtttgatttctttaacaagatcaccaacgtgtcggctgtcatcaagtaagtgcagtgcttcggaaaccaccttctggaatcttgttccagtccctgcagcttaacagaattgcctgggaagctttaaaaatacccgtgcgtggccccaaccagatgaatgagagtctctagcagcggggctgctggtggttctgatggacagccagggtgggtggggaagcactgcttggggtgagtcagggctcttgaaggtatggcagaatgcacggccacgccagtttcaggaaacacagcttagtttcattcctgagatttgtggaatttagcacatggctccacaatttgaggtcaccctgccctctccacactctgaaggatcgatcctcttggtgtcaggaaaaccagactgcctttgcagctcctgtcatcgttttcctagaccttccattcatgtggacctgacaccatccttggatgttggtggctttgtgcattcataagggatgaaaccctggagtcatcaatgctgggcacgctggctgggctgtctccattgcttacactgctctgaccttggtcactttgaggcccttttctgggctgggtgctgagaatagcagtgctggcagcttctaacccaagagatgaaggacgggagctagcgtttcctgggtggcagcaggtggcaggcattattacccccaccacccccagccacacacccccgcccacagcaggggcagagcctgccagaaaacagcccttccggggctgtcggggtttctccatgaggaatgcagggcaagaatcgctgccagtggtgcctggctgcgctaggagcagctagagccgggaagagagggacagagagggcaatccaggcaggaggggccctgggctgtcccccagcagccagttcctccaggagacaaagcaagaatttctttcctgtttctcaggccctaccctaaaggcgacgagagaaagaaggcttgtctgtcggccctgtctgaagtgacggtgcagccaggtgagcaggtggcttctggaggctcagaccaacctcttcctgcaggcgggcggcggggcgtgaaggctgctgccctctccaggcactacaggatgtggacacagtggcttggccagccccacacctgcttgggcccacggtgcctggtgccccaggaccccagcccctccccaaaatctgccgctagtgagcgggagctgctcgtcagtgggtgcccttcatcttccttgctgcctgctgtttttctggaggctcacactgacctcagtagctgttactctagaagagggttcctaggctccagcattacaggagcaggtcacacagacgaggggatggcgggcccagtgtgggagggctcaggtgtgctgggacccatcagcaccaccccctcaccgcctccatgggaagtcgctcctgggtgcctgtggctgtggccacatgggaattcaagccgagcttttcaagagaagatggaaatccagacttcactgggcagctctctctccatttcttttttttttttttgcgatggagtcttgctctgtcgcctcagcctcccgagtagctgggactacaggcgcccgccaccacacccggctaatttttttgtatttttagtagagtcagggtttcaccgtgttagccaggatggcctcaatctcctgaccttgtgatcctctcgcctcggcctcccaaagtgctaggattacaggcatgagccactgtgcccggcctctctctgcatttctaactattggcacaaacttgtcttccaaactctgtctgtcccgtgcagatgttcacagcggctggtccttgagtgccctgcaggaccccggtttaaccatttcttcccaacacgttgtgttgagctcatacaacagcacggcttcccagagagggcaggacatgtatgcagggcctttgttcccgcatcgggaaggccacaactgctggggaggggcaaaaagagctggaagcattgtactgcagggggcatgcacagaagtccccagcccctggctctagattgtgttggctgagtcttgccccagaggtcagggaagccagcagggctctagcaggagagcacagaggggcctgagtgtgagccacagcctggagcaggcagaagggcaggtgaggaagaggaggagatggcatgcccccctctccctgtaccccacagcaaggccaagcttggctcccctcaaagcccacctctcagggctcaaggagcacacatcccccttggggactggcagttccttggccagaaacaggctttcccttgtcctcttatttcacacatttactgagcactcactgagaaaggggagcctgggccgggcgcggtggctcatgcctgtaatcccagcactttgggaggtcaaggcaggtggatcacctgaggtcaggagatcaagaccatcctggctaacacggtgaagccccgtctctaccaaaaatacaaaaaatcagccaggtgtggtggcgggcgcctgtagtcccagctactcgagaggctgaggcaggagaatggcgtgaacccgggaggcagagcttgcagtgagccaagattgcgccactgcgctccagcctggatgacagtgcgacactcggtctcaaaaaaaaaaattaaccaggcatggtgacgcgtgcctgtaatcccagctacttgggaggctgagaacaagaatcacttgaacccaggaggtggaggttgcagtgagccgagattgcaccactgaactccagcctgggtgacagagtgagactctgtctcaaaaaagcaaaaacaagaaaagaaaaggcatgacattgggtattgtggctgttaaaaagatgagtaagacatggtccctgagctgaagaagcttgaactcacagagatataaaataagcataaagaaacaatgttggcctggcacggtggctcatgccttaatcccagcactttgggaggccaaggcgggtggatcacctgaggtaaggagttccagaccagcctggccaacttggtgaaaccccatctcaactaaaagtacacaaattagccaggcgcggtggcgggcgcctgtaattccagctactcgggaggctgaggcaggagaatcgcttgaacctgggaggcgtaggttgcagtgagctgagaccgagccactgcactccagcctgggcgacagagtaggactccgtctcaaaaagaaaaagaaaaaaagaaacgtgttagacaaaagtcctaaaggctgggagaaccaaggacagttcatggacatagtgacatttaagtaaggcttttgagagagtagtgttcaaatgggtaaggaaggccgggcgtggtggctcacacctgtaatcccagcacttgggagaccaagacgggtggatcgcttgaggtcaggagtttgagaccagcctggccaacatggcgaaactccatctctactaaaaatataaaaattagccaggcatggtggcaggcacctataatcccagctactcaggaggctgaggcagaagaattgcttgaacctgggaggcggaggttgcagtgagccaagatcgcaccactgcactccagcctgggtgatagagtgagactctatccaaaaaaaaaaaaaaaaaaaaaaaaacagggactccaagaatggagggctgttcagagggttgctcaggcaggtggaggcaggacaggcctcacacacacccccagaagcagtagggctgtatccgtgaggatggggctcagtgctcctctaggaagagcatttcccagaaggtgcagactcatttggtcgatggctggaagagtcgaagagtcaaggaggacggacccttagcggccacagaataataagttagtggtgccctggacaaggaccagaggcccctccacaggggtggggtgtgcctgcagggtggacacgcacgtaacatccgtgttggaaactgactctggctcacctgtggtgacacatgcactccctgtgactgcctctgtccctgcacaggctgctccctgcccagcaaccccgaagccattgtgctggacgtcgactacaagtctgggaccccgatgcagaggtgagcgcctcaccctacccatcccccgcttccacagcgtccgcgtgtgaagtttttctcggctgcatcatgggtgccacattctttttgttgttttcagtgctgcaaaagccccatatctggccaagttcaaggtgaagcgatgtggagttagtgaacttgaaaaagaaggtcagtaaagaaccctgattttgtttgggagctcagtgcttttccttgctaatgccagtttcttctggcatgtgttaaatttagtacagctctccataaaagatgatgtctgtccatctgtctgccctcagtcagacccctcactaggggatggcagggagctcaaatgcactgacagatgtgccaccccagaggtctgtctgccgtgagtcagctggcatgctccagcaggctccttcctgaggctgaggggcccggggctgttggggggtgttagtttcccagggctaccgtacggacgatctcagttctggaggctggagtccatcatcagggtcgtgccccctctgaaggctctgggcaggtcacaccttgcctcctcagcttctggtggtgttgccagcagtcctgggctcaccttggcctgcagatgctccactcccatctccgcctccctcttcacatgatgatctcccttgaaggacatcagtcattggattagggactgtcctaatccactgtgaccttgtcttaacctaattacatctgcaaagaccctgtttccaaataaggacacattctaaggtttggggtgaacatgaattttagggagacactcttcaacccagtacagacggtgtggccagctgtggagagggggctgccaccccttgcagggacctgcctcccatggccatgtctgcacactggccccgagccctcccaggaccccagtgtacagacacattcctcctgccccccagctcacagcacccaacactgactcaggcacacctgggtcttcactgcagatgaaatggggctctgtttttagttccatttaagcctaaatgttcttagactccaaccctggattccacctgctgttccaaggctttccttgggccctgctgggctcctccttggcctccttggggttttgaagaagtgatccccaagattgctggggttcctttcaggcatgtgagaggactcatccctggccccctcagagggcttctcactgcctacaggctaacagtggcctctctccctgcgggcaggtctgcggtgccgctcagactctgaggatgagtgcagcacgcaggaggccgacggccagaagatctcctggcaggcagccatcttcaaactgggagacgactgccggcaggtaagcagggtcaggcctcaagtaggcttggggactgggcttgctgctccccaaggctccaggcccaccagagtccaatctcatatgcagaaatgtgaatcttttccttctcttacatggttcaggtgccacggggtaaattagggcttctgcaaaacccagaggcctctccttccagcccctttcccactgtccctgccatgccagtgcccacctgagggaactgtccaggggttgggtgccttatctcacacaccccaccagacagctcagcctcatgctcagcccagggcctggtggtcccagcagcctgagtccagcccccggtggtcagaaaggaaggccttccagactcttgctcggctgtggtctccccacctcactccatctctgggtgctcggcttttgccctgcatgagccagaagagctactggggtgcaaggatgccaactgaccgcatcctgcgcctcccggcttcccaggacatgctggccctgcagatcatcgacctcttcaagaacatcttccagctggtcggcctggacctctttgtttttccctaccgcgtggtggccactgcccctggggtaagttccctgagtggagccagtagggcagccctgggcacctcgcacccggcgggcctcagaactggcctttcctcctagtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgcgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcaccactgcactccagcctgggcaacagagtgagactccatctgaaaaaaaaaaaaaaaaaaaaaaaaaaaccagggcacctggccgggcgcagtgctcacgcctgtaatgccagcactttgggaggccaaggcgggcagatcatgaggtcaagagatcgagaccatcctgaccaacatggtgaaaccccatctctactaaaagtaaaaaaattaactgggcatggtggtgggcacctgtagtcccagctactcgggaggctgaggcaggagaatctcttgaacccaggaggcagaggttgcagtgagccaagatcgtgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgccttttgggggtggagggggtgctcctgttgaagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccaggctacctggctgtgcggtgagcctgggtgagggccagggtggaggcggagggggtgtgtggaacgttctgagatcccctttaggatgaagggaatcgggttccagagagtgaggtaggtgctagcagccacctgctgacctacacctgtcctttggtcacctctgtctgcccacctgtgccaataaattcttgctctgggcatctaattccaaccaccttccccacaatcctgcccacgccttcagccatgggctctccctttctgggcatcccatccaccttgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctgtctctccccaggccctacatggatgtggtcgtctccctggtcactatcatgttggacacgggcctgccctgttttcgcggccagacaatcaagctcttgaagtaggttccttggtggacacgcaggccatctgggggacagttgtccattagctgaggctccatccaagataggtatctttcgtgtaattgtcactgtggttgtcatctccttggaacctcagagcagacagggttcctaggtgaggctctacccctagaccacaactgtgaggggcccctgcttgtgccggccacaccagagacccacccaggggcctctatttatgtcaaggatgctacgcccaacccacctccaccctaaggtctggggctgcagtagcttagctccccaatgcttagtcccctaataccatgggaccactcaggtgatgctgggaaggggacagggcccatgataggccaggcgtggccttcacagcaccccatcttccaacatgtggaccccaaaggtacatttccagggcatggctctcagctgaagtccgtccccatggaagaccctcctcccactgggccagggagccagcacggccctgcccatggcagccctgacacagcctctcctccaggcacaggtttagccccaacatgactgagcgcgaggctgcaaatttcatcatgaaggtcatccagagctgcttcctcagcaacaggtgagtgccccgcccccctgccttctcccactgcctcggtggccactgggcacctgcagggccttgcctgcaccaggcgatgaggattctgctgtccccaagccgcccctctcatgaagacccaagtcttgacaggaactcttgaggagcagtggggtgctggtttagggggctgtggtgtgccgaggggaacacttggcagaggccgggcccacctgggcagggctcgtgaggccgaaggagcaatagggacacaaggccaggagtattagaactgagtgtggtgtcaggcctccctcctcccaggagggctgaggagtcagagcccactccttccctgcgcctgcctcgggctgcttcgtgggcagtgactggaggtgcaggccgggctgctggtcactactgtggtgggaggagatgggtgcagggggccctggggagggctggctcagggtctgaaggcagagcaccgggctgacaggctccctgctgtgggagtcagaggtggctttgaggggtccggcctgaacaaagggaggatggcgatcccagcaagtgagccatccccgaagggggcagcacttaaacatgtggggttggtaaggccctgaggggcatgtgggaacccaaggctgtgccatgggacagaccacatccagactaggaggaggggcccaggtgtggccatctgcatggggaactgccggaggagcgtgagaggaagctgagacctgcccccaggtggcgcccgggtccggcaccctaacaagggcactgtggaggctgggcacggaaggagctcttgctgataggaagcagagaagccaggcggccaggacctcaagaggggctggggcagggcgagaaggggctctccagaggtgcgaggagagcgtacagaccccttggaggcatctggccaggacgagccaaggggcccgaggcccatggggcagagcagtggctcccacggatggaagcggtttggctgaggagcatgaggtggcctcagagtcccccgggttggagcagatgtggtcactgggtgggggagggcacgcctgggacatttgtaccttcaggtgctgggcagccataaggggctgattggacaggtagggctccctgtggggagggaccccagaccctgctggctcctcgaatctcccttcactcttcttggcctttcaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttggaatctgtgaggttttgtgtcaagtcctaagtccaccttcagccaaagggcagttcctggatttgcccctagagaggggggcccagtgttggctgcactcataggctggggcccaggagcacgggttgtggcttaacaaacatgagattcccataatctcaccacggcataggtgcaccaaaacacacattgtgtttgtcctgactgctgtctgcccgctccaaaactgtctccctcagggctgccgtgggggcctgtctgtggctctccgcagcatcttcccactgctctagtctttccctcttgcttgttttcaagtgctgtgctctggaactccaaaatctttgtgtgactagacccagcaagcatctactcccacccaccgaggccctgcatctgaagcagataggaataaagacctgaaacaaaagagaaactccaaaagatcagctaaacagcagcaggtaagaagagaaaatcagtgatcagaatagtgaaatgaccaaacatgcagtgtgaaggaaaggaaagccaagcggggtggctcctaatcccagcacttcagcaggccaaagcaggaggattgcttgagtccaggagttcaacaccagcataagcaacacgggaagaccctgtctctacaaaaaaatttaaaattagccacatggtggtgcatgcctgtagtcccagctactcaggagggtaagaaagataggatcactggagccgaagagcaagactccagtgagctatgatggtaccactgcactccagcctgggtaacagggtcaaaaaaaaaaaaaaagttgaatgaaaagctccagtcaactttttcttttttttttagtcggagtctcactctgtcgcccaggctggagtgcagtggcgtgatctctgctcactgcaacctgtctcccaggttcaagcaaatctcctacctcagcctcctaagtagctgggatttcagctgcacgccaccacacccagctaattaatttttgtacttttagaagagaaggggtttcgtcatgttggccaggctgatcttgaactcctggcttcaggtgatctgctcgcctcggcctcccaaagtgctgagattggagccaccgtgcccggccccaatcaacttctaatgggatttccagagttgaaaaacacaaatattcagctttaggaagcacagttgagtcctgagcagtacaaataaaaatataggctgggcacagtggctcacatgtgtaatcccagcactttcggaggctgaggtgggtggattgctggagtccagcagtttgaaaacagcctgagcaacatggcaagaccccatctctacaaaaaatacaacaattatccgggcatggtggcacaagcccgtagtcccagctactcaggaagctgaggtggatcgcttgagcccgggaggtggaggttgcagtgagccaagatcacaccattgcactccacactggatgacagagtgagactgtcttaataaaaaatatgagtcagcgtataagttaaaaggagttttaaaagatactaatccaaaagaaggcagaaaaggagaaacataatagacttaccagcccaatttaaaagtcagggattacaaacatgaattgaagaagtgagacccagttatgtgctgattataaccaaagcactttacatatgaagacagatgtaagatgaaaataacagatagaaaaaagactggccatccataatcaaaatgtgtatgggtgtttatgaaggggcatttcacaataagcaattgacggcgctaccaacaagaaagtaaacacaggagccctgaacaagcctgtcactcacctggacctgctgggtatttagaacacactctgttggcctggcacggtggctcatgcctgtaatcccagcgctttgggaggccaagccaggcggatcacaatgtcaagagatcaagaccatcctggccaacacggtgaaaccctgtctctgctaaaaatacaaaaattagctgggcatggtggaatgcatctgtagtcccagctactcaggaggctgaggcaggacaatcacttgaacctagtaggtggaggttggagtgagccgagattgcacaccactgtactccagcctggcgacagagcgagactccgtctcaaaaaaaaaaatcactctgtcaacagcaacaatacacttctcagtgttcattacaagctttgtgctgggccacaaaacaagtctcagtaaatgagatagaattaaaatcatgcagagtgtattctctggccacagtggaaattaggactcagtaagatatctggagaaaatgttggccaggcacggtggctcatgcctgtaatcccagcactttggggaggccaaggtgggcggatcacgaggtcaggagatcgagaccatcctggctaacacagtgaaactctgtctctacaaaaaatacaaaaaattaaacgggcatgatggcgggcgtctgaagtcccagctacttgggaggctgaggcaggagaatcgctggaacccgggaggcagagcttgcagtgagccgagatcatgccactgcactccatcctgggcgcagagcaagactccgtctccaaagaaaagaaaaaaaaaagtagcacatgtgatcagagggaaaagacctaagatgctttaaggcggtttaggggaagatgacagcgatgagctgagctcaagtagtaagaataccagaatacagagtgtgacttcccaaataaacagaaggaaaggggagcattgaaaaatcaggatcaacatgttacaaatggtagaaataaattcaaatatagtagaaataatttcaaatcacaatacttgaaaaggcagcttgtcagattggcaaagtgtcaaatgctatgtacaagtttctggcaatacggcaaattatgtatcctgaaaaactaaaaatgctgtttacaatactggggagtggctctaaatccatgagctgtaaggaaggaaggaatctttggaggctgaaaagccagtcaagctcctacatgacatgggagacagacgacgaacccacgagcttcatcccttgagtttattaggcaaccttggtctacactctcaggagaggagtgcaccagaaataaagccaggtgccctggagtccacctggagccaggcgcggggcgctgcacttaggttggcagaagcccgttagcgcgcagctccagcagcggggacagcgtgtagcgcaggcggcgcagcgtcgtctccgaggtgaggctccagagccacgcggagacggcgccggggtccaacagcaccgtccagagcagcgacagccccaggaagaggagcggcagcgtcagcagcacctgcagcgcgcccagcacgcaccgcctgcggggcgaaaggcgggcaggtgggcggcaactcgggcgggcacctgggggaccgcggccgcgcccaccgcccggctcacctgatggccagcgcgcgagggccgccgaacagccgcgtctcctgcggggagagagggccgcatccagctacctccgcgcccgcggcgccggcccggtttccaggaggagggggaggcggtaccgcgggggggacggggagggttgtcccgctccagcccaccccgcccggacccgcgcaggcgctcactcggtccgccctggccatctcctccatgagcgattcggtgctgtactgcactccgcgaagctgcccgtcacacctgcggggacaggcatgcaggtgggagcccatcccggccccacagtgccccgccgcgcccgcaggcccaactcccttacagttcccggccactctgccaggcgtccagctcctccgcagcctccatcaccttcacctgcacctcctggagcgggtgagagtgcggactgaggcctcggggaggcgtcctggcggtgggttgggagacttaccgccccaggtctgggggaggagaggcgggaggcaccttggcgtctgagtggggccgcacctgcaggactacggtctgctcctggaatatggcccaggcctccgctgtctgcagcgcgtcctgggtgtggacacccgggttagactcggcggcgtcggggcgacaggcccttccccatccacactcgaaagcctaccctcctccaacagaacccgcttctgccctcacctgctgcagcttctcctcctgcaaggcgcatttggtctccgccagctccagttcattcttgagaaggacccagggaatgtcaggaggtccgcaggccggcaacccgctgcgcctccgggccccgcccccggccctcagtgcccgcccccaggcgatcatgaccccgcccgcgtcctcaggaccagtcgtaagcaacgccccagctggtcatggccacgccccctccgcgctccgcccctattctagccctcagagccccgcccccatgcgattgtgctccgcccacattccccgccccgcccacgccttcagggcctgccttaagccacacccccaggtggtcacggcccagctcatgctgctgctccgcccctactaaacacctcagggtcccgctcaagcacctgcagcgtcaccaattgggctgcgagttgctgctccgtgctcttctggctctgcagttcccctccgtagtagaagagctaggggcggggcttgtaagggcggggtttaccgggcttctggaggaacgggtgtcaggggagacagggacggggaggcaacaagggcgaggacaagggcaggacttccgagaggaaccaagagacaggccctcccatctcctgcacgtacctgactcgacagctcctcccactgctcctgcagctgcctgctgtgctgctcctgcggacggggtcctggggcggtgccgacctctccgccggtcctacctcaccccacccccggatcctgcccccttccgcccgccctgccccaccccaccctgggtccagccccattccaggactcttcctcaccaagtactccttgtggcgctccgcctcctccagtcttctgcgcacccgctccgcgcgctcccgcgccgcctcgcgcgcctccccttgcagaggctgcgctgcctggcttcgcctccgcagcaggctgcagagggaaactgaggttggcgctacaaggcggactgggtcgctcaggatcccgcagtcgccaggaaggaccagccgcaggctcatgattgaggactgggaagtcctggccgagtcccccacctgggtccgctgggtggatcacccgttcccaagggcctagagcagagatgcgggcctgggcggatcagcctggtactctgcgaagcacctcgcggcgctgcctgcgggaccgaccctcgcgcgcccgccaggtagaggggcgttccccgcgcacctccgctcccgctcgctcaggtcctgcaggcgctggttgaggctctcgctctcggcctcgagcccgcgcatcagcttctctagctcctgcttccgctggcgaccatctcggttatccttctgcaactgcagcagcagctcctgcgtcgcggccatggctgtggagaccgagcctaaatgccgcccgcctcggggacccagcctgcggctggcaggcgtcacaatgggcggcagggagcgcctagcgggctggatcacaatgggcggcaggggaagcccgagcgtagcccgacacatgccccttctcacgccggccggaggcgggtcaggccggatcacacttagtccatcactgatgaaaattgtgtcaaagagccgtaattggatcaatgaaaggttaataaaatactaataccaaatgcaggcaagttgaagattggttcccccacactgcagatggcacttgcaaactgatcgatctcttgtggaaaagaacccataaatatgttcgtagcttttgacccaattatccttctcctgggaaatttatcccagaaaggagaaaaaataatttaaacccactacacactaaatggttcgctgaagtggttacagtagccacaaaaaaaggaaacaattttaatgattaaaatgtgcttgggtattatgtggtatgcctagagctatgatgatgtctagtgaaaaagaatttgatttagcatttatgctaaagtaactaagataaaatacatgagcaagatccgtaaaggaaacaggaggaagataagctctttcattgcttggtgagactgtaggtaaactcgtccttttaagtattattattttagaggcaggtcctgctgtcaccaggctggagtacagtggaacaatcgaagctagctgcagcttcaatctcccaggctcaagtgatccttccgccttagcctcccaacttgtccttttaaaatctgcctttatttgtccagttacaattatgaacttggatgcaaaaatccaaaatacattactaacaaaatctaaagggaaacagaaatccatggaaaccaaacagagtttattccagagattgttcaacatcagaaaatcagtgttgttcaccatatggacaaacagggaagaactccacgatctcaatggcgcacttcaatagatgcagaaaacatgaagatgagggtcaccatctattaataattttttttttttctgagacagagtctcattctgttgcccaggctggagtgcagtggcacaatcttggctcactgcaacctccgcctactgggttcaagcaattctctgccccagcctccagagtagctggcattacaggcactcgccaccacgcccagctaatttttttgtatttttagtagagacagggtttcaccatcttggccaagctggtcttcaactcctgacctcgtgatccacccacctcggcctcccaaagtgctgggattacaggcctgagccacctcacctgaccatctattgataattctaaaagctctaacaaaagggagagataaaagcactctctagtctgataaaggccacagtaaacattatagtaaggaggaagtattaatagtatatgcttttttttgcttttttttttttttttagagtcagggtcctgctgtcaccctggctggagtgcagtggtacgatcaaagctaactgcagccgcacacttcagggctcaagtgatcctcccgcctctcaccctttaagaagtagtagacggccgggcacggtggctcacgcctgtaatcccagcactttgggaggccgaggagggtggatcatgagatcaggagttcaagaccagcttggccaagatggtgaaatcttgtctttactaaaaatacaaaaaaaaaagttagccgggtatggtggtgcttgcctgtagtcccacctactcgggaggctgaggcaggggaatcgaacccgagaggcagaggttacagtgagccgagattgcaccactgcactccagcctggtgacagagggaggctccatctcaaaaaaaaaaaaaatgtagtagtaaaggccaagcacagtggttcacacctgtaatcccagcactttgggaggccaaggtgggtggatcacctgaggtctggagtttgagaccagcctggccaacatggtaaaaccccacctctactaaaaatacaaaaaattagctgggcatggtggcctataatcccagctactcaggaggctgaggcaggagaatcgcataaaaccaggaggcggaggttgcagtgagccgagatcgtgccaccgcactccagcctgggcaacagtgtgagcctccatcttaaaaaaaaaaaaaaaaatagtaagaggctggccacggtggctcatgcctgtaatcccagcactttgggaggcaaaggagggcagatcacgaggtcaggagatcaagaccatcctggccaacatggtgaaaccccatttctactaaaaatacaaaattagctgggcatggtcgcgagtgcctgtaatcccagctacccgggaggctgaggcaggagaatggcgtgaacccgggaggcggaggttgcagtgagccaagatcacgccactgcactctagcctgggcgacagagcgagagtctgtctcaaaaaaaaaaaaaaaaaaaattttttttgtagggacagagtctcactttgttgccctggatggtctcaaaattctagctacaagtgatcctcctgcactggcctcttaaagttcgtaatgctttgctcttttaagtttgtctctttgtgaacatgtaagaaactacggggccgggcgcggtggctcacgcctgcaatcccggcactttggaaggccaagatggacgatctcctgatcgaggccatcctggctaacacggtgaaaccccgtctctactaaaaatacaaaaaattagccgggcgtggtggcgggtgcctatagtcccagctactcgggaggctgaggctggataatggcataaacccgggaggcggagcttgcagtgagcggagcttgcgccactgcactccagcctgggtgacagagcaagatccatctcaaaaaaaaagaaaaaatttaaaatgagctgggtgtgctggtgtgcacctgtagtcccggttactcagaaggctgagctgggaggatctcttgggcttgggagtttaaggctgcagtgagctataatcatgccaccacactccagcctgggcaacagtgagacccccaactcaatcaaccaatcaaaaatgtcttcagatcgggcgcggtggctcacacctgtaatcccagcactttgggaggctgaggcaggtggatcacttgaggtcaggagttcaagatgagcctggccaacatggtgaaaccctgcctctactaacaacaacaacaaaaaaaaaaattaggttgggcgtggtggttcaagtgattctcctgcctcagcctctcaagtagctggactacagacgcccaccaccacgtctggctaatccttgtattttcagtagagatagggtttcattatgttggtcaggctggtctcgaactcctgacctcgaatgatccacctgcctcagcctcccaaagttactgggattacaggcgtgagccaccacacctggccaatattttttaattttaattttttgttagagagaaaggatcttgctctgtcacccaggctgaacttcagtggcttgatcctagctcactgcggtcttgaaatcctgggctcaaggaatcctcccacctcagcacccccagtagctgggactacagcatggctgattatttttttgtagaaatgaagtctcactatgttgaccaggctggtctcaaactcctgggctcaagtgatccactcaccttggcctcccaaaatgctgggattacaggcatgaaccacccccgctggtctttttttttttttttttttttgagatcgagtctcactctgttgcccgggctggggagcagtagcgccatcccagctcactgcagcctcgacctcctgtgctaaagtgatcctcctgccttgacctcccaaagcactgggactacaggtgttaacatttatttttaatttttttatttttgagacagagtttcactcttgtggcccaagctggagtgcaatggtatgatctcagctcaccgcaacctccgcctccagggttcaagcaattctcctgcctcagtctcccgagtagttgggattacaggcactcgccaccatgcccagctaattttttgtatttttagtagaaacggggtttcaccatgttggccaggctggtctcgaacttctgacctcaggtgatccgcccgcctcagcctcccagagtgctgggattacaggcgtgagccaccacggctggccaggcattaacatttatataaactaaatacacagggtgagtacagacggttggtaggacaaggaggaggatgggatcagaaaggaggcggcgagagcacccaccagggatgaggacaagggacatgaatgctgtgcaccaggaggggacattctgcagatgaaaactctgcaggtcagaaggagagtttaggacgcctgctacaaccaagcactgggtcccctttcactaatgttgagaaatgcaagcaagactgaaggtattttggttacttatagtggactcaaaacgaccacagattgtctacagttctcaccaccagtaggtggagcctgtttccccagctcaggaatctaggctcacccttgggtcttgctctgacaaacaagatgatgcagaaaagactttgtgggcctccagagcgtggacctcagagcctttatagcccctctcacccccttattttttttttttttctgagacagagtcttgcttggttgcccaggccagagtgcaatagcacgatcatggctcactgcggccttaacctcctgagaccaagccgtccccgtacctcggcctcccgagtagctgggactggcagcagcaccaaccagcaggcatgccggcaaacccccagcccccagccagccctgggatgactgcagcttggccagagcacccaggcaaggtctgcagaaccttttgagcacaaggcctgttatgcagcaaagaattactggacgtttgtattattcgcaaaggattactagtgactaaattgtactcctatgaatgtgacactatgcagcaaccaggtgactggggtggggtggctttacatgagctattcttgccatctcatgttataattggtcccctagtggtcaaagttgaggtgggggagaggtggggcggggacagaacacagggagaggagctgctgcatttcagcccccacctcactgtgcacacgacttctgtgagcgtgttcagtccttacaacctaaaggagctggcactgaaggcttccatttacatagaggagggacacgagggtgcatgtgtcctgaagctccaccaccacccttggattcacacccgaaggttagaaaggtgctatctgccagtgctgggcctggggaaagccatttaggatctgctgcttctctttcagataaactttagaactgtcttgtcaaattctcccaaatacattgttgggatttgataggagttgcaaaaacaaagcctgtatgtgaagcgtatatattaaaagggaagaatgggctgggcacagtggctcacacctgtaatcccagcactttgggaggccaaggtgggaggaccacttgatcctaggacttccagaccagccagggcaacatagcaagacccctttttaaaaataaaatattaaaataaaaattttaaagggaagaatggacactctccatcatcaggtattggtcccaggaacagagcattcccgtccaatcccacaagtcttgcctcaggcctcctacaaatgtgctatttccaaatgggcttttggcacatttatcaaggctatgcctatgtcacttgtttcccgttactattatgaaaaggcctttctgaaaatttcatttggaggccaggcatgctggctcatacctgtaatcccagcactttgggaggttgaggtgagtgcatctcttgagctcaggagttcaagaccagtctgggcaacatggcataacctcatctctatcaaaaatacaaaaattagctgggtgtggtggtgtgcgcctgtggtcccagctactcaggaggctgaggtggaggattgcgggagcccgggaagcagaggcagtgagccaagagctacactccagcctgggtgacagagcaactgtctaaaagaaaaaaggagaaaattgcatttgggatatacatattacaggttaaattgggtccccccgaattcatattggagtcctaattttcaatacctcagaatgtggccttaacttgaaaacagggtcactgcaggtgtgattaagatggggtctcagccgggcgcggtggctcatgcctgtaatcccagcactttgggaggccgaggagggtggatcacaaggtcaggagatcaagaccatcctggctaacacagtgaaaccccgtctccactaacaatacaaaaaattagccgggtgcagtggcgagcgcctgtagtcccagctccttgggaggttgaggcaggggaatggcgtgaacccaggaggcggagcttgcagtgagccaagatcgtgccactgcactccctcctgggccacagagcaagactctgtctcaaaaaaaaaaaaaaaaaaaaagatggggtctcattggagcagggtgggaccccatccaatatgactgatgtccttatgaagtaggaacttggccacagacgacacgcacacaggccctcgaggaaagcgccatgtgaaggatggagttccgctccagaagccaaggagtcaccaggggctacgcaaggggccagactcagagcctcgccgagagcctgcaggcgagcatggtgtccactgcctccactgtgagatgtgaacacctgtgctgcagtggccgcagggagccagtcccgagggtcacaccgtgatgtctgtctgcaagggcccagctgctcttactgaggcctttccagcgcagccgcctctccacattagagaggatcagcctgggcacatggcttgtggtagaaggccctgatcacaccacaaacgcagagagcggcttgtgatgctcaggttttcatggccacgtggcttcagcctcagcaaggagggcaccgggcccacgtccgagggtttacctggggatgatcacagtgaggtgggtggctcaacaggacctcacggcgctggcctgggagtggtgggctctgcaggccagagctgtctagacgggcagtttgcctctggagtcttacatgttcacttcttccatagctccggctcgtatcctcttctcccatggtcttggagcgtccccaccatatcctgttggggaagcatcatgacccttttctttttgagacagggtctggctctgtcacccaggctggagtgcggtcacacaatcatagctcactgcagcctccaccacctggactcaagcgatcctcctacttcagcctcccacatagctgggactacaggtgtagccacacccgctaattttttttttttctttttggataatcttactctgttgcccaggctggagtgcagtggcacgatcttggctcactgcaacttctgccttccggttcaagcaattctcatgcctcagcccccaaagcagctgggattacaggcacatgccaccatacccagctaattttttttgagacggagtttcgctcttgttgcccaggctggagtgcaatggcgtgatctcggttcactgcaacctctacctcctgggttcaagcaattctcctgtctcagcctcccgagtacccagtattacaggcacccgccaccacccagctaatttttgtattttttagtagagatagggtttcaccatgttggccaggctggtcttgaactcttgacctcaggtaatccacccgccttggcctcccaaagtgctgggattacaggcgtgagccactgcacctggccaattttttttttttttttttttgtatttttagtagagacgaggattcgccatgttgcccaggctggccttgaactcctgagctcaggcaatccacctgcctcccagagtgctaggattacaggcgtgagccacagtgcccagcctcaatcacacccagctaattaaaaaaaaatatttaggccggcgcggtggctcacgcctgtaatcccagcactttgaaaggccaaggcgggcggatcacggggtcagtagatcgagaccaaaacttttagtagagacatggttgcactgtgttgcctaggctggtctcagactccagggctcaagcaattcacctgtctcagcctcccagagtgctgggattacaggtgtgagccactgtgcctggctgtaagaaactatctgatgaaaaggaccaggtggctttaagcaatggtaacaaaatattaacttaaataataaaatctgggccaggtgtggtgactcacccctgaaatccccacattttgggaggctgaggcaggcagatcgcttgagcccaggagtttcagaccagcctgagcaacatggcaaaacttcatctctacaaaaaatcaaaaaataaaaaaataaaaagctgggcatggtgtgtgtgcctgtagtcccagctactagggaggctaaagtgggaggattacttagcccaggaagtcaaggctgcagtgagccgtgaacataccactgtactctagcctgggtgatagagtgagaccctgtctcaaaaataaaaataaaaataaaatctggttgggcatggttgttcacaactgtaatcccaacactttgggagtctgaggtgggaggactgcttgaacccaagagttcaagaccagcctaggcaatatagtgagacctctacaaaaaaaaaaaaaaaaaaattaaattagccaggtgtggtgcggcattcctgtagtcccagctactcaagaggttgaggcaggaagactgcttgagcccaggagtgtgaggctgaagtgagccgtgatcgtgccactgcactccagcctgggcaatgaatcatgaccgtgtcttaaaaagaaataggggctggatgcggtggctcactcctgtaatcccagcactttgggaggccgaggtgggtggatcccgaggtcaggagttcaagaccagcctggccaacacagtgaaaccctgtctctattaaaaatacaaaaattagccaggcgtggtggtgggcgcctatagtcccagctacttgggaggccgaggcaggagaatcgcttgaacccaggaggcagaggttgtagtgagccgggatcgtgccactgcactccagcctgggtgatagagggagactccgtctcaaaaaaaacaaacaaacaaacaaaaaaaaaacaccaggtgcggtggctcacgcctgtaatcccaacactttgggaggctgaggcaggtggatcacgaggtcaggagatcgagaccatcctggctaacacggtgaaaccccgtctctactaaaactacaaaaaaaagtagccgggcgtggtggtgggcgcctgtagtcccagctactcgggaggctgaggcaggagaatggcgtgaacgcggggggtggagcttgcagtgagccgagatcgcaccactgcactccagcctgggagacagagcaagactccatctcaaaaaaaaaagaaacagtaaaaaaaaataataataaaatccaaaatccttgcctagggcagtcaaagtcctccagccttcgggccctgccagcctcacggacctcagccatttttccactacagccagaatgaactgtgttttatttacgcacttattgatttttgttttagcattattgggggtcagctgtccctgacttgcccacttgccacactcagccaagtgacccttgcgctcctggacactgtcccctctggcctcgcagccattcctcttcaacgcggcacccccacggctccctgggtgagtcctgctcttctcccactcttccgtgtaggcgtagaaaccctgatgctctccttacctcccctccgcctcacacccttcctccagcctgtccccaagccctcgagctcttccattgcaaactgctggcccatctgcaccttacttcctcaggagatgctgtccacctcagcctgattgccacacagagtaaacgagctgatgtttacaaagtgtcagtgactcacaagtgctcactaaacagctttaaataaaatgtgaacctccaagttctgacccctgcttaccaccttcaacactatggctctggactgcaccattccgagagctcctaaggagcctggctgcccccaccttgtcttcctccagcagccagtagggcctctcagaccttcagagagcacaagtccaaaccccaacatggctcctaggcccggcgccgccaggaccgctcctgccgctgtgcagtctgctgctacaggcctctgtgcctgctcattcctctgcctagcccctccctcacttcctatggcctcaccctaatgccatttcttgggaagccttcccaggccactcatccccaattgcaacagtgtccccacagcactcagcactaccaaggatgctttcctttatttatttatttttttgagatagggtctcactctgtcatccaggttggagtgcagtagcataatcctagcttactgcagcctccacctcccaggctcaagcaatcctcccacttcagcctccccaggtagctgggaccacaggctgagcctccgaggctggcctgtcttccccaagcattctaggatccaagagctcacggaccacatcttgtgcacctttccctccattgacaaacccagggcttggaaaaccacacacactcaaatgctctgacacctgaatggagagccagcccgtctgcacctcagagacatggcatctgtccaaggcaaaggccgctgccagttggggctgggattcaaatgctctgggctcctttcagctgacctggaggtgcggcctgctgatcgagaagcacgggatggcctgatttcacagcagggaccctgcaggaggcaactcattgttaccttggccagaaagaggagctgaacatgaataggcaaaaattccaaatcccaaaatcgctggggactgagtttttttgtttttttgtttttttttttgacatggagtcttgccatgtcgcccagggcggagtgcagtggcgcaatctcagctcactgcaacttctgccacctgggttcaagcaattctcctgcctcagcctcccaagtagctgggattacaggtgcctgacaccatgcctggctaattttttgtattttaagtagagatggggtttcgccatgttggccaggctggtcttgaactcctgacctcaagtgatctgcccaactcggcctcccaaagtgctgggattacagatatgagccactgcacctggccatgggggccgacattttcttaaatccactggtcagcggcattaggggaggccacctggctcagaaagtgtctgggcacagggacaggtgagcgctcctcagccatctgcccagggcacggttcttggtagcaccaggcgcactgagaaagacacctgggccctgctggtggcccagcctcttacactgccaccaaggccctccagcctcccgtctggtctccacagcacagaggctagcctttgcgtgggaaaggacgcagcctggcactgcagggagaggcctcggctgctgcacccctggccagttctggcctcctagggagcctgcagccctgcctgcctttcccaaccctggtccccatgtggccccttgatgacttcttccttcagcatggggtctgtgcagcttcctgctctgtggggggcttcctgccacctccccgttggctctttccgccccagcctggagcagtggaaagggtaagtccggcctgtgccgcgtgggtggacagatgaatgcggcccaggccagggggctgcaagaccaagtcccagccacccaagcctagggcttacacgtgtccacacactcttacgcgattgtggaaaggtgatcagtatggatgctgcacactaccttacagcacggtggaggcaggggcagcatcctgccactggcaaaagtaacattttacagcacaacaccagggacctttaatgacacagtctgattttacccaggtcatttcgagaaaaagcctttcacaagcttccttctacatttgctgtgcaacttagtgaatgtcctttacaaagtcctattggaggctgggcacggtggctcacgcctgtaatctcagcactttcagaagctgaggtcggcaaatcctgaagtcaggagttcgagaccagcctggccaatgtggtgaaaccccgtctccactaaaaatacaaaaattagctgggcatggtggcacgcacctgtagtcccaggtagtcgggaggctgaggcaggagaattgcttgaacctgggaggcggaggttgcagtgagccaagattgcgccactgcactccagcctgggcaacagagtgatagtcagtctcggaaaaaaagaaaaaaaagtaagtcctgtgggaaacatttcttggaatatttagcatggggacacttccttttgtactaagatgaaaaccacctccaattcccacttcccgacctttgctttttcacatccctcctctttttgggagcagggcagagggacaccttgggcacgcagagccaaataggatgctcagccacacattttagccccctggaaagcatggcagctttctcctattcctgttcttttactgtgtcaaacattctccactccatagaagacttttactgcaatccacctcaaatggcttttggaaaacgacttatttttttttcttttaaagatagagtcttggctgggagcagtggctcatgcctgttatcccagcacttcgggaggccgaggtgggtggatcacgaggtcaggagatcgagaccatgctggcaaacacggtgaaactccgtctctactaaaaatacaaaaaaattagccgggcgtggtggcaggcgcctgtagtcccagctacttgggaggctgaggcagaagaatggcatgaacctggggggcagagcttgcagtgagctgagatcgtgccactgcactccagcctgggtgacagagcgagattctgtctcaaaaaaaaaaaaaaaaaaaaaaagagagtctcactctgttgcccgggctggagtgcagtaatgcagtcatggctcactgcagcctcaaactcctggggctcaagggagctttctgcctctgcctcctgagtagctgggactatagatgcattcacctcacctggctgaaaagctggtttttgtttttgttttgagacaggtgtctcactctgttgcccaggctggagtgcagtggcacgatcttggctcactgcaacctctgcctcccgggttcaagtaattctcctgcctcagcctcccgagtagctgggattacaggtgcccaccacaatgtctggctgctttctgtatttttaatagagatagggtttcgccacgttgaccaggctagtcttgaactcctgacctcaggtgatcagcccacctcgggcctcccatagtgctgtgattacaggtgtgagccatcacgcttggcaaagaagcaaggttttttttttgagacggaggctcgctccgtcgcccaggctggagtgcagtggcacaatctcggcccactgcaacctctgcctcccgggttcaagcgattcccctgcctcagcctcctaaggagctgggactacagaggcgtgccaccacccccagctaattttttgtattttagtagagacggggtttcaccatgttagccaggatggcctcgatctcctgacctcgtgatccagccgcctaagcctcccaaagtgctgggattacaggtgtgagccaacgcacccggcagcccagctaattttttgtattttttttgtaaagacggggtttcaccatcttgccaggctggtctcgaactcctgacctctggtgatccacccgcctcagcctcccaaagtgctgggattgtagacatgagccaccgtgcctggccataaatgaagttttactggaatatatccatgctcatctgcttacatatcattggtggctacttttttttttttttaagagttttgctggtcgcccaggctggaatgcaatggcgtgatctcggctcactgcaacctccgcctcctgggttcaagcaattctcctgcctagatggaattcaggcacccacaaccatgcccagctaatttttgtcttgtttttgagacagagtttcactcttgtcatccaggctacagtgtaatggcacaatctcaggtcactgcaatctctgcctcctggatttaagagattcccctgtctcagcctcccgagtagctgggattacaggcacccaccaccacacctggctagttttttgttgttgttgttgtttgtatttttagtagaaaaggggtttcaccatgttggccaggctggtctggaactcctgacctctggtgatccacccaccttggcctcccaaagtgctgggattataggcgtgagccattgcgcctggccccactgatggctacttttgcactatgacagaaggctgagtagtcacaacagagatggtgttacctgtagagcctgaaatatttactatctggcagccagaggcagtggctcacacctgtaatcccagcatgctgggaggccaagaggctcacttaaagccagaagttcaacactagcctgacaagatggcaagaccgtctctacaaaaacaaaaaaaaattagctggatgtggtggctcacacctgcagtcccagctacatgggaggcggcagtaggaggatcagttgagcctaggagtttgaggttacagtaagctatgatccactgcactccagcctagacaaaagctggagtaaatatatatatatgtaaatctatatgtaaatatagattttatatatctaatataaatatatatatttttacaatctacttaatagaaagtttgccaacctctagatcaaactacacattttacaagtatttggtggatataaattagggagaagagagtataaatgaactaaaatccttattgataataagtccagactccaaaatggaataagacagcagtgtaagaatactacttagacacatagagataaatgcagaagaaagtgctaaaataattcaaagtgattggctgtatagtatgggatggagttggggagataaactatttttgttttaagcctttttgagaaccatttaattacttaaattctattcaggaattactttgataaagccaaaaaatcattttaaagcaactgaacagaactcaccaagacttagagtagctgcgctcaagttcttctggagtctggggtcactgggttcatctccggctgccaggagccaccagatgtctgcagtccatgccagaggtctaaagtggcaatcaccctccacccctgctcctcctcctaggtcttcacacgaggatccccattccgggtggtccctggggattaacattaccccttttccttcctccctcccctcccctcaggccaagcaccaggaagcagcagtgggcagaagggagcagccctcgccttgccccagcccttcctcagtcccaactgagccactccaatgaggggtcccaggcactgggcagccatcctcctctccccagtcaccaggtccatgctgctgtaactgcacacacatcgctgcttcccagacagcctcagctaactcaggccaacactgcccaagaggatgctgaccccaaagtgctagttccctggcacggtgcacacccccaggacccaccaagcaccactgaacagtggcaggcagatgcccatcccagaccccacccttctaagacttagaagccgtgtcactttgctagagagaacagccaaagcagaatatggaggtcccacaccagagttttcaatcaagcttttaatgaaaagatcataaaataacagtttcttatcgctgtacatttaagactgcacacttctgaatggagagatcagtcgttggtgaattgcttttctatgacactgggcagctgtgtagctgcagctctgacctgaatttatacaaactctcaagggacatgaactcaatgtgacaagtgacagcggcggtggccagtacaggagtgcgatcccggtgtccctccccccttctgggaagggcataaaacaaaacatgatccctcttccagttccaattaaacaaaacagctataaccccatccctcccccctccccttcgaggtatttgcgagaaatgagccagtgcccaacctgggtcccccccggggtgggagagggcagagggaagctagtgatgggtggggtagagaggctcccctcagcacctggccccacggggcccgccaagtggagggtgggagccctggggatcctccctgccccagtgaggtctgttatgcagcatttttgaggtcaataaattacagcaataaatagcaaggtgaggtagggggagggggtcctggtagaaagttaaagtggggtgactgaagccggggcatcctaggaagggggtcctgggcagcctcagttcccaccgctcatgcccacccccaccccggcgtggaatgtcagactgaggctccagttaggtccctccccagccctcactcctggcgtctgattcacaggttcagtaacatctgccccaacggggttctgggaaataggaggaccttggtccctttagggggcatgccagggctgagagcccttgtctgctctaaggcctggcacctttggcttttgtcccccacgcctgggggtggacggatgcagcctcctgctccctgagccctgccctccggctgcccaggcctcaccccaactcaggatggccgcaggagggcagggggtcagcctgcccagcggcccagcccggatcgcactcctgcacagggcctgaggtccagtgaatactgacggattttgggagtgggtgggcggcccggtgcccccgagtggtgatgaacggtaaacacacagggctgcctgaggtggggaaagttggtgagggtccggatcgttcatttcacaggctgaggtgtatggctatgctgcgagtctctgagattcttatttgcttaaaggttcatcttttctcttccttttttttttgcaatcctggaggagcccttgctggggctcggtccggcgggagcatgcagtggcggagcccggcctgccacccgctcactcgccccaagtctgagaaataaatacattcatcactgcacaaacatattgatacaaaaacaacactgttaagagtgtttgcaccgtctatgttggtaaggaccagacccagtcagccccttccgctgcctggggtggggttagggggccccaggagtggggacccaccagagtcgacagagctgcgcaaaggtcccggctttttggcttgagtgggaccctcgcatcaacccatccccaagggtcacgggcagagcagcagggggacccaagcccagactcgggtcctgtggccagaactgacggccatccccgcgtaggctagctggtcaggaccagcatggtccggccagagggccttgggggctggtcagcacgggcccaagctctttggtgccagctgggcttggaggggccctgggaatggggacgagggctcaggtgactccagggaggcttccaatccctcccccagccccagggctacccttctctgcccgtgagccactccagggccaactcagaagggtttccagcagcaggggagggttccctggactggccttacagctgctgaggtctgaaactgtaaaagcttatgtaaacaatgagataaatatattagcatcttttttctgagcccatggaggttccatactcattcaaaatgtgctttggtttaaaaaataggctttgtgaatttgggtatgagcttatttttttttcttttttctttgtttatcctctctttcctacatgatatctgctattttctgattcctgtttctctgaaacattcaggaattaagtgacgaacgcagagaactgtaagccgccttggcctccaataacccagtttccttgtgaggctcttaacatctccacacacacacactcgcacacacctgatgtggaaatcaaaggaaaaagaaaacaaagccaaatgttgtgttaatcccgccccgccccacaaacccttaaagtcttaaataggaaactagtgttctgctttctcattaaaacacagaaaaggctcgatacaatactaaggtggatacaatactatgtcgcacaaacgtcgttgagtgaggggcctctgctcccagtccctgaagttctgcaaaggaatcacctactttcacgagtcacctcacagatgcggctgcccacagcccgggaggccatgcacacggccaggcgcgtgaacatttcccgtgcggtacagactttgtgtcatgtggcttaagtgctgatggggcggggtggcgtcaggacggcaggagccccctcactgagtatgggtgaagtccatgggtctcctccccccaggtccctagcctgacttgctggaacctgagacccagggtccagtcctctgtctcccaccaggagggaagaggggccatcttaggctgggatcaccacagggagggctcagccaggagcctcatctacccaagctccctcacccccaaaagacgccgctcaccacttgggtccctgaactcaggctctgtttttagctggagggtctctagaggggtgggggtaggggatgactctgtatttttttggtctaaacttaaaatagaatgaaaagagagagaaaaaaaaatggtgaagcaagatgacaataaaggctgccagcccagccccacagcttcagctggctgaagacagtgggactgagatcagcaaccttggtctgaccttgagagcccacttcagggcccacagaagtatctgaggctggctaattaccaagatgaggggcgagaggtgggccccgagacagtggccgggggccaggactgctcagggaagtgccatccctgttccccggggggccctgtggtcagctctctcaagcttaaaactcttgcaggaatggaggataggagtggcaggatgagggctcacttccgcctcaccctggccgggagctgcaaagacctgccaccctcctcatggttcccctgtcagcacccagtgcctggctccaggctggggcctcacacccctcacctataccacagaggtttgtgtgcccggggtgccagggtcccctcgaggtggatgtggccaaaggctcaaagggaaaacccacaggtgagctgcaggcactgggccacttggcgccctgctggctcctgcacacgacttcctaggtgctaagcgaaggaaaacaagagtgtcaagggcttccactgccagtcaccaacatatcgttgtcatgaattcaagaggtagcaaaaggtcagaagtctccaccttgttcagcgaggaaggagggaaagcgaaacatctgcccatgcatacggcacacaccacacatagacacacacatacgcacatacacacacacacacgcacgcacacacaaatgaaaacaagagtaccgacggccccggcattgagtctagcctccccccaccccccggaaccccagaccttccagttcaaacagtcacataaacgttacactggtttttctcttaataaaaaacaagtacctctaaacaaagaatattccttggaaactacaggaaaagcactctcccctgaggcagccgaggcagggctcagggaccagggaagcctttgggcaagaagggcttctggggcctggagaggtggcgcgccgacacccctgcagcgccagagccgggggacgcgcaggagtgccagcggcccctgttacattcagtcttcagacccaggctcagccccggagggggcggaaagaaaataagctattgtctgttttggtttaaaaaacaaaaatcaaaaagaaaaacagaggaacagatcagtaggaataacagcaacacaggcccagagggctctttagatgtagagaggtaggcggtggggtcaccctgactgtcccagcgccagtgaacagtgccaccctggctcaaggagggagggatctgcacccccagcacctgttccctgcagaaccagggctgcacgcgcccgcacagacacaagcacacgtgcacacacacagacacggccagcggggtgaggcctgctcccgacaccaccctggccgtggccagcgtcccactgccctttctccaagccgcctgcaacaaagggaccaggtcccagcgagacccacgtgacccagcccacaggccctgcggtggcccccgcggggagctgggggcctgggtgggatggggaggtagacgggctgggacccctggcttccctcctctcggctctgcttggtacggactgtccattaaagctctgggtgtgggcagtgggggccagaggggccacccggagcctccactggacccagggtcttgcccctgctgctgcatcacctcgcttctccttccatgggttcccggggagcaaggtggcagagggcgcccgcgggtctttggcttctaggagggggaggtgtgcatgcgcaggtggctgatgaggttgcgctgctgggtgaacttgcccccgcacagctggcactcgtaaggtttctcgcccgagtgcacacgcatgtgctccgtgaggcggtactgacgggtgaagcgcatgccacactcatcgcaggcgaagggcttcaggcccaggtggctccgcatgtgacgcgtcatggtgccgcgctgcgtgaacattttgccacagatgttgcaggggaagggccgtgtcagccagtgcgtcttctcgtgctgccgcagcgtggctgggtccttgtaggtcttctcgcagaccgaacacttgaagggccggggctcagccgtgtaggccgcactgggtgctgacaggtcctcggcctcctcctcggcacccccactgcctgtctcgtaggccccctcttccttgatgaacagctcttcctccgtgtgagtctccacgtgcgcattgagctgctcagagctggggaagcccttggcgcagggaatgcacacatacaagttgtccccgtaggacaccgtctcgtagccctcctgccggtacatgtagtgggcgctggcatggccgctgcccccctcgctcccgctctgcgcactgtcttcacttgcatccttgccgttctcctcctcctccttgcaggggtaggggggctccccatagggcccgctagggccagccccactagccaggatgccattgggaaccctgtccccgaccccctcaccctcctctcccgggcagggacccttgggccctgcttctctccgctcaaagggggagccagccacaggctccttcttgccccactccttcttccgagtggagtgccggaggctcttccgaggctgcccaccaggcgcctccagcaggctcaggtggttgtcctcggccccctccagatccatgggctcatcaggggtgccccccagctcagaataagaggcactgttggcaacgggaggagcagaggccgcagggggcgagccatgttggctgtcgctcagctgggctgcgtcatcgggagtgaggtggggacctggggtggcagggggcaagggtgggcttttcttggacaggtccaagcccagctcctgctcgcagcccccgctgctcccgttggtgctgctgctgcagccccccagacccgcctccccgccagctgggcagacagcccggcccagaccttgcacgctatcctggttagagccaccaagaaagagttcatcgtctgagcctttggcttgggggagctcctggggggcgtgggcccccttgcgcccatccacgagcccctgataccgagcttggatgacagaggccgtggacagccgctggctgcgggggggccgccccatgccagtggaccccgccctcccagagccaaagggcttgccggctcgcttgagtttgcggcggcagagggctgccaactcgggcagctggaggtagctggcggcagtgaggagggtgctgaagttgggctcggctggctggtcgctgggcagcagcttgcctgtgtagatgaagtccaagatctgctggaacactgtggagctgaccatgtctgtgtccaggttgatgaggttgtcgtgcaggaccagggacttgaaatagatgctgctggcggctaggacgttcttgtgggcccggaagatggagttctccaccatgatgatgacgtcacacaggaagcccttggtcctctgctggttcagctgcagcaggagctgcttcgagtggctgggcagctccatgtcgggccccatgtccccgcgccctgcccacgcgcaccacctgtgggcaagaacaggcacgcatgcgtcagatgactggcacactcggaccagggctctggggcagggtggggctcgacgaggcaaagggcctcagaactgaccccacatagggcaggagcccctgcggcacagtacacggcacataagcccacaatgcccaccacatgcaggcgcagtacacgtgtcacctcactgaggactcaaactgagaagggacagaggcccctgccccatttgcactaatgagaaaatggaggtggagggtgatgaggggacaaatagagaaactgggatttgcatttggtttcacagcccgggctactgtctctacactaaatgaagtcaaccctcagggaccagaaggggacccaaaaatgaccagatggctttaaacttcgggaagcagaggactccgtgagaggagcttgtcttgaaagctggcaaaaatcccccaaaactaaatggtggttccttttgaaatacggcagggcccaaatcaaactgccagcagtcatgttgctgcctcccagatgctgcagtcagcctgcagccagccctgcctctccccaaggccctgggctgcctcgcactctgggcgggcgccaagtgctgccccagcctgggcttccagctgccaaggaggaaaggtagcttaggccaagcacctggcaccacctgaaccctccgtcctctctaggaagggcagcaccatctgggcctaggaaaggtggacagctggcctccatcacacagaatggcacaggcactaactgagatcagtaagcaagaagcacactgacgccgctggtctctgcaggaactctgacggcccaggtgtgttcctgcttatgcagcagcaagacatggggttctgagcgggtgctcctcgccacgcttcccatccccactgagcagcctcctctgccatggaccaggcaccccacagtgggagtacaagggcagggcaaatgggtgcacagtgggcaccagatagacgccggggggaggagggaaatgtccctccaagggcggaggcaaggactgtggccggcggtataaagaatgactctggaaggctttgaatgactcaaagccatcctcagccctaagcccaactccccagtacaaaacgcagtactcccagctccatcctctcacccctaccagagtccctcagagaatggctcagcaggagggtgctggggaaggcatgccagtgtccaggtggccacctgtgccccggataggctcacaggcttccacagggcagggggccagtgaaaacatgaactttcctcatggctgacggacaaccgagcagcggggcccacaggcagctctgagcctcgcagttcagggtccagtctctcagcagctgaactactctgagcccaccgccctctgggatctactgcccctcccagagtgtccagccctgcctcccagagcagaggcctggaaagggtcccaccctacccaaccttctcatgacagaaactctccccagcctcatgcctacccttgtttgcaaagacaaagaaaaaccctaacattcacaggcccctgaaggtgccagagctcaatgtgaacacgcaagggtgcaacacagcctggaacaccgctggcactcagagcctaacagcaagaggcagcaagcacccgccagcggctctctgcctagcagcccagcccacagcagttcaggagggtgctcatgggctggagacttcgtgaaccaatcctcctccactccctgcccgcctcaacccaccaggcagggacaaagagcccccaaggtgtggcttccacacttggccccagtaacctagcccccagaaaacatcagtgccggctctgccagcacccagacacctggtaccccgagactggcaaggggactggaagagggcagtggcctccaggctccctccacactgcccagtgctgtgtgcacacaaaggaccacgggtcagacagatagaggccgagctgtggggctgtgtgccacccagaaactccggggaaaggggccagtggcggtcccccctcccctgcgcctcaccggagtgccaagggcccagacaccatgtgagcagcagccagcggcggggggggctcctgagcgcgtggccttcctgggggtgcatcaatgcctggtcacctggggaagagaagacgaacacagtcacccagacagccatcagcgaagaagggagggaagggcgatgaagggacgcacctgggggtctctggctggggcaccaggggcagcccagcaggagactgtggccacagagcctggtagttggatctgacagccaggaagagtaaggaccagcgaacaggtctagggagttcggtgggtgcaatgcctgcccctctaacacacacaggagattaaggacacccaggggccacctaggccagggggcgctggtggcagacacacaattcttggcctgcgggtgtggtagcaggaggcctgggcagggcccttcccaagctggccacatttacataacaaaaggtcaaaattggagccacttgtgcaagggctatttataagaaccagtctcaaccgcttttggctcccccgttccttcccttcctgatctgctctcaccgcctccctgcccagagggcccagccccctagcccgcctggcctgaccacatggccttccctctccagaggtttcactgcctaagggctcacccaagctgcaggcctgggctttcaataccggcccaccaaagccttgggcagctgccgccaggaaacgaggggttccctcccacccccagagctctgggtcctgcaggaggggggatcctgaggtggtgggtccttgcaccccacacctgccagcctgggcccccacggaatagagccggggtcggggaaggggcgtgcagcggcccgtccccgtttccccttcccccactccacccccagggccagggaggctcagcaggtccctcaggaatgtgaccagacccggggtgccggcccagagctgggaggcctaggctgcagctggccagctgtctctccagcccctagtgcagctcccctctgggtggggggtgtgaggggagggggtgcatggctggtccaggaccccaccaaaggcccagagggcagcagaaccagctctgttggtaggaagcccaagggcgtccacagttagcaagggttgggcccagtgggctaatgctgggatgaggccagtagggcaggggccactgaaacactggcgggagcagtcgaaaaactgggtagagggtctcggtggcacactggaggcaatcagataccaccatccagccctgtgccacttcatctgctccccaaccactgcccctcaggacccagtcaaccatgggtagagcgcatgccaaactctgcagccaggggtcacctgaccttgccagaggccaggccagctactggatgccgcgcagggagtgggtggcagaataggactggggggcacctgagtgccatgggggtgggaacaccctccgtcagtgcccactgcctggccctgacgggcactttacaagcccaaggctagcactaggtctccccaccaaggaaggatggccccaggctgggtcagctgtgatgtagaacagggcagggctcctccctgaaccctccacttgagttagggggtgtcagagccacctgcagaaagttcacagcaagcacaatgccaccatgcgtgccatccacaccagctgggccaagtctgggccacatctaggccgccactgtgtctgcgagcagcaatgcagcctcaccccatggcggggcaggggggtggcacacgccatcctgctgcgaaacgcctactaagcactgctccttccttctcagccacagagctctgccctacccgctcaccgctggacatgaaacagcaagtgcctatcctggagggctccgcctggggagtgccaggtaactagaaacacggctctgggtgctggcccggatgctggtgctcagccctggaagcagctgactgcaggctgcgatgagaatgccacctagcacccagcagcccctggcagcaggcccgggcagcacgcctatcagccccgaggctagcacgcccagccctggcctactgcccatccagaaacgctggctcccaggacgcccaggatctgaggcagtagggcagcaggcctgggctatcggggccagctgggcattcgcctaaggctgtgacccatcccctccctaggacagagccttcaggggtccaggggagaggcaagaagggtagcacagaaactatctcccaagttaggatccctcagctccaggattccccctgtaggtggactggccccagctgggaaggacaagagccccagcagctggagggagggccagctctctctgcggaatcctgaaggtctgcaggaaggaacacaaagcctcggggttaccttcccaggccatctgttagagcagacacacggccctgtttacggaacagccaacatgccaactgctctcctttccttcccctcccagtccccgccacaaaaaagccagaaagccaggtccccagacactgagggcaggcccagggcccaggcaggtgctagcgggctggaacagcactcagatactccagcctctcaagccactggtggcacatgcccaagctctgtagaactgggccagccacagcagccccacccccgctctgttcgccctcaaagaacttacagtaaggcagctgctctgcaaggcccagtcagagcctacccggcccagcaagtccattctgtggcaagaaaaaccttggggacacacatacccaactgctaagtaagattatctctggggagcgggattacagaaaaaccatagtatctgtatattatgttcatttctgtaatactcaacattttaaaaagtattaccttttttttttttttgatggaatctcattctgtcccccaggctggagtgccatggcgatctgggctcactgcaaactctgcctcccaggttcatgccattctcctgcctcagtctcccgagtagctgggactacagccgcctgccaccacgcccggctaattttttgtatttttagtagagacggggtttcaccgtgttagccaggatggtctcgacctcctgaccttgtgatccgcctgcctcagcctcccaaagtgctgggattacaggtgtgagccaccgtgcccagccaaaagtattacttttaaaaccctaaaaatacaaagggcagaaatgatgcagagacatggatgaacctcacagtcgtggcactgagtggaagaagacttttgcgagagtacagactgcatgactccatttacatcaagttctagaataggcaaaacggactgagggtaaaaaccagagcagaacaggctgtgagcgacaggtgaggactgtccaggatggggcgagggacaagcgcccactgcctggccctgacaggcctatccaggacggggcatgaggaactctttggggtgagggcagctctctagcttgctgggaatctgggttaaggtaaatgaaaatacaattttaggcccttaattgtatgtaaactttacttccaatgaaacctccagacagaggctttcacaggacattctcatctcagaagctcagcacgataccctggaaacaccaccagctaacctttcctgggcactgttgtatgcccgaccatgtgctatgtcactggagccgcagggccacccaggagcctgtgcgttctgtccatgtgatcaggtgggctcctctcaatcttcacacagcacagctgagcctcaaacccagcactcaccctgacctctcacctccccacaaggtaggaaaacctggggctgaaagtgtgcagggacatgtcatctttagccttgggcaaaggcaacccttcccactgatgatttccagatcacccaggggtattggttctgcctcaattttccaactggcacagagatcaagggcgacggtgaagcagattggaagggcaaagatgccacagtgggaacaggttcctatccctcccggctgctccccagctgggtggccctcagtgcatctccagagggcagtcaaaagccccaggccaagaccaccctgcactctggatccctctactcgctcaccaaacacagaccagccaaataaccaacggggatggcagaggccagggcactgtgcacccctcgctgcctcctgacactcgaagcagccccccattgggggacccactagcccatgatcctacgcgagcgaggtcaggccacacctgcccgtgtgtggagcctctggtcagtccacgtggctgcaggggcctgtggggaggctggaacagggttacctcaaggcctttcttctaagcacccagcaaagggcaggagagtgtgctctagtcagcatctttcaaaggccaggagagaggaggttttcagatcaaagtgatccctgctgaggcagaaagcaggaaactccagccccaattctgagaggcactgccccaacccagcctggatacccaccttgcctagaaccttggcctccaagaagccaggcattcagaactgctccaggtgctgggcctccacatggctccttctggaggccatgactctgggagacaggaacacatctcacgcccacgtccaggcccacaggcgggggtcaaactcatctcagccacatgataaccctgccttcagactgaaacttctggctcacgcccagccaggagggaggcctggggagaagggtgaagaccaggaaagggcgccaccccaagcaggccatcccgcctagccctcctaggatccttctcatccaccttcctccctggaagctatcctttactaccaagaaaggggcttcctgcaggaggcctggagctatgctggaggactgaggagaagctccccccagcccactcccaaggagcagcaccttaaccacctcccagcctaaacaaaagtaacagtgaaatgagaaccctccagctgacgccaagacagctgagagtgagcagggccgcccacggcccgcccgagctccactgtcaggtgggagggacaagcatgccaggctgagaagccatgctaggcagggcagggccaccaggcaacttccacaacccagaggtctaagtacatctgaccagggtcagagagagccccagacttgctgccactgctcccaaacttcagtctaaggtcagcatcggccctggttccagaccaacccccaactatagtcacctcatacttcaggtgtggccgggacagatgcagctgcaacgggtggccctgtgtgagctcagcctcttcccaggagcccctaagccatgggagagactgcctggaaggcacaaggcagccaggcaggaggcagccagtatccagaagtgccccaaggcccagcccctggacacaccaaccagccctgcacagtcacaagcccaggactttgttcatcctatccccatggcctggagtcctccctgaggaagccttggtagacaagagatagctccaaggggcgaaggctgcacctcgcccaccgccacagccctgtatgagatggcagcctacatgtgggcaggtctgatctcctcaatcttcccacaggcccagtgagcggggcgttatctctgcagtttcagataagaaattaaaggttcttgggggttaagcaacttgcccagggtcacaagagcatgtaggtagcagagtgaggacctaaagcctgactccagagttgtagtctgatgacccccccgcccaacgcaggcagggccagggatgccactcacacatggcttccaactgccaagctgcttgggggagctagaggaggcaccgccctccatgcactggtgtgccaggagcagggactccagtctgcacctccaccctcactcccccaccccccagcaccacctgcctatccacagcagggccccacctgggtgtattctcccaaactcactgtgagggcatggggtctgcccagctcctccaccagaagtgacaaggtggagcccccatgcagcctgctttggaggcccaggttgtgcttgctgctcctctgggaacacccccaccctccatgacctccttccctgtcccttcaggaatgggctggtggtgggtggggctcactgctctgggcaagcccagccatgtaatccagcccagacctggatgccggccagcagctcctggctctcctcccagaccatcctcctggaaagcaacaggctccacaaatgccaggagcccagctctctccaacgcagcttctacaaaataaacactcgggttccactcaacacattggtgatgcagcgattgggacctgaggctggcctcctcctcctctgctcctcaggccagccctgtggcctaaagtgagggaggtagcatccaccccagcccagtgactttcccaagcccgtcctgaaatgcccatgggacctactgatgacctcgtactgcccacagcagggccaagccctgcatggtccgagccacccgcccatgggtactgtcccttctgaggtgaggaagcccgggctaacaccccagcacaaggaaaaggctggaatgggctgctgagaggagagctggaccgaaagtgcctccaaactgtgcttcccccagaaggtacagcctcagtcccctccctctcctcatcacttccgggtttggagccagcaaggaatgaggccaggaagaccttggagacctgcagctgatttcccctgctagtgctggcaccaaggagggccccaggcctggcacagtctggctgacagttctgagacaggatattggagacaggcaggggaacattgctttaagaagcagaataacggccaggtgcggtctgtaatcccagcactccgggaggctgacatgggtggatcatgaggtcaggagatcaagaccatcctggctaacactgtgaaaccccatctctactaaaaatacaaaaaattagctgggtgtggtggcacgcgcctgtagttccgctactccggaggctgaggcagaattgcttgaccctgggaggcggagcttgcagtgagccgagatcgcgccactgcactccagcctgggtgacagagtgagactctgtctcaaaaaaaagaagcagaataacaatttaaggttgtgatagtgactacgaatgctgtgctcacctccaaactccatcccaacactaccctgccccctaagaggggcctgagcatggggtaaaaggctcgctgacagccacagagcaggagcccacgcaagaccaccagaggatgtgcagccgctgttcctagtaggtgaggaaaaagcaggaatctggcatccacacatgtcaggaggcaaaacaggccctgtgctggtttctgcagtcctctccagcccacttccctgctcttcttgctcactggccatgacccaagaaacagcagcagcaccaccagggatcttgttagacacgcagaggctcagactccatccagccctaaccaccagaaccctgggggctcaaacacacagtcaagtctgagaagggctaggttagaagctttttttccttcttttgtttttacctggacaccactgattggaaagctctctacggcctgaaagccaagcgctccacaagtagtaaacgctcaagggatgggcatcaagtggaaggagaaagcccccaaaacgaagatacatgtcccatgtacacaagctcacaggctggtgaatacaaacggtagacctagaatgtgccacaccaaggctgagcgtgttaccacaggtaccagaatggtgaccacgctggagggttccacaaaccctgatcagagaagtaggcgtgagtggcaggcagagaacacagctctgtgtggcagggagggaggacaagcagtggcagcacagcagacaacaggtggaaattctacatgaaaggcactaaatgggcgaggaaagcctgggccgcccaggtggaagggactatcgtgatcatctctctcaccctagggacaccttaaaaggaggtaactgagccccaaagggaggcacccagcacagctgagtcacagagctgcagccatccaacccacagctccaggagggactctccaacttcacaatttcaaaatcaaccctagcagctaacaatttcttaatgccaagtaaagactagaattagaaacaaacagaaaccctatcatcttctaccatcattacttcacaaaagaaaacatttcaatgatcaaagagcaggaagaactactggcagtcctgcacctatgcagttctccaggcctggcaaaggctctgaggcaaccagcatgaaggagccactgcaccgtctgtacgcaacaccgtctgacccccgggctgggacaagactgagatgacatgctgaaagggaatcagaaaaaacaaaaacacaaaaattcaacaacagatactaaagacgggattttgactagccaaacaaagactaaaagagtatctcccagggatgaaaggaaaatggggatgtttttaaacaagaccaggactgttccagaaacaataagaacgtcaaagcccatcaggaaaaaggtaacaccaaatgttggccaggcagtaaggcaaccagaagtctcacatactttataattttttatttttttgagagagagtcttgctctgtcacccaagctggagtgcagtggcgagatggctcactgcaaccttcgcctcccaggttcaagcaattctcctgcctcagcctcccgagtagctgggattacagaagtgcagtgcgccaccacccgcagataatttttgtatttttcgtagagatggggtttcaccatgttggccaggctggtctccaactcctggcctcaagtgatctgcccatctcagcctcccaaagtactgagattacaggcataagccaccgcacctggccagaaaactcacatggtttagaaaacccttggatggcacaatctaaaactgtgggcccaaggccgtgggtggtggctcacgcctgtgatctcagcactttgtgaggccaaggtgggtggatcgcctgaggtcaggagtttgagaccagcctggcaaacatggtgaaaccccgtctctactaaaaatacaaaaattagtcgggcgtggtggcaggctcctgtaatcccagctatttgggaggctgacgcaggagaatcacttgaacccaggaggcagagcttgcagtgagctgagactgcgccactgcactccagcctgggcgacaagagccaacttcgtctctaaataaataaagccaacaagctagctagctagctgtgggcccaaaaactcacccaaggtatacgccaacaagaatgcacacgtaatgcacaccaaacaggcaggcacactcatgaaggcccaacaatggaaaacaactatgcccaccctgagaagggacagctgcaggtataaaagactatgagccagcagtgaacaggacagaacgtttaggttgaactgtatgaatttaccttttaggggtaaaaaaacagctggctgctgataatttcacatggtttgacttacaaacaacgcagatgaatctctcaaatatacttttgagcaaagatgccagagccaaaaagactattacagttccatttgcatacattcaaaagcaggcagcactaatcttatgggtgggggttgagagtgactacaagcttcaggatacgtgaggggcttccagggttgtgtttcgcactctggatgctagttacaagggcataatcatttgtgaagaactcttggagctgtgcacacttcttacgtaggctgtccttgaattcaatacgtgcacagaaaccttcagaagggaagcagagatcaacttcatcctgatcagcaagtagactcagtccaggcagcaacctctcctggacccccaaccaataacaaaaacacaggaagcaaaatattggcaggacagctggcaacgcggcaatgtccaggatggagtgcccatcctagaggagggagctcacacaagccagccaggagcccacaggaaacagagagactactgtaaatccttattaagagcagactcatctctgctatctaaaagataaaaacctgataatgtttttaagttgtcctaaggtccaattgacttttttttttttttttttttgagacagagttttcctcttgttgcccaggctagagtgccatggtgcaatctcggctcaccgcaacctccgcctcccgggttcaagcgactgtcctgcctcagcctcccgagtagctgggattccaagtgtgcaccaccatacctggctaattttgtatttttagtagagacggggtttctccatgttggtcaggctggcctggaactcccgacctcaggtgatccgcccgcctcggcctcccaaaagtgctgggattataggcgtgagccaccacacccagccccagttgacacttctaaaggagaaggggttctgcaaatcctgaaaggcaagcccaggagaaacaggaaatctgggagcacggcaagcgaggttcaaacaggacaccaaataattcccagcaaccgcctccagcaggtcctggtggcagccaggtagggcaggagccggctgggcatatcaaagggaggaagccaagaagaaaatgggcgagactctcagggatttggggtcaaaggaagccgctgggagaaggaaacagcccacttgctccttcataggtaatcaacacacaaaccccccagtgcctcaaatggctcaggagctacagccaaagatcaaggatcaagttattttactccaagaaagaaaaaaaaaaaaaaaagttatacgttcggcatccattggaagttttgtgattgtttggagacagggtcttgctctgtggcccaggctggagtgcagtggcgcgatcatagctctaatttctgggctcaagggatcctcccgtctcagccttttgagtagctggaactaaaggtgcatgccacgatgcccaaccaatttttaaaattttttgtagagatgaggtctcactatgttttccagactggcctcaaactcctgggctcaagtgatcctcctgcctcagccttccaaaatgttgggattacaggtgtgagccactgtgccaggccttaaaaagcaatttttacagataaaattgggcaactgctatggaaaatattacaatctatggtcctgtgcctgaaaagcctccaagtgtgatactttatagagaagaggtctctcctgtccagtaggtaacttgaaagtgtctaagagacaagtgcccaagaactcaaagaatgagagagggatccattcaaactcagggagaaaaatgctcacaaagtttcactgtacttctaaactgagtctcagtggtgcattaaggaactggatttagagacagaaaacaaaataaactggcacttctctgcctcaagaagcatagcttgggggtgaaaagtcagctacttagaaggcagcaaaaacaaaacccagaaacccacccaaatgctcactgccagcaggacaggtgattatgtgtggatggcgccaccttggacactgaaatggagaatgggaacacaggaactgctgctcctggtgtcccaagagtgcaggacacccggctcccagcgaactgagccaaaatcattcgcagtttcaggatccagacaaaggtgggaaaccgacaaaagccagcgaatggctgacccgcaattcagaagactgttggcttctagagggaagtgggaataagccagggagaagtgcatgaggtgtcccaggaacttgggaggctatttcttatgtggccatgagggaacaacggtgtcacgcttagtgggacacccacgattcaaccaatagtaggtttaccactacttatctctctattctttaagatttgtgcacacacatatatacatgtaatttacctttgtttttttttttttttttttgagtcttcctctgtcgcccaggctggagtgcagtgacacaatctcggctcactgcgacctctgctgcccgggttcaagcgactgtcctgcctcagcctcccgagtagctggggattacaggcacccatcaccacacccagctaatttttgtggtagagacagggtttcaccatcttggccaggctggtctcaaactcctgacctcaagtgatccgcctgcctcggcctcccaaagtgctgggattacaggcgtgagccaccatgcccggcctatttacacctttgtaaataacttcttagagttcaatggctaagtctactaaggaagctgagcctgctctgtgcagaagtctcaaaagaaaggaaagtcgggtgtggtggttcatgcctttaatctgagcactttgggagattgaggcaggaggatcgcttgagcccaggagttcaagaccagcctgggcaacacggcaagaccctgtctcatttaaaaaacaaacaaacaaacaaacaaaaaaacagagagagagaaagagagaaaagaaagagaaaaaagaaagaggaaagagacctccctggaaatcccaatccagggagaagccaagaggctaaagctgaggtgcactcacagagcacctccctttcaccacccgagagatcacctggtccacagccgtcaaactcagcaaggccacacacttgggcagctatgacaacaatgcacaaatgagggctttggagggctcagttcccacaagagataacccagaaaatatcaccctgtcctaatcatacaaagcaaaagaacctggggcctccacacctggggtagcaggtatgcttcactcaacagaagttgtccaggagggagaaatcccaggcaacctcccaaggtctacaggagaaagaagggcagaatcagagccactctaagtgaaaatatcagcgtttagaacacaatcacccccctgcaacccctccagccaaccctcgcctagtccctgtaccctccaattcagagtccaataaccctgagttatctttctcaacacccatctcatcaagccactcccctgcttaaagctttcaatgggccgggcatggtggctcacacctttaatcccagcactttgggaggcccaggcgggcagatcatctgatgtctggagtttgagaccagcctgaccaacatggagaaaccccatctctattaaaaatacaaaattagctgggcatggtggcgcatgcctgtaatcccagctactcaggaggctgaggcaggagaatcacttgaacccgggaggaggaagttgcagtgagccaagatcgcgccattgcactccagcctgggcaacaagagtgaaactctatctcaaaatacaaaaaaaaaaaattaaaaaaataaataaagctttcaataaattcctgatgcctagcataaagtccatgctcaggcctggcatgcaaagcacttcccacaggggcatcaagcccacctcatcccttccacagacacacctgagagctcctgcaggccgtgccctactctgggaggagcctgccccctcacgactccctcctctgtgaagccagaactgcctctgttgtccccccgcttccaacgtcagcaccagctgccaagctgcttccctcctgcctacccccaccaccccatagaccagtacccaaagttagaccctgtgtcccaagcagccacagcagcaggcatgcagcaggcactcataaacattcattaggtgagcaaatgctggtcagacccaatgctgagaagagacagagtgaaacaacatgtgaaagataaggaggcacgtggggaagatggaaatgtccagtaccctccttgccactggttctaaaattgtgttgtttacattcttaaatagtcagggctcctaacgagcatctgcttatgtggcttctctattactgttttgtggggttttttctgagacagggtcctgctctgtcacccaagctgaagtgcggtggtacaatcatagctcactgcaacctcgaactcctggcttcaagccatcctgcagcctcagcctcccaaagtgctgggattacaggtgtgagccactgcatctgggctgttgctgtatttgatgttaccatgtactacaacagtgccctcttattcagtttttttttttttttttctgagacggagtctcgctctgtggcccaggctggagtgcagtggcgtgatctcggctcactgcaagctccgcctcccgggttcacgccattctcctgcctcggcctcccgagtatctgggactacaagcgcccgccaccgcgcctggctaatttctttttgtatttttagtagagacggggtttcaccgtgttagccaggatggtctcgatctcctgacctcgtgatctgccgcctcagcctcccaaagtgctgagattacaggcgtgagccaccgtgcccggccaaaaaaattttttttaaaggctgagcacagtggctcacgcctgtagtcccagcactttgggaggctgaggtaggtggatcacttgaggtctggagttcgagaccagcctggccaacatggtgaaaccccatctctactaaaaatacaaaaaattagccaagcgtggtggcaggtgcctgtaatcccaactacttgggaggctgaagcaggagaatggctttaccccaggggagggtgtggggtggaggttgcagtgagccaagattgtgccattgcattccagcctgggcaacaagagcgaaactctgtcttaaaaaaaaaaataggctggacgcagtggctcatgcctgtaatcctagcactttgggaggccgacgcgggtggatcacctgaggtcaggagtttgagaccagcctgcccaacagggtgaaatacaaaaattagccaaatgtgttggtgcatgcctgtaatcccagctactggggaggctgaggcaggagaatcacttgaacctgggggaagcagaggttgcagtgagccaagatcacgccattgcactccagcctggacaagagcaaaactccctctcaaaaaaaaaaaacaacaacatttaaaaaaatacaaaaattagctgggcgtggtgacaggtgcctgtaatcccagctactcaggaggctgaggcagcagaatcccttgaacccaggagacggaggttgcagtaaggagagattgtgccactgcactccagcctgggtgataagagtgagactctatccgaaaaacaaaacaaaaaaagggctgggcacggtagttcacacttgcaatcccagcactctgggaggccgaggcgggcggatcacgaggtcaagagatccacaccatcctggccaacaggtgaaaccccatctctactaaaaaatatatatatacatacaaaaattagctaggtgtggtggcgcgcacctgtagtcccagctagctagaaggccgaggcaggcaaatcacttgaacccgggaggtgggggttgcagtgagcagagatcgcgccactgcactctagcctggcgacagagcgagactgtctcaaaaaaaaaaaaaagaaaagaaaagaaaaaaagaaggatagcattgctttacacttttataaatctctttaatgtctagcctaatagaagaagctggattctcatatctcctgcattcagtctgttaggatatgcggttttgattaaagtctttaaagaaatttggccttacacagaaagaaggaaggagtattttaataactttttcagaaaactgtctattcttcattgatattacactaaagctcgacaaatgagtttcttaaaagttgctatgggccaggcgcggtggctcacgcctgcaatcccagcacttcgggaggctgaggcaggtggatcacttgaggtcaggagttcaagaccagtctcgctaacgtggtgaaatcccgtctctactaaaaatacaaaaattagccaggtgtggtggcaagcgcctgtaatcccagctactcaggaggctgaagcaggagaattgcgcaactgcactccagactagcaacagagcaagactccgcttcaaggaaaaacataaataaaagttgctatgtaggccaggtacggtggctcacatctgtaatcccagcactttgggaggctgaggtgggcgatcacaaggtcaggagtttgagaccagcctgaccaacatggagatacccagtctctactaaaaatacaaaaattagccgggtgtggtggcacgtgcctataatctcagctacttgggaggctgaggcaatagaattgcttgaacccgggaagcagaggttgcagtgacccaagatcgtgccactgtactccagcctgggcaacagagactccatctcaaaaaaaaaaaaacaaagttgctatgtaggctgggcacagtggctcaacacctgtaatcccaacactttaggaggtcgtggtaggaggactgcctgagcctaggagttcaagaccaggaagatcccatctctggaaaaaaaaaaaaaaaaaaatagctggctgtggtggcgcatgactgtggtcctaactactcgggaggcttatgcaggaggatcatttgagcccagaaggtgaggctgcactgagccgtgattacatcatcactgcactccagcctaggcaactgagggagaccacatcgccaaaaaaaaattaaaaataaaaaaaaaattgtaaagcctcatgccgggcatggtggctaatacctgtaatcccagcacttccggaggccagggcgggtggatcacctgaggtcaggagttcaagaccagcctggccaacatggcgaaacccagactttattaaaactagacaaaattacaccaggcgcggtggctaatgcctgtaatcccagcacttcgggaggctgaggcgggcggatcacgaggtcagaagttcgagaccagcctgaccaacatggtgaaaccccatctctactaaaaatgcaaaaattagctgggcatggaggcgcatgcctgtaatcccagctactcgggaggctgaggcaggagaatcgcttgaacccaggaggcggaggttgcagtgagcgagatcccaccactgcactccagcctgggcgacagggaaagactccgtctcaaaaaaaaaaaaaaaagaaaaaattaaccaggcgtggtggcaggcgcctgtaatcccagctactcgggaggctggggtaggagaatcgcttgaacccaggaggcggaggttgcagtcagcgagatcgcaccactgcactccagcctgggcgacagggcaagactccgtctcaaaaaaaaaaaaaaaaagaaaaaattaaccaggcgtggtggcgggtgcctgtaatcccagttactcgggaggctgaggcacgagaatgacttgaacccaggaggtggaggttgcagtgaactgagattgcgccactgcactccagcctaggcaacagcgagactccatctcaaaaaaaaaaagcctcatgcatccttcctatttcatcacacagaaaagtaaaaatatgtgtaattaaaggtctagatttaatactcagtcatctgtactgcctcccctggacatgtgtagaactggtgggtctcagcccccagtgctggctaacagtggggaacacaactctggcagtgcaagtgtccacccagggcagaggccagtgattttttttttttttagatggagtctcgctctgtcacccaggctggagtgcagtggcaaaatcttggctcactgcaacctccgcctcccaggttcaagccattctcctgcctcagcctcctgagtagctgggactacaggcgtgcgccaccacacccagctaatttttgtatttttaggagaggcggggtttcaccatgttggccaggctgatctggaactcccaacctcaggtgatccgcccgccttggcctcctaaagtgctgggattacaggcgtgggccaccgcatctgaccttgtaacttctaaatatactgaaaaaggtatcggggaccctcagggtctgcaaacaactttgagaatagctgacaagcactgcctcaaatatttctaacaactcgtttacaggcaaggagaatgaggcctggagagcttaagagactggcccacggaggaagcaggagtcatctttccacaaaactacacttccccaaaagctgaactcttggacaaggagcccactgccaaacctaagagtaacaaatttcagcaaataaaaggaagtgccatttccaatggcatcctcgaatactctaagaggtggggctggcagaatccatcaataggcctccagaggcctgctactaagagccagcaacgctgctgaaagcggcactgcctctgcaggctgtgtgaccaggacccggcgggggccctgcacctggaagcagagggggtcggtgggggaggggtgctaccaggaagcaagatgtgcatgctgcctgctgggggcatgaagtcaaagtcccctcctgcccaaagtggctaggccagccctaggctgccttatcagcatcaacacatgcctggaatgtgggactttggcaacaaccctctcccttcggccagcacggggctgacgcctggtccctgggctctggttcacagtcagaggacaaccaccttgaagcaccagaacccgcacccccagcccatctaccagaagacaatctaccaagagtcaccgagaggagctatcctgcctgtgtccccacaccaccaagggccatgtctgagcacctcgtttgtccacactcagagaatctcaagagctcggctctggtccctgcaacgtccagaccatcccccacatggctctcctggaggtgttcggcaaaggcacaggctgccgtggggcagaagattcccacataccagacagtaaggagctgcgtgtgactggaaggatgaggacgacccagagaacgctctctggcccctggtccttggggaggaatgggggacctgcaggggaccaccttcccactctgggagccagattccctggctttgtccagagcagccaacccactaccccactcaaaatgaacacctcagctgccctccagcccaagcactgcgcagagtaaggagtcctcactcacaaatgtgtccgaggctttcacacacttcacctggagcttcgccactcacttcttagatgtacgactctaacttctctgagccacttgtacaacgaggactgacaagatgatgaggaccacaccggtgtgttctgacaactgaaccgggcatagaatgcccactgccaggctgagcccaggaacgagcccaggatgagtgcttaccctcttcaccactaccttcctagccttctgtcagaactccgtggggaccatcctcttcccatcttctaagccaagtaccctggtacaagccagacagaaactataatagcagctgcttccataaaggggaagggccatggggtcccggacagggctggggtgaaggggcgcaagacctagggcaggaatccacccccagatcactcactcaggacaggaccacctggacccagctaccaagatgtgcaccacccccttccttctgagccccttttcccatctcctctactgcccctggccaggttgctgtcccacctctaagaggcaagatttcctacccaggatgctgaccaaaaccacacccaggggcctacccgtcccctcacatgataggctgctcctagctggcaggagccgtcttatagcctctctccctcaaatacaaacaaaaccccagaacaacctattgttctgttccagcaaagggggccaggcccagccaggccctacctgaagctctctgtctcccgtcccccttcagtcccctcccactcgtccttctctgcccctattagtggcctcatataccttgtccagataacacagcccaagaaaccaacctcagggacaaatctcttctcttccagggagaagaagacagaggtcccaggagtcccaggggcccccattactggccacctccgctcaacccaaactgcactatgtgaggtcccgccagactacatacaggccaacgagagcccaagaatgcagccaggaaaccaggccaggcagactccaaaagcccgtgctacggggtcagtaggacccgcctacagctgagggctataggcagctctccagaggacctcccaggagaagccagcagtgcacatgggctaggttcctcctgctgttcaccctctgtgcccagtaactacccaggaacaggcatgactgactctgccaactcattcactgggtaaccgctgaccccaccaggccctcggagtaaagcagttagtgagaaccgcaggtaaaagcgcgggctactcatccctccgcctgtggattctattatcaacaaagatgcatcacctgctagaagagcggttctcaaacttggctgcacatcaggttcacttcaaaagcttcaggaaaagctagtgccttgggcccaccccagagacaggtatagctcaaggtgagaaccagagcaccagcaggcaggcctctgccaggcagcatgggcaacgtgtgctgggtgaatgtgcggcctgcactcatcacccagaagagccccactgtgtccacacaaggacaggccaccgaagtcccagtccccactctcccttctcacttactttgtgaatgagagctcaccaacagtttaccgtcttccgagtgctgcggcctcaccgcccgacccgcagcaggggtgagggcttgcaaaggccatgcaacagatcctccccctcaaaggggctcaggcctcagtgtggtaatgggagcggccccttcccacacttgtcagagaacccacccacccggtggaatgaagccgaagcccaagccgcagggcaacagcccgggacggcaggggacaagtctgtacagcagccacacccctgccagagccaggagctcttccatttccacagcaggccaactctcacctggaagcacccacctaaccaaacccaatccctgccttcttttagtcacactgggaactgccacaggaaggctggggactccacatactccctcctcaccacaccccatgtgtgatcacccttaaacagaaaacatgcacctaagatcctacgatgcgctgcccacctcacaaaaaaccggtgcctctaggtaagaggcacctagctgacccatccctgttccctctcaccattagaaggacccccaagtccccctgttctaacaccgaggctgcactcccactctccacccactaacattaccataaaaaataaattgaatagttagaaggaggggctccccaaagcctggccaccttcccgagggtcccaagcagtttcttggagtccctctccccactcagtcccgccacacccctctcaggcagtctggcccttccctcctgaactttggcgggctggaaccagctcccagcctcgcctcccttatcaagctcactgggggcccacacagagctcccatccccaccagcttttctcgctttgccactcccagctaaaactgggctcaaggcaagcaagcctgcagtccctcagtccctcggggcccagcccctcctcagagccctcccccagcccaggtccctaacccttagggcaaggcccctcccagcaggaagcgaaccctggcggtgccaggcagagtcaaactggaagggctggttcagaagcccctaaatgggagccaggacctctcttagggagggggctttcagccccatcctccctagtgcgatctcagatctctccagacaccacactatatgggcctccacaggcggtggagtcaaaggcatttaccctccagcccccagcaagctacttaacttccaaaagcagctccttccctcctccagaggagaacgggccgcgtgctgaactgcaagcgcctctatcaccccgcccaggcaagtctgtgagcaccagaaagcaggggccaacatgacttggtctaaaccaagggggccaggcactgactttgcgctcagaaaatgtggcggaatgaataaaaagcttgaaaaagagccacatacatgcctggctggcagtggggtctcccaagcgggcttcacagctcacacagtacccgtgggtccgcgtcctcagtgctctccagctgtctccactgccaccctctaccctaccactgccttttaaaacccagtagcagtcacttcctggttaaaacccctcccctccaggccaaccccaacccacatggcatccagggttctcagccagcccacggccggctcctcccacgccaccgctatgccctctgcgctccgctagatgccagcccttatcaccccatcttataatcatttgttgagtgtctgccttccctaggctgagctccagaaaacagcgatacatgaatgtaaactccagttctgttcccattgtagaaacccggcaggagagtcaatcactgctcaaggtcatgacgggagtaaatggcagagccagcaatgcactacagactttgcgaccgaccaagtccagttcccctctcactgccccacaggggtccgtcctaggccaggctcggaggagacaagaagggaggaacccaatgtgttctttcttcccgcggtgaaagctgcctcccaggccagcaagagcagcccagaagaagtgccccactctcccagggatcaggtactgggggcagcgggcaggacaaggtatggggtggggctgactgctccaggccaacagaccaagcaataaggttggaaccacaagtcccctgggtaaactgaactttattccttcctcacggctctcactctccagaactgccccgccagctcttctccaggggctggctgctgattaaatggcacttccccacccctcagatctgaccccgcaaacaataaggacttgaggggaggcggcaggctatcagctcaataatgcaaaaccctgttgctcctcgtccacaacagctgacttcaagtggatgggaggctgcgcttattaacaaaatgagaaatctgatctacggaaagaaaacactacgtgaggattaatctgcgactgcagcttgtggagaaggctgggctgctggccaagaccaaggatcgaggatgggatcgtgcctacctgtccccagagcaggtatcatgcagcacaacaggactcatcacccctgccccacctgcgccttctcttctccttccagcaacttcgacaatcatttcggttttgctttaattaaaggcctgactccctcgggctgcttcttcctctacacagaggcagcaaccagagggagatttttcttttcaggaatcggtcgtaaaaactcagtgactaatctacaagttccaacaactggcagaaaaacaccgcagggagaggttgctgggcacacagcagcactcagagccaactgaccagagaagctgggccacaggcactctactacaacctccctcccccagcccgacactggcctgccgacccacctgagagctctgacctcccaaggcaggcagctggggagcctcttcccagccttccaagtctactgctcgtcctgtgggacccagagatcttcacagtctcaatggcacaagacggaacgttcacttccaggcaacaatcctgcgccacaggactcagttcagcccccaagtatcagactcccggccctgttcttggtgttcagagcccactaaaccagcagtcttgccacacagctttgtctccagaggccagctcatctgctttttttcacactactccagcaaccctgctccaccaagcacgcacactctccttgacacagggctccagaccaaccacatggcctgtgctcctgaaaatgcctgcctgaaggcccagggagtccagacactggcagatgagaatggacgaaaagaagccaagccagaagccaggaagcaataaatgctagacccagaaaggccttaggtttgagtgacccagctccatccctccatcctggatccttggaggacagccccaagttcagcctaggagctcccaaggcccctccactacctgccagctctccgacagcacaagagacacagcaatcccacatcagtcaacaacccaccgccacaggattcctaggggcaaggctctgcccctccccccagcacatatgtcagaggggtggcttccctgggttacacccctcctgctgttgggggagtggggggtcggggaacacagctttccagatgtgcttggcaactcctactagaaaagactaggggtgcgggggacaggagaagacatggataaataactttaacaccgctccaacccatccggctcagcactgggctcccttacacaggcagtcccaggcagttctgggtggggccgttgggagcattatctggcctcattccctcctctcagcaagtcactgccccccagggagaggcattcccccccaccccccccaaccacgcacacacccaggcctgtgtgaatatgaaccatcttggaagataaacagagagtgacaagctggggcccctcagccccctccctcagccagccggtcccttccccctgaaagccgaccccctcccccaagcccatctctcttcctgccaagcggctgcctacaggagaggtctgggggcagggcagcgagcccaccagccgcagagcccggccctctgggagcggcccctccaggcccgcccctgcccctgccgtggccagtcttcccgcggggaggaggcaagaggagaggagaccgcagacggtgcaggaccgcagtcctggaaatcgcaaaatcctctagcgagggggcgaacgcgggcgcagggccgtttgcataatgggagccctcccgcctgtcaggcagcgcagctcgcccgacgctgttcggattagattgctaatgaaaaggcacaaagagccggcgcccgctcgcccgccgacccccgctccgcagacccgcgccgcctgggcctggcgcggcccggtgggctttgtgccccgggtgccccaccgcccgcgcccctccgggcatctggcccacaaagcccgggcctgccaggggtcccgcgtgcgccccagcccaggcccgccagacgctagcgcgtcccccacgcgcgcagtcccacgtcgcccgggcgcgcgcgcgtccacgcccctctccccggggacgcgcccagcccgcggccccggcccccgcccgctccccgcgccccccgccccacaaggccgcccctcacctcgtgtgcgtcggcggcggcgctccgcccgccggccggccggccctaccagcggcccttgtcctcagcgcccggctcgcgccgcacgcgcccgccccgtccgcctgccgccagcccggctcggctccccgcctagcgcgccccgagcgccgctcacagccgcccgcccagcgccatcttggaagcttgtgacgtcggcgccgcccgctcacccctgacccacatctgaatgggcgagcggcggggcggggacagggggcagctgggggcgtggcctgtgaacaggggcggggcctgcgggggcggggccgggccggacagcggtcccagcactaggcggggcgggctgccggggtccggcgccgtgggggaggggtgcgcgggaggagccggggacccagaccccggacatctaaccggactccgacctcaagcgccagggcaggaccgcgacctcgcccctgaaatacccggaccgcataccggcccccgggacagggaccctggccccccccgacaggctgacgcccaccccctcaaactctggtggacttacccccttttagccctaccctgacccctaggagccccgaattagggacctctatcggcctacgcgccccctccccgacccctttgcgacccctgctcgacgctccctgcggttgcccgaggctcaaaggcgcagccagcagtgactgcaagctcgggggtctgggctcctggggaagcccgggctggttgggtgcaaaagagaaggggcgcccctcccgtgaccccagcgcccctcgggcccccgcgggcgcacccccgcgaaccctacctgctccgagggcgcggaggacccagcacgctgcgctcagccagccccttccggtggccgcagcccctcgcaggccccaggggtcaagcgcctgcccgagccggcccaccaggacccgggctcccggccgccatgcagatagccttcccaggggctgggctggcctgagccgccactgcttctctagggagctagttaatggaccgctctctactttgaacaccaaacaaaggaacacaccactatcgaggtcgcccaagtccaagaggagcccaggtctgccttacagggaagttgtgccccagctccagtcaagatcaaaaaccagtttcaataacccttcgccaagctgatgatgcaacctttctttcctaatggatgtataggtttaatgtcatcctaacaacatttcttagacttcacaaaattctaagttcacctggaaaaataaatagccgaaaacagctatggttttccccccttgggaacaaaagcaggcatgagggtagacttgccctaacagatatcaaaacaaattgtaaagctaccgcaggcatttcagtgtggtacagaacaggaaatagaatagaaagcctagaaacatcctagaaatggtaagaacacaatagatgaaaaaggaaatatcaaacatctgtggaaaaaaaagagctatcaaacatccctgaagaagaacaagaatattccacaaatagagcctagcagaggactcactatttgaaggaacgactgaaaaaaaaagtcaaccattctactaacccaagacatataaattaaaactataggccgggcgcggtggctcacgcctgtaatcccagcactttgggaggccaaggcgggcggatcacgaggtcaggagatcgagaccatcctggctaacacggtgacaccccgtctgtactaaaaatacaaaaaattagccaggcgaggtggcgggcgcttgtagtcccagctactcgggaggctgaggcaggagaatggcgtgaaccccggggggcggagcctgcagtgagccgagatcgtgccactgcactccaacctgggcgacagcgagactccgtctcaaaaaaataaataaataaataaaataaaactataagaagctgggttttctcctaaacaaattaaaaatcagtttcaagtgataaccttcaaacacaaggtctgataggtaatcactctcatatacttttggaagcacataaatcacctcaaaattcctggacatgagtttggcggtatgagccaaaagttgtttttttggggttcttttgtctttttttgttttttggagactcggagtctcactctgttgcccaggctggagtgtagcctcaaactcctgggatcaagtgatcctcctgccttccaaagtgctgggattacaggcataagccaacgcacctggccccaaaaatattttaaaataattataccctctcagaccagtattccaggattctgttctggggaaattagccacgtttgcagaccacgtacttattatctgtctctctacccataagtaagtttgtacctgtaagtttggaacccatgcctaggagcacacctgagacaacaggcattccacggtcccttgtttcatctgcatttgaaaactaatgtggctggctcatgcctgtaatcccaacactttgggaggccaaggccggcagatcgcctgaggtcaggactttgagaccaccctggccaacatggtgaaaccccgtctctactaaaaatacaaaaattagccggatatcgaggtgcatgcctgtagtcccaattactcgggaggctgagacaggagaattgcttgaatctgggaggctgaggttgcagtgagctgagatcatgccatgacactccagcctgggcaacagagggagactcggtctcaaaaaacaacaaaaaagataactaatatatgataatattttttaagtgtcatgtataatagtgaaagaaagcatatacaggcggtggctcacgcctgtaatcccagcactttgggaggctgaggcgggaggatcacctgaggtcaggagtttgagaccagcctggccaacatggtaaaaccccgtctctactgaaaatacaaaattagctgggcatggtggcgtatgcctgtaatcccagctacttgagaggctgaggcaggagaattgcttgaactccagaggcggaggttgcagtgagctgagatcctgccattgcactccagcctgggcaacagagcaagactccgtatcaaaaaaaaaaaaagaaaaaagcatatacaaatttctcacaatggggttaaatagtccacataatggaatgtagattaggccaggagtagtggctcatgcctgtaatcccaacactttgggaggccgaggcgggcagatcacctgaggtcgggagttcgagaccagcctgaccattatggtgaaaccccgtccctactaaaaatacgaaaagttagctgggcgtgattgcgcatgcctgtaatcccagctactcgggaggctgaggtaggagacttgcttgaacccgggaggcggagattgcggtgagctgagatcgcaccattgcactccagcctgggcaacaaaagtgaaactccgtctcaaaaaaaaaattagccaagcatggtgtcacatgcctgtagtcccagccactcagcaggctgaggcgcagcacgagagttgcttgaacctgggaggcagaggttgcagtgagccgaggtggtgccgctgcactccagcctgggcgacagagtgggactccattttaaaaaaataaataggccaggcgcggtggctcacgcctgtaatcccagcactttgggaggcccaggcaggtggatcacgaggtgaggagttcaacaccagcctggccaagatggtgaaaccccgtctctactaaaaatacaaaaattagccaggcatggtgacgggcacctgtaatcccagctattcggggggctgaggcagagaatcgcttgaactcaggaggcggaggttgcagtgagcccagatcacaccactgcactccagtctgggcgacagagtgagactcggtctcagaaaataaataaataaattaattaattaaattaataggatgggcacggtggctcactcctgtaatcccagcactttgggaggccgaggcgggtggatcacccaaggtcagaagtttgagacctgcctggccaacatggtaaaaccccgtctctactaaaaatacaagattagccaggcatggtgacgtatgcctgtaatcccagctacttgggaggctgaggcaggagaattgcttgagctccagaggcggaggttgcagtgagctgagatcctgccattgcactccagcctgggtgacaagagtgaaactccgtctccaataataataataataataataataataataaataagtaaatttttaattaaaaaataaaatttttatttatttatttatttattttttgagacagagtctcactctgtcatccaggctggagtgcagtggcatcatctcagcttgctgcaacctctgcctcccaggttcaagcaattctctgcctcagcctcctgagtagctgggattacaggcgcccaccaccacacccagctaatttttgtatttttacaagaggctggtctggacctcttgacctcatgatctacccgcgtcggcctcccaaagtgctgggattacaggcgtgagccactgcgcccagccaaaaataattaaaaaaaaaaaaaaaaagaagaggccaggtgcagtggctcacgcctgtaatcccagcactttggaagactgaggcaggaggatcacttgaggtcaggagttcgataccagcctggccaacatggtgaaaccccatctctactaaaaatacacacaaaaatattagccaggcatggtggcacacccctgtagtcccagctactcgggggactgaggcaggaggatcacttgaacccaggaggtggacgtttcagtgaaccaaaatcacaccactgcacactccagcctggtcaacagagctagaccctgtcttaaaaaaaattgtattttttgtacaaaaaaattagccgggcctggtggcagatgcctgtagtcccagctactcaggaggctgaggcaggagaatggcgtgaaaacctgggaggcggagcttgcagtgagccaagatcacgccactgcactccagcctgggcgacagagcgagattccgcctcaaaaaaaaattttttttttaattgcattttttaaatgcatgcaaaaatattgatatatggaaaagcaactgaagaaaataaatcaaaaatatttacggaggttctctctggaagttgggaattttttttctacacatgtatactttagcgtgtgtgttatttttattttatgaaagtaacatttctaatcggaacaattctagagatgctgaagcacattttatttttattttattatttatttttgagacagagtctagctctgttgcccaggctggagcacagtggcgtgattatggcccactgcagcctccacttcctaggctcaagtgattctcccagctgggactacaggcatgcaccaccacacccggctaattttttattttctgtagagacagggtctcactatgcttcccaggctgatctcaaactcccagactcaagcaattctcccacctcagcctcccaaagtgctgggattacaagcatgagacaccatgcctggtaatttttttttttttttttttgtgcagatggagtctcgcgctgtcacccaggctggagtgcagaggcgcgatctccgttcattgcaacctccggctcccgggttcaagcgattctcctgcctcggcctcccaagtagctgggattacaagtgagcaccgccacaccaagctaatttttgtagttttagtagagatggggtttcaccatgttgccagggttgtctcgatctattgacctcgtgatctgcccacctcggcctcccaaagtgctgggattaccggcgtgggccaccgtgcccagcccatgcccagcaattttttaaagttaaattctccctcctcctccaccctaatcagtcctttctgaagtaacattaacagtttaactctcttctctgacatcaatatgtatctactcaccttacaaaaaagatcctactattttgaaatcatagacatttttctagttcatttccataattcattcttttttttttttttcatgtcagacgggtaatgtgcctatgtcgtaacaagatttgaaggtggcggccgggcgcggtggctcacgcctgtaatcgcagcactttgggaggccaaggcgggcggatcacgagttcaggagattgagaccatcctggctaacacagcgaaaccccatctctactgaaaatacaaaaaaattagccgggcgtggtggcgggtgcctgtagtcccagctactcaggaggctgaggcaggagaatggcatgaacccgggaggcggagcttgcagtgagccaagatcgcgccactgcactccagcctgggtgacggagcaagactccctcttaaaaaaaaaaaaaaaaaatatttgaaggtggcacatcttacatgggaacgtgtgtgaacacataatcatcatgcttatgaactacaaaaggatcataattcattctttaagagctgacaaatgttccagagtatggagcttctgtaatttattcacacttcgttaaccatggttgttcagtttatttacagtgtggtgctttttgttttcttttttctttgttttttttttgttttttttttttttttgagatggagtcttgctcctgtcacccaggctagagtgcaatggcacaatctttgctcactgcaacctccacctcccgggttcaagcaattctcctgcctcggcctcctaagtagctgggattacaggtatctgccaccatgcctggctaatttttgtatttttcgtagagacggggtttcaccatgttggccaggctggtcttgaactcctgacctcaagtgatccacccgcctcagcctccctaaatgctgggattacaggtgtgagccaccgcacccagcctacactgtggtgctattaaaaaatatttttaggctgggcacagtggctcacacctctaatcccagcactttgggaggccgaggcaggtggatcacttgaggccaggagtttgagaccagcctggtgatcatgaagaaaccctgtctctactaaaatattagccaggcatggtgtcacatacggataatcccagctactcgggagtctgaggtgggagaatcacttgaactagggaggcagacgttgcagtgagttgagatcatgccactgcaccccaggctggacaacagagcgagacctcgtcttaaagtaattaattaattaattaattaatataaataaaatagcagatttcaaaaatttgttctccctggcagcaacccagtaaagctagatctgggcggaaggtaatatggaaatataaaaactacagattagcagggatgggaagacccgccagaaatgggttcattttgtgtcctcactccctccggattctctgtgtgtctagtccaagatctaaccactatgatctgctttcctcatccatttgggaatcagggcaccacccccttgggaggcttgaatgacaggaggttgagcaggcagagcacggaactcaggctctggtgagccctggtacagtgactatgattgttgtgtcatgtaggaagggtctgttattttaccattatctgttttcaataaaaaacagaaagaaaacaaatatacaaaatacccccaaacagtaaatttcagcttcttactatgacagctagatttagcatttaacagtatgcccaaatttgaatttcggataaacaaccaataatgcttaatataagtatgtcccggccgggcgcggtggctcacgcctgtaatcccagccctttgggaggccgaggcgggcggatcacgaggtcaggagatcaagaccatcctggctaacacggtgaaaccccgtctctactaaaaatacaaaaaattagccgggcgcggtggcgggcgcctgtagtcccagctactcgggaggctgaggcaggagaatggcgtgaaccccaggaggcggagcctgcagtgagctgagatcgtgccactgcactccagcctgggtgacagcgagactccgtctcaaaaaaaaaaaaaaaagtatgtcccatacaatatcacttctcaccttcccatatcccaagctcaagacaccttatatacgccatgatttctcctgccatctctgggcattcacaccagggctcctcctgtccaggccagccttctcccttctcccacctgtgcctggtgaacaactcagttcagacatcatctcttgtaggaagtctcctgtgatcccaggctaatcaccctgatacagtcctgaaatactgctgagcagttggcatgagggcaggaaggcttggtcttgttcactcttgtatccagcttatacatggcacaaagtaggttctcaattaaaagtcaaatgaggggccaggtgcagtggctcacgcctgtaatcccagcactttaggaggccaaggcgggtagatcacctgaggttgggagttcgagaccagcctggccagcatggtgaaaccccatctctactaaaactacaaaaattagccagacgtggtggcaggcacctgtaattccagctactcgggaagctgaggcaggagaatcacttgaacccgggagggagaggttgcagtgagccaagattgcgccattgcactccagcctgggcaacagagcaagactccatctcaaaaaacaaaaaaagtcaaatgaagtcgggcacagtggttcgcgcctgtaatcccagcactttgggagactgacgcaggaggatcacctgaggtcaggagttcgagaccagcctggccagcatatgaaatcctgtctccactaaaaatacaaaaaaaaaaaaaaaaaaaaatagctgggtgtggtaatgcacgcctgtaatcccagctatttgggaagccgaggcaggagaattgcttgaacccgggacacagaggtaacagtgaggtgagatcatgcaactgcactccagcctgggctacagagcaagactctgtctcaaaaaaaaaaaaaaaaaaagtcaaatgagaccactcatggtagctggcgcctataatcccagcactctgggaagccaaggcgggaggattgcttgagtccaggagtttgataccagcctgggcaaaacagtgacatctcatctctacaaaaaatttttaaaattagccgggcatggtggcactcgtctatagtactagctacttgggaggctgaggtgggaggattgcttgagcccaagaattcgaggttgcagtgagctatacttgcgccattgtactatagctgggcaacagccagacgcggcctcaaaaaaaaaaaaaattagccgggcttggtggcatgtacctatagtcccagctactcagaagctaagacaggaggatcatttgagcccaggaatttgacgctgcagtaagccaaggtcacaccactgcactcccgcctgggagactgagtgagaccctgagtctaaaacaaataataataaaaacgaaaatgaaagtcaaatgaatgaggccaggggtggtggctcatgcctgtaatcctagcactttggaaggctgaggtgggtgggtcagctgagccctggagttacagaccagcctgggcaacatggcgaaaccctgtctctacaaatacaaaaaagaaaaaagccaggcccatggtggtgagtgcttgaagtcccagctactcaggagggtgaggtgggagaatagcttgagctcaggaggtcaaggctgcagtgagctgagattgcatcactgcagcctagccatgatgacagggcaagacccagtagaaaaccaaggttagagaggttaagtcacctgcccaaggtccgtagctaacctcagactccagcccctcagactgacatgagctcagttcaccctcttaggaacaccatctgaagaatgcatccccagcaagcctattccctatagcaaaggccaggcctgtgatgggtgccccgctcctcaccacacacctccctgtcaagtcaccactccttcacccctagcagagccaggcaccttgagcccaagggaggccactcatggaactgtcattcaaccaacagatgctgacagcaatgatgaggtgggcactgggctagtgaacagcacagatgtgttccctggcctcagaagcccacagactaaggagaagatgacagaatactcacaagggtgctggggctgggcaaaaaggtgcaggctgctttgtctggtcataagaggggaactgacttccctggtctgaggagccaaggaaggggccgtgcccttgccatgccctctgcctgccatgccttgctgttcttcagtgcctgctctaaggtcactcctagtgtggttttctctggctgctcttttgttttgttttttttttttttttgagacagagtctcgctttgtcacccaggctggagtgcagtggcaccatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccggatcaactccccttggcctcccaaagtgctgggattacaggagtgagccaccgcgcccggccactttttttttggagtctcgctctgtcccccaggctggagtgcagtggcgcgatttcggctcactgccagctccgcctcccgggttcacgccattctcccacctcagcctcccgagtagctgggactacaggcgcccgccaccacgcctggctaattttttgtatttttagtagagacggggtttcaccctgttagccaggatggtcttgatctcctgaccttgtgatccgcctgcctcggccttccaaagtgctgggattacaggcttgagccaccacgcctggcctctttttcttttttgttgagacagattctcactctgtcgcccccaggctggagtgcaatggcgcaatcttggctcattgcaacctcggcctcctgggttcaagcaattctctgcctcaagcctcccgagtagctgagattacaggcgcccaccaccacacccggctcatttttgtgtttttagtagagacagggtttcaccatcttggccagactggtcttaaactcctgacttcgtgatctaccagcctcggcctcccaaagcgctgggattacaggcttgagccaccgcacctggccatgctctttcttttttatttgtatttttatctgtttcttagagacagggtctcactctgtcatccaggctggagtgcagtggtgtaatcataactcactgcagcctcaaactcatgggctcaagggatcctcctgcctcagtctcccaagcagctgggactacaggtgtgcaccactatgcccagctattttttttttttttttgagacagagtctcgctctgtcgaccaggctggagtgcagtggtgccatctcggctcactgcaacctctgcctcctgggttcaagtgattctctgcctcaacctcctcagtagctggattacaggtacctaccaccatgccaagctaatttttgtgttttttttttttttgagatggagtcttgctctgtcacccaggctggagtgcagtggcgcaatctcggctcactgcaagctccacctctcaggttcacgccattctcctgcctcagcctcccgagtagctgggactacaggtgtccgccaccatgcccggctaattttttgtatttttagtagagacggggtttcaccgtgtcagccaggatggtctcaatctcctgacctcgtgatccgctggcctcggcctcccaaagtgctgagattacaggcgtgagccaccgtgctcggcctaatttttgtattttcagtagagacacggtttcaccatcttggccaggccggtcctgaactcttgacctcatgatccaccggcctcggcctcccaaagtgttggggttatagacgtgagccaccgtgtctggcctggctccactttcttagggagctttgcttgccctctgcttggggtagtttgtgaattcagtgctctgtctctcccaggtcctgggtctcctgctcctgatcaatctgccacgtgccatttgatctcagagttgtctccaccattagactggcagggtctgtcttctggggtctgtgtgtaggatacagtggccccaggatgggtaaaggaggggacccagttgttcttctgtgataggtggagacaagggccagcagggctgtttctcggtgaaacccatggggagatagtcgaaccaggaaccaaatccggccgggcgcggtggctcacgcctgtaatcccagcactttaggaggccgaggtgggcggatcacctgagttcgggagttggagaccagcctgaccaatatggtgaaaccccatctctactaaaaaaaaaatatacatatatatacaaaattagcctggcgtggtggcacatgcctgtaatcccagctactcgggaggctgaggcaagagaatcacttgaaactgggaggcagaggttgcggtgagccaagatcgcaccattgcactccagcctgggtgacagagactcagtctccaaaaaaaaaagtccaaaaattaaaaaaaaaaaaaatgccgaactcagtggctcacgcctatgatcctaccactttcagaggccgaggcgggcacggtggcgcgtacctgtaatcccagctactccggaggctgaggcagaagaatcacttgaacccgggaggcagaggttgcagtgcgctgagatcgtgccactacactccagtgtggtgacagagcgagacttggtctcaaaaaaaaaaaaaagtcctggctgtgccactaggccagacgccctagaactgacttctatggacctcagttttcatacctgtgaaatggaactcagagccatatctacttcattgggttgtgtgaatgtgaggtagttacaggatggagcaggcagaaggtcagcacagcctcagtggttggaggagtgggggtcaagtggacagagagggtaccccagggccagaggtagaggcaaggtgaagcaatgcttcatttccctgctgaggttcctctctagcagtttggaggtggggcaggagtggagaaaacacatcccctcctcaatctgggctgaggaacagggttcttgaggcaccaagaacctctttggggctctggcttgcctcctgtagtgaaagggatgggctgtgtgcaatgaactcacacctgtaatcccaacactttgggagacagagtcaggaggtccagaacagcctaggcaacatagcaagaccttgtttctacaaaaaactttttaaaaaattagccaggcgtggtggtggcacctgtagtcccagctacttgggaggctgaggtgggaggattgcttgagcctggagaggttgaggctgaagtgagctatgatagcaccactgtactccaacctgggcaacagagtgaaaccctgtgtctaaaataaaaagagggcctggcgtggtggctcacgcctgtaatcccagcactttaggaggccgaggcaggcagatcactcgaggtcaggagttcgagaccagcctggccaacatggtgaaactctgtctctacagaagtacaaaaattagtcgggcgtggtggcaggcgcctgtaatcccagctgcttgggaggctgacctgggagaatctctcgaacctgggaggcagaggttgcagtgagctgagatcacatcattgcactgcagcctgggcaacaagagcgaaactccgtctcaaaaaaaaaaaacaaataataaaataataataataataataataataataataataaaaagagggtgggagtggaccaaggcctaatggcatggaatttgcaaactctatcttcctacttttctctggggagccttcctccatcaccagggcccagcagggcctcagatggcggggggtggggcgggggctacacatatccctcatggccaagatgctaggaagcccctgagctggggcaacagcctctggtcacagtcatgagggaggctgggtgcagtagcgcttatctcgcctgaccttgtggagactgaccactccctccttctggaaaacgttgccccctgccctctccaaggcctcctccttcttacatcccctggtcctggctagggcctcagcacccaattctactccttgacccaccaccctgtggtgcttttgccgggccccagcccacagccatctgccaaacacctccccctggagtccctgcggcgtctctgactcagcaggtctgtgcctgcccctgctgttccccccacccagtggctctgcagagcaccctgttgcccaagccctgagtgctggccactcccagggcctcgccttcccccaccaccagcaccaccaatttgaattcctatctctccctctggcctcctccctagacccaggccctgccccagggtgggggaaggaatcctatagataagggcattggtcaaagggacacacctgggttcgggcccccagctctgcccccaacctgctaaatgaccacacccctctccaaatctgagttattccctatgtaaaagggggaaataattaaactagctgggtatgctgtgctgagcaatatgtgagctcaggaaaggtcagttttccaggggaagtatggccgctgagagcctcagtctagtgcttctcattcacgagctggttggtgcctttcctaagttggaaatgggttagtccacaaatcccgttgcctggtccatgccaggtccaggtacctgcattcagggtgcagggtggagtaagacagtctgaagggagaggtagcaggatgaatgagtaattcctgggtgcgttttgggattatgcctaagggctgtccgagcacgtgggaggggtagctaaatcctgtaagggaggggagaatggggaaggctgcctgcaagaggtggtggagggtgctttcaaaggatacctgggagtgagctggctgtaggcacagggcagctggaaggccaattttagggaagaggaaattgaggctgaaagtcaaaaaacaaaggaactgcctgaggtctctcaactgagaagtgagtgggccagggttcacattcagcccccactccattctcaggccgggcaggaaggtactttgccctcaggagggcaccttcgacccaaagcaccctgaccaagaggctgtgcaccgtggcaaccctaagactgaggcccaggtcctggagttccaccaaggtaggtacaaccagccaggccgtcagtgacaggaggatttactggggcttctagggaccccgtgaaagggcaaaaagacggcacagaagcctgtggatatcagatatagatagtgagggctagggctttatggggagggtggatgggccctgtgggcgggggatgtttaggagatcttccaaacagagcattccagcctgggggaacaacccattatagaccccacccagcaccgaagacagggacaggtggggctgagcctggaggccggcaggacctgtgcggccggctgcggtgtcagcaatgccaccgtgtgtggaaccctctgtgcctaggttcctggagccagctccacctggcaatgtgctttgtttcacaagactagagttggcccatcttgttccgcctcagatggaacacctgacctcctgcacaccccacccagcctccaaattcaaccaccccagtagtgagacagggagagtagggtgtgaccagaaggtggaatgagcttaaaataggctgcagagatatctctgagcttttaaaaagtcgtatctttcatatcgtgttcttgtgaaatcttctccagattttttacaatgactctgaaattgatcagttagcctcatgctttcaaaatccatagccgcagtgagcgagagggggcaggtcagctagaggtggagggggcagatgggccagaggcgcctgggcaggggtggatggggcctggacaggcttagtgacccttgcaccagaactctccggacaccgccccttcgcccactcgttaggctcctctgccttcgggccggctgggctgcccatccccgctcgttcccctcctgggcaggtctggactggacaggttttgggcctccaggtcgtgcagtcagtcagggaaggggcctggtgcaggccacagccaggcatccacctccttcccagcccacccctaccccccagcagcctgccaacttgctagacctgtgcggccttcccttctgctgaaagtctccagattctcagggctctgcacggggagccaagctggggcttagaactgtgctcccttgcccccacccccgacctgtgccctcatcagctttctttttttttcttttttctttttttttttgagacacagtctcgctctgtcgcccaggctggagtgcagtggtgcgatctcagctcactgcaacctctgcttcccgggttcaagcaattctcctgcctcagcctcctgagtagctgggagtataggtgcgtgccaccacaccccgctaattttttgtatttttagtagagacggggtttcaccgtgttggccaggatggtctccatctcctgacttggtgatccacccgcctcggcctcccaaagtgccgggattacaggcgtgagccaccgcgcccggcctgttttaaattttttttgtagagacagagtctcaccatgttgcctaggcttgtctcgaactcctggtcgcaagtgatcctcccctctctgcctccgccgtagctgggattgcaggcacaagccatgacgccccccttctcatcagctgtctgggtctttctcggggtcctgacaccaggccaagtgttctgcacacctgacctgctcaaaacaaaaccagttctgccacagtctgggaacatgaggctcagagaggccttgcagctgtctgtgagcaggctggcatttggatccagtgactgggttctggagcccagtggctctgtggccctgcctctccagccttatgcttctttaaaactgcccatggcctctgaagttgaggatttaggggagcagggctgccagaggggtgaagaaggagatctttctgtgggtgggtgtcagaatgaccgggcctgacactggtccctgctcccctggaaggacagcccctctcggttatgtggggggtgggctgcctagggtgctctggggagaagggagggagagaatggggctggtcgggtggggtgtggattccaggcctgcttggtcaaaaagatacagtatttcctattcccccttacactgggcaggcaggtgtggcccaggcagctctgccaggtgtgcagcccctggagaatgacccttaagtgcacctaggctgccccctggcggcagcatgaggtcctcctccctggacttgtaaccctcccagggggaggaggtccacaccagctgatgggttggcacctgtccccagtccctttcttctttcctgtgccactgctcccagagttgcccaaaacacacgatcaggtgcagtggcttgaacgaaaccctgtctctacggaaaatacaaaaattagccaggcatgttggctcatgcctacagtcccagctacttgggaggtttaggtgggaggatcgacagcccaggaagtcaaggccgcagtgagcagtgagctgtggttgcgccactgtactccatactgtagcctgggtgacagagtgagaccttgtctttttttttttttttttttgagacggagtctcactgtgtcatccaggctggagtgcagtggcgcgatcggctcactgcaagctccgcctcccggattcatgctattctcctgcctcagcctcccgagtagctgggactataggcgcccctcagcctcctgagtgctgggactacaggcgcccgctaccacgcctggctaatttttttgtatttttagtagagacggggtttcactgtgttagccaggatggtctcgatctgctgacctcgtgatccacccgcctcggcttcccaaagtgctaggattacaggcgtgagccactgagcctggccgagaccttgtcttaattaaaaaaaaaaaaaaaaaagataaaaacctaggtaacatgctggggggtgatgagggttatggaggaaaataaaacaggtgggggctggagtgaagagtgggggtgcccctcataactctgacaaagactacaacgcagctgtcagaaaaaaagctgatttgaggcaatggtcagggaaagttgtgaaattaagtaaaaagtgatggaacaggctaggtgggaagtggtggctcacaccaataatccaagtgctttgaaaggccaagcaggaggatctcttgaggccaggtgtttgagatcagcctgggcaacatagcaagaccctgtctttacaaaaaatgtaaaaattagctggaggctaggctcagtggctcatgcctgtagggaggccaaggtaggtgaattgcttgagcccaggaatttgagaccagcttgggcaacatggcaaaattccatctgtacaaaaaaattgccaggcatggtggctcatgcctgtaatcctaacacttagggaggccaaagtgggcagattacccgaggtcaggagtttgagaccaccctggccaacatggtgaaacctcgtctctactaaaaatacaaaaattagctgggcgtggtggcgcatgcctgtaatcccagctactcgggaggctgaagcaagagaattgcttgagcctgggagacagaggttgcagtgagcctagatcgtgctactgcactccagcctgtgtgacagagcaagactatgtttcaaaaaaaagaaaaattagctaggtgtggtgacatgcacctgtagtcccagttactcaggaggctgaggtgagaggatcacttgagcccaggaagttgaggctatgatcgtgctactgcattccagcctgggtgacagccagattctgtctcaaaaatcaaaacacaacagggcacagtggctcactttggccttccaaagtgctgggattacaggtctgcaccaccatgcctggcctgagagtgcatgaattaaagtttctattctcttgctagtctgtcattgcttccctagtgtgtgggaaccatacttgtccccacttctcagtcagagagcagcctgccaacctccaagtctcttgcccctgacccaaaaggtcccaggctgtcctctcggcagaagcagctgtcttgtggcttgctgtgctcagactccatttctaggctgtgggctcatcagggatctagtgctttgaaaaagtgtaaaggagagcagcagtattattcacaatagctaaaaggtagaaacgaccaaagtatccattgacagatgaatggataaacaaaatgcattacatacacacaatggactattattcagccttaaaaaggaaggaggccaggtgtggtggctcacacctataatcccagcgctttgggagactgaggcaggcgaatcacttgaagccaggagttggaaaccagcacagacagcatggggaaaccccctctctactgaaaatacaaaagttagccaggtgtggtggcacatgcctataatcccagctactctggaggccaaggcatgagaatcgcttgaacctaggaggtggaggttgcagtgagccaagatcatgccactgcactccagcccgggtgacagagtgagacactgtctcaaacaaacaaacaaacaaaaagaaacgtgtggtggaagaagggaagaaaattggccaggcacactctggtaggggatggttggatgatgaaatacagacaatagaaaaacctagataaagacctggcgtaatggctcatgcttgtaatcccagcactttgggaggctgaggcggaaggatctcttgaggccaggagtttgagaccatcctggtaaatatagtgagaccccagtctcttaaaaaataataattggctaggcgcgatggctcacgcctataatcccagcactttgggaggccaaggcgggcggatcacctgaggtcgggagttcgataccagtctggccaacatggagaaaccccatgtctgctaaaaatacaaaattagctgggcgcggtggtgtgtgcctgtaatcccagctactcgggaggctaaggcaggagaatcgcttgaacccgcaaggtgaggttgcagtaagctgagattgtgccgttgcactccagcccaggcaacaagagtgaaactccatctccaaaaaataaaaataaaaataaaaataaaaataaaaaagaaataggccgggtgcagtggctcacgcctgtaatcctagcactttgggaggccaaggtgggggcggggtggatcacttgaggtcagaagttcgagaccagcctggccaacatggtgaaacccaatctccactaaaaacacaaaaaattagccgagcatggtggtgggcacctgtaatcccagctactcgagaggctgaggcaggagaatggcttgaacctgggaggcggaggttgcagtgagccaagatcaccccactgtactccagcctgggtgacagagtgaaactgtctcaaaaaataaataaataaataaataaaacttttaaaaagtaagaagaagaagaaaaaaaaatatggaaataaaaaaacaagaaaaaaataataggccaggtgcagtggctcatgcctgtaatcccagcactttgagaggccgaggtgggcggatcatgatgtcaggagttcaagaccagcctggccaacatagtgagacctcgtcgctactaaaaatagaaaaaaattagccaggcgtggtggcgggcacctgtaatcccagctacttgggaggctgaggcaggagaatcacttgaacccatgaggcggaggttgcagtgagccgagattacgccattgcactccagcccgggtgacagtgcgagactccatcaaaaaaaataaataaataaaataaataaatattaataataattttaaacaattaaaaaatatgggattttttttgagacagagtctcactctgtcgcccaggctggagtgcagtggcatgatgtcagctcactgcaacctccgcctcctgggttcaagtgattcttctgcctcagcctcccaagtagctgggactacaggcacgcgccaccacgcccagctaatttttgtatttttagtagagacagggtttcaccgtattggccaagctggtctggaactcctaaccttgtgatccacccgcctcggcctcccaaagtgctggaactataggtgtgagccgctgcacccggccaaaaaatatgttttttaaaataatagagatgaggccgggtgtggtggctcacacctgtaatctcagcactttgggaggccaaggtgggtggatcacttgaggtgaggagttcgagaccagtctgggcaacatggtgaaaccctgcctctactaaaaatacaaacctgagctgggcatggtgacgcatgcctctagttccagctactcgagaggctgaagcaagagaatcgcttgaacccgggaggcggagactgcagtgagccaagatagcgccactgcactccagcctgggagacagagcaagaccctgtctcaaaaaataaaataaaataaataaaataaaataaaataaaataaaataaaataaaataaaataaaaaaaaaataaaataaaataaaataaaataaaataaataaaatagatgaaggccaggtgcagtggctcacgcctgtaatcccaacactttgggaggccaaggcaggcagatcacctgagttcaggagttagagagcatcctggccaacatggtgaaaccctgtctgtactaaaaatacaaaaaaagtagccaggcattgtggcgggcggccaataatcctggctacttgggaggctgaggcaggagaatcacttgaacctgggaggcggaggttgcagtgagccaagatgatactactgcactccagcctgggtgacagagcaagactctgtctcaaaataataataataggccgggcacggtggctcacacctgtaatcccagcactttgggaggccgaggcgggcagatcacaaggtcaggagatcgagaccatactggctaacatggtgaaaccctgtctctactaaaaatacaaaaaattagccgggtgtgctggtgggcgcctgtagtcccagctacttgggaggctgaggcaggacaatggcgtgaacccggtaggcggagcttgcagtgagccaagatcgtgccattgcactccagcctgggcgacagagcgaaactccacctcaaaaaataataataaaataaaataaaataaaaataaaaataataataatagagatgaggttttgccatgttacccatgctggtctccaactccttggctcaagcgatccatccaccttggccttccaaagtgctggaactacaggcttgtgccaccaccctggccttaaacaattattcatgaaaggaaggaaattctgacacatgctgcaacatggatgaagctcaaggacattatgctaagggaaggaagccaaagacctgccagccgaggtcccagtccgtcaagggctccagtgagcgagcaggattgagcaggtccctgggctgagcagtgggaactctgctttgctgtgagtgtggcacgggtggcggcagactgtggagtgcaggctctgtggagcaactggacactctgttgaacgaagtgcaaggtggtaggtttttgcttttttttttttttctgagacagagtctcactctgtctcctaggctggagtgcagtggcatgatctcgactcattgcaacctctgcctcccgggttcaagcaattctctgcctcagcctcctgagtagcttggattacaggcgcgagccaccacacccagataatttttaaaatatttttggaagagacggggttttaccatcttggccaggctggtctcgaactcctgacctcgtgatccacctgtttcagcctcccaaagtgctgggattacaggcatgagccaccgcgcccggccacaaggtggtagtctttctcaaggacgctggggcaaccccattgcgtcttcaccaacaccctggtacagatcctgcagctgcagtctaccccgcatacaacatgttcaatgatccctagctagacaaggcattgaaaactattccataggccgggtgcagtggctcctacctgaaatcccagcagttttggagcaaggcgggtagatcatctgaggtcaggagttcgagaccagtctggccaacatagcgaaacaccgtctcttctaaaatacaaaaaattagctgggtatggtggtgcatgcctgtaatcccagctacttgggaggctgagacatgagaatcacttgcaccaggaggcggaggttgcaatgagccgagatcacactactgtactccagcttgggtgacagagtgagactctgtctcaaaaaaaaagaaaaaaaaaattagctgggcatggtggcatgcacctgcaggcccagctactcaggaggctgaggcaggagaatcgcttgaacccaggaggctgcagtgagccaagatcgaaccactgcaccacagcctgagtgacagagtgagactccatctcaaaacaacaacaacaacaacaatcaactattccatgggaggcagaggcaggaggatggcttcaggccaggagttggagccaagctaggcaacatagcgagaattcctcatctctacacacacacacacacacacacacacacacacacacacattaattagctgggtgtggtggcgcatgcctccagatactcaggaggctgagcgggaaggatggtttgagccctggaggttgaggctgcagtgagccatgatcacgccatgacagaatgaggaccaggtggaagaactgaaaacgttggggatccacacatccgctccatcctttcagatggaaagaaataccaagactcaaaaaaatgagggtgcccaggtcctcactgagcagagactcactgctaaaaaaaagccttacctatttgggttttcactagtaagcagttggtttgtaagcagttggtgattttagtttgtctgggtttcagccatgaatattctattgtaaacttaattataacaactgcactgtaataattcaatgtcctattatgatgttgttatagacaaaatttgcctttacattgtcatttattttattttatttttcttttgagacagggtctcactctgtcacccaggctggagtgcagtagctcaatcttggctcactgaaaccactgcttcccaggctcaagcgattctcccacctcaccttctcgagtagttgggaccataggtgtgaaccaccatatcaggccaatttttgtatttttagtagatacggggtttcaacatgttgcccaggctggtcttgaattcctgtgctcaagcgatccacttgcctcgcctcccaaagtgctgagattacaagtatgagccattgacatttaatcttccttccttccttctttccttccttccttccttccttccttccttccttccttccttccttccttccttccttccttccttttctttttttgagatggagtctcgctctgtcgcccaggctggagtgcagtggcacgatctcggctcactgcaagctccacctcctgggttcaagcatttctcctgcctcagcctccggagtagctgggactataggcgcgggccaccatgcccagtgattttttatttttattttttttgagacggagtctcactctgtcaccagcctggagtgcagtggcgcattcttggctcactgcaacctccacctccagggttcaagcaattctctgtttcagcctcccgagtagctgggattacaggcacccaccaccacacccagctaatttttgtatttttagtagggatggggtttcaccatgttggtcaggctggtcttgaactcctgacctcgtgatccaccaacctcggcctcccaaagttctgggattacaggcgtgagccaccgcacctggcctacttttttaaacttaaattttaaaaaaaattaagtttatttttaatgtgatttatttatttatttattttttagatggagtctttctctgtcgcccaggctggggtgcagtggcgctatcttggctcactgcaacctctgcctcccgggttcaagtgattcttctgcttagcctcccaagtagctggggctacaggtgcatgtcaccacgtccagctaatttttttgtatttttagtagagacagtgtttcactgtattggtcaggctggtcttgaactcctgaccttgtgatccacctgcctcagcctcccaaagtgctgggattacaggtgtgagccatggcacccggcctatttatttatttattttttaattttttttgagacggagtctcgctctgtcacccaggctggagtgcagtggtgcagtctcggctcactgcaagctccacctcccgggttcatgccattctcctgcctcagcctcccgagtagctgggactacaggcgcccgccaccacgcccagctaatttttttgtatttttagtagagatggggtttcaccgtgttagccaggatggtctcgatctcctgacctcgtgatctgcccaccttggcctcccaaagtgctgggattacaggcgtgagccaccgcgcccggcctctttcaatcatttctgatgacaccggagaaggcagtgtcctttccttattgtctctttttttttttttacctgggtattctggaagtgtctttcctctgacagtgttgttggacgtggggaaacaaaagggtatcaaagagagggagagaaggataaagaccacccctcattcccgccctcccagaggggcagcctggggagtctatggaggaggtgactttgagccatgatgtgaccttagatgaggggcctctctgagcctcaggaagctcttctgcaaaatggggcaaataaagaaatgccctctgtgtgcagtggctcaggcctgtaatcccagcacttcgggaggccaaggcaggagaatcacttgagcgcaggagttccagaccagcctgggcaacatagtgggaccccatctctaccaaaaaatttaaaaattagccaggcatcaggtgtggtggctcaggcctgtaatcccagcactttgggaggttgaggcaggcagattgcttgggcccaggagtttgagaccagcctgggcaacacagtgagacccctgcttctacacacacaccaaattagccaggtgtggtggtgcacatctgtagtcccagctacttgggaggctgaggtgagagaatcatttgagccctgaagctcaagactacagtgagctgtgattgtgccactgccctccagcctgggcaacagaccaagactctgtctcaaaaaaaggaaaggtccgggcgcggtggctcatgcttgtaatcccagcactttgggaggctgaggtgggcggatcatgaggtcaggagattgagaccatcctagctaacacagtgaaaccccgtctctagtaaaaatacaaaaaattagccaggcgtggtggcgggcgcctgtagtcccagctactcaggaggctgaggcaggagaatggcgtgaacccgggaggcagagcttgcagtgaactgagattgcaccactgcactccagcctgggcaacagagcaagactccatctcaaaaaaaaaaaaaaaaaaaaaacggaaaagaaggccggacgcagtggctcacgcctgtaatcccagcactttgggaggctgaggcgggcggatcacgaggtcaggagtttgagactagtctggccaacatagtgaaacactgtctctactaaaaatacaaaaaattagccaggtgtagtggtgtgcacctgtaatcccagctactcgggaggctaaggcaggataattgtgtgaacccgggagacggaggttgtggtgagccgagattgtgccattgcactccagcctgggtgacagtgcgagactctgtctccaaagaaaaaaaaaaaaggaaaagaaatgccatcccaaggtgatccctcacaggaagtgactcagaaaagcagtgagctacgaaagctatctgaatgaagcaagatcgtcatgtgggagacactgactacccactcctagcaaagggctcagcagcacacggcctccctgcggggatgccctcggggaagatgtggcccagaggagttttttgggccttgctcctcagtcctggctcttagtaggaccctctgcagccaaactagcatatcctgagccaggctgaccttaaaaagtaagcattcagggcctagggaccttgggcaaagcagagaagctggtgtcagatgaggtgccgcacgtacagtaggataaggtgttctcaggtccccagtgcagccccaagatgagcctgcagtattttccttacatgatctggtcctactgtgggcagcgctgctgcccagagcctgagaggattatgaaaacatggcaacggaagtgaggccaggggacacagcatgggggcatgaggagcaggggacagcgggtggggctagaggagagggaggtttagggaggcctctgctgctgtgactgtgagccccagccaatgatgacgtggccaccgcacaatctgagttctgggaaccatgtgatggaatgtgttctgggaatagactgcagccaggaaaaaaaaagcagaagggtgcaccctcccttcctcagccaggaaaacatttctgtagcccttgcggacccagtgcgcagaagtgagagggaggaaagccaggctcatgtttccttggttgtgcttcaacttctaaaatatgttttttctatgaacattttaatgaggggttggacataagacagaaaaataacattctgagagctcgtttggaggttctagcaggggagcgcagctactcttatactcttgactgaagaccgatcgtcctctatcggggatggtcatcctcttccattgagcacacagcttctggagggacgcacatggagtggtgagggaggaaggggatacccgcctagtcagccagatcagccgaatcaaccctgatgatcaatggggtgacacatgtcgcagccagatcaccctcacatcccaaaaataacactcagattgctttttcttttttaagatgtagacttttcttgagactttcgtacaaggcaatggacagataaccttaacctcccagagaaaacacacattggccacagaaaaaggcgcttctccgtatacctgccatagttatcagcaactttgaaatggcttctcagactctcaggggttggcttgttgtgtttgcttttgcaaataactcaggcttaagtcctgctactttcagagcctaggggacgcttaaggactaccatcagtttaacacagtggcacttggagcacatgctacttatggtggtgaggaggggtgctggtgtgagggtctgaacgcttgcttctcctctggcagggtgtgagcagccagaggccactacctgggcaaggatgcttgctcagtgtccatggagggacatgtgatccagcaggtgggcaggaaccaggcccctgtggccgcccaactctccataatagaatccttggtcatccatgggcccgtaaaccatgaccacgtctcctgccctcagcgccagcctgcccttcccctggccccccatttgcccatccccaggatcatagtccagagctgctatcatgatctttggagtccacagtgggagtctcttggagttcccctggagcaccagggaggaaccctgggggatggtgagcccctgaaagtcctcgaggtgggccacagaaggcaggtgcccttgggccggagaacgccacctcctatcagtctgctctgtccccacctccatctcagccactaggcgcccggggatattgcccacttgcctgttgcactcgctgaggtagaaatcatgggtgtcctgagagccccacactcttagcaactgccttttctggaagaccagctcctcctctgcagccttgaggttggcagacatcaccagggggttgtaatcagagagggccacaaagaccctggctggagtgttggcccccgtccccagctgttgggggccacccctgggcatcttgatgactttggcggatggagctggacacagtgccgagctgggctcatggagctggcaccctctcttcacccccagagcttgtccttgcctgctgtggggctcaggctccctcctctcctctcgcctctctgtgccccgcagatccaagcacagtgcctcctgctcctccttcaaaacgttatggaagtcagatgcatactgttggctggcgcccagctggggaggtgtgaacccttgggcatcttgcttttgccgaagtaccctctcaagggcagccttttcctgacacggttctttcctgggcccacactcggtgcgtagatggatgaatcctggagcagggcttttgctggtgcccatgtgctggtagcaattttccttctccccaggctggtcactgactgaaggtggcctgtggttctggggactcttctgaaagagcaggtcctttctacagccctcccaggcctctgcaagctcctgggcttggctgccagcccctgaactcggacattctccttctgagcccaggttggacactggggattgcctccttgggggttcttcaaagaatgcttctaggaacttggcctggggctccccgcagcttccagggttgtgggggctggccttggcactcggaggagccagtgacagcttctgggggcagacggggaaggtgactctgtaggtggatgggtcgccacaagtgtagctaaagggtggagtctctggccatcggtgacacatgaagaagtcctcggggatctgagcaggcactgaatccagggactcaccacagagtgacatggttctcactgagaccttctgccacgtgaggggcacctgtagctgggagaattccaatacggtgctcccagcagtggcatcggcgacctcacaaaccttaagcccatctgcatacacagcataaccggtgacctggactccattggaggacccagctgagtcaatggtcacagggagccagctgaccaccaggacacctggcgaggcatggcgctccaccagcacctccagcggtgggtagggaggtcctgccaagagtgtgtcgaaggtgacggtggaggacatagttccccaatacacctgcagcaagtcccatggcagccgcacctccacccgcacccggtagtgcgtgccggggcacaggccctggaaggtgtagcagctcacgcccgctggggtcagggcatgctctcggtcatcaagatataccacatgggggtggcggtggctgctgtagacccaggtgatgttggctgatgtggctgtgacattctgcaggtgtagctgcatgggagccatacggagcacccctttggtccccagaaggggtctggagaggccctgcttccccatgctctgcagcaagcccagctggcaggcttccgtcttggtatccaggatctctgttgctacttctgtcttggagcccaccctgaccatctggcacagccctctgtccaccattccctgggctttcccagataataagctgtcttcctccagagcttcatcctgccccgctgggagttgactggggccaagatcaggggatttggcaggcaggcagcctgggatgtagctgtccggaatctgctccacgaagttggagggcaccagcccccgccggccatcgtcaagctccccctcatagaagccatcctcatccatgtccccgaagatatatatgtagtccccagctgtgaggggcagctcaccctcagggtgatcattgggcccctcaaatgggttgtagttatactgagccatgaagatcttgagcttgggggcagcaggagccgccgagccccccatttccagggccagggacacgctgtcaggctccaggtcatccacctcactggctgtgtccctgtccagagtaggggaggacggcacggtggcccacatcgacccctcagaggaggagtttgactgggagctggttttcttggacagaggttggctggcagggactgtctctgaaacttgggggacactggctgactccccaagggcaactgggctctcctcgagggaggcttcccttttctcctgtatgtctctgttgggctgtgacactgcgtagtcttcaggccgtgcgtggaacttgggccttctgctacctttaacttgggactccggcatttgactggtctcccagggctgttcaggagggtgaccaggccgacactggagcgcctgtatctccttccaggaaggatggaggtcacacagggccttctgcgggtcgcgttgcagctgctgctgcctgtcctgcccgcgcgccgcctgctgcagcagctgttcggcgatcaagccggaggcatcgcgctcttgacacgcgcggcccaggtggccgcgcacttcgctattctcagcctccaccttccgcacccagtcggtcttggcctgcagccgcccattctcctccgccagccaggcgtttttgagcagcgccgcctgcagctgtgtctcggcctcctcgccacgtcgccgcgccggggccgcctgcgtgcccagctcctggcactcgcgccgccgctggtccagctcgcgctccagcgccagcatctgccgtcgcacctcctcgcaggttgcgctctggccgcccgcctcgggccaagcgccaccgttgccctgctgaagcatcaactgcctctgcaggcgcagcacttcccgctgggactcgcgctgcaggcggtctaagtctctgacgttgagccactgggtgcaggggccgccccttccagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggttggtctcctgcagctcgcgggcgcggtcagctaggcgccgcgcgagcccggtcagctccgcgcgctttaccttgagccgcttcaccttctcgtctgcctggtaggggcagcctgcacgccgcagctgcttgttctcctcttgcagggtataacagcggcgcgccagcacccacaacgccttggccagcagccagttcagctttatcagctcgtggtggcccaggcccgggggtgagggagtcaggacttcgcagggctggctctcagagccttctcctccccgcgggttgctgagtttcctgtgggctgacggtggtggtggcggcgggagtggcgatggtggcggcgagagcctccgggagccaggggtggaggtgtctggtgaggagggccgctcctcggatttggaggccttggggaggctccgggtgctgtcaagcgagcgggaacacgcaggtgcgaagcaatcaagggagctggcgtgcgtggagagcaggccgtctggggagctggagcacgcagaggacaccaggcctagcgagcgggagcgcacaccgacttcagcactcaggctgtctagagatccgagttggcaggcgggtttgggggcgtggcaagagccgctggaggtctggggcagcggttcttccaaggaatgcacagcttgggggtccggtgatcccgacaaagccgggtgcccgcggaagtgcgccaggatgtacttgaggaagagctggcgctccacctccagcgccgcctgcagatagcggatgcgcgccgcctgctcgccgtcagtctgccagcgaagctgcgccaacacttcctgcaggcgacagcggcactgcgccgcggaaacctcggacgcccccgggcggctacagtggccgcggttcaccagctcctcggccagctggcgctgcagctcccgggcttggcgcaccacgccatcgcgctcccggtgcagcagctgctgcagctgccgctgctcggcctccttccagcgcagcagctgccggatctcggcctcgcgttcccgctgcatctcctcttgcagctgccgcaactcccggctgcgctgtgcctcccacttggagcgcagacggtcagccagctgccgccgctcccgctcggcctcctcacgcagctggcgctcccgggcagcgaagcgccgccgttccgcccgccagcctgcccgctccgcctccagctccgcccgtagcttctccagctcccgcctctggttctccagcactgccgccgccgggctggagcagcccggcttcttgggcgacgcgcccaaggggctgggcgagtccttggccattgcggccgcggcccggctggtctccagacttcgcctggcaggcctcagctcgccaacggccgccgccgaccgcccggcgcgccccttccggcgccccctgggggtctccgcgtgccccttccgcctcttggcatgttcccccgcctcctgccgcggatgtctggcccaggcgcctctccacctggcaaggccagggctggactcccacacccctgctcaaactggcccatgtcccttccaggatgcacgggggcttttccggtccctacacttttcctgctactagcaccaagtcccttgtgaccctccccaggcaccctcccaggcactgtgcagtcccaagcaggccgcggtgccccgagggaagtctgggctgctgctcctgtacttggagaaaggggcagggtgtgtgtgttaaggccacccatggggtgtgggcatacctggtcgtgggttcaggtggtgtatttgggtcaggtggctggaaaatgcagcaggataggcctcaacttggctagacctggactccccaggacccttcagccccctaacagccctgatcacccaactggtcatccaccttttgaggaaaggatgtgcctgatacacatttgtgttactgcgcagagtcggctcagaggaggtgtaagcgaaaagaccctccccagcaaggtggcatagggacccagggccagataggcatgggggcactgcccaaactggccatctggcctgtctacctcccacatccaggtaccacctggtgacaaacactggagccccagtgtctgggctactcattggcatcttaggtagaggcctcaggatgggccaggagtgagggtgaggcttcagcagaaatgttggaggcatcctgagctgcagaagaaacacacacacacacacacacacagctgcagaagaaacatacacacacacacatactgagctgaaggaatacacacatacactgagctgcagaagaaacatacatacacacactgaactgaagaaatacacacacacacacacacacacacacacacacacacactgcctctctgactggtggccacctgtgtggcttgggagctaagaagccctgcttcagtctggctcctctttgcccttcctgtctgctcctggtgccaagtggctttttggagacatggatggacacctgatacctggcagtctgcattgagacattgattttgttttttgagatggggcctcactctgtcgccaggctggagtgcagtggcgcaatcttggctcattgcaacctctaccttccacgttcaagagattctcctgcctcagcctcccaagtagctgggattacaggcttgagccaccatgcccagctaattttttgtactttttagtagagacagggtttcagtatgttggccaggatggtcttgaacttctgacctcaagtgatccacccgcctcggcctcttaaagtgctgcgattacaggcatgagccactgtgcccgacaagaccttgatattgaagtcacatcagaggcccctttgcttcttggtctgtcgtgtctccctgtccccaggaagcacctgggacctctcacaactgctgtgttcactcagcttatggccctcctttacaacactcaagtttttcaaatcagtttccccggaacccacagaacatgcctttaggcagtgtcaagtaacaagaacatcgggaattatggctccagatgttctttttttttttttttttttttgagatggagtctcgctctgtcgcccaggctggaatgcagtggcgcaatctctgctcactgcaagctccgcctcctgagttcacgccattctcctgcctcagcctctcaagtagctgggactacaggtgcccgccaccacgcctggctaattttttttgtatttttcagtagagatggggtttcaccatgttaaccaggatggtcttgatctcctgaccctgtgatctgcccgcctcggcctcacaaagtgctgggattacaggcgtgagccaccgcgcatggccctttattttattttattttattttattttattttattttatttttgagacagagttttgctctgtcaccaggctggcatgcagtggcacgatttcggctcactgcaacctccgactccctcgttcaagtgattctcctgcctcagcctcctgagtagctgggattacaggcatgcgccaccacgcccagctaatttttgtatttttaatagagacagggtttcatcatgttggccaggatgatttcgatctcctgaccttgtgatccgcccactttggcctcccaaaatggtgggattacaggcgtgagccaccgtgcccagcccagatgttctttatgagaggtgaggcagatgtagtgtgtatgtgagaggaaggggaggtgagatgcagggatggccttagccttgaactggtgctgggctcctggacatggtagccacagggaggactatcttgagagaatcttcatcacagccttgttttacggaagagaacctgaggctcagtgagagccactggcttgccagggcacatgggcaactgaggcagagctggtgggtggggtttcacagcctggatgccctgctgcagtctccagtagggcctcaactgtcaggtcaggagggcaggctgggccgggcatggtggcacagacctgtaatcccagccctttgggtgaccagggtgggaggatcacttgagcccaggaactcaagacctgcctgagcatcatagagagaccctgtctctacaaaaaaaattttagctgggcgtgctggtgcatgcctgtagtgccagctacccaggaggctgagatgggagggtcacttaagcccgggagtttgagactagcctgggcaacagagtgagcgagacccagtctgcatttccagctgagatgaaatgattgcttgagcctgcaaggtgaggtcaaagtcgcaatgagctgtgatggcaccactgcactccagcctgggcaacagagcaagactgtctcaaaaaaaaaaaaaaaaaaaaaaaaagcctggtgcggtggctcactcctgtaatcccagcattttgggaggccaaggcaggcgtatcacgaggtcaggaggtagagtccatcctggctaacatggtgaaaccccgtctctactaaaaatacaaaaaattagccattagccaggcatggtggcgggcacctgtagtctcacttatttgggaggccgaggcaggagaatgacatgaactcaggaggtggagcttgcagtgggccgagatcccgccactgcactccagcctgggcgacagagcgagactccatctcaaaaataaaaattaaaattaaaattaaaaaaagagagtaggctgtcaccaagaaaaaggacactggggtggatgggtctctgggaaccccacagttaccatccagcagctgccccaaagtatgtcaaaagcattcgggaatgttggttgagtggatgagcaaagccaggcttccccagggctgggtttctgccatccctgttctcatcatgttgtgcagtgattgtccagtgacctgcctgtcacccccatcaactctgatcttggggagagcagaagccatgttttcccttgtccctattgcatccctgcatgtgacttagcacatcactggtgcccaggacatatgagaatgagttgcagggaggcaggagtccctgcatgagctcaccatgctgctgccttctccaggttcaactttctcacctattaaatgaaagagatggtttcttttttttttctttgagatggagtctcactctgtcacccacgctggagtgcagtggcatgatctcggctcactgcaatcttcacctcctgggttcacgtgattctcctgcctcagcctctcaaatagctgggattacaaacacctgccaccatgcctagctgattttcatagttttagtagagacgaggtttcgccatgttggccaggctggtcttgaactcctgacctcaagtgatccacaggcctcagcctcccaaagtgctgggattacaggcatgagccaccatgcccagcctgaaagtggtggtttcaaactgggttctttagggctccagggttccttggaaatatagaactgctgggcacacacctatactcccagctacttgggaggctgaggcaggaggcttgcttggatccaggacttctggattgtaatgtactatactgatggggtgtctgcactaaatttggcataaattggtgacttcctgggagcaggaaaccaccagcttgtctaaggagaggtgaactggcccaggttagaaaaggagcaggttggccgggctcggtggctcatgcctgtaatcccagcactttgggaggccaaggtgggcaggtcacctgaggtcaggagttcgggacccgcctggctaacatggtgaaaacccgtctctactaaaaatgcaaaaattagctaggcattgtggcgcatgcacgcctaatcccagctacgcggcaggctgaggcaggagaattgcttgaatctgggaggtggaggttgcagcaagctgagattgcaccactgcactccagcctgggcgatagagtgagattccatctcaaaaaaaaaaaaaaaagaaagaaagaaaaaggaaaacgaaaaggagcaggtcaaaactcctgtgctggctgggcgcagtggctcacgcctgtaatcccagcactttgggcagttcaagaccagcctgaccaatatagtgaaaccccatctctactaaaaatacaaaaaattagctgggtgtggtggcaggcgcctgtagactcagcttctcgggaggctgaggcaggagaatcgcttgaacccgcgaggcagaggttgcagtgagccaagatcatgccattgcactctagcctgggtgacagtgcaagactccatctcaaaaaaaaaaaaaatttttttttttgtaggctgggcgccgtgactcatgcctgtaatcccagcactttaggaggccaaggtgggtggatcacttgagatcaggagttcaagaccagcctggccaacatggtgaaaccctgtctctactaaaaatacaaaaattagctgggcatggtggcaagtgcctgtaatcccagctactcgggaggccgaggcaggagaattgcttgaacccaggaggtggaggttgcagtgagctgagatcacgccattgtactccagcctgggcaacagagtgagagtctgagtcaaaaaaaaaagaaaaaaaattaacaacaggccagatgtgacggctcatgcctgtaatcccaccactatgggaggctgagacgggcagatcacttgagctcaggagttcaagaccagcctagacaacacggcaaggctgcatctctataaaaaaattacaaaatttagcctggcatggtggtgcacgcctgtagtcccagctatttgggaggctgagatggaaggataccttgagcctgggaggcagaggttacagtggactgagattgtgccactccacttccacctggacgaaagagccagaccctgtttcaaacaaccaaaaaaacaaaaacccaaccccccaaaataaaaacaataataataataaaaataaataaaacagaaataccataggccttttgggaggaggtatgcaggaagcggatggggagagacagtgcccctacttgcttcaatgggcagatctactctttttttttttgagacggagtctcgctctgtcacccaggctggagtgcagtggtgcaatcttggctcactgcaacctccgcctcacgggtttatgccattctcctgcctcagcctcccgagtagctgggactacaggcgcccgccaccgagcccggctaatttttgtatttttagtagagatggggtttcaccatgccagccaagatggtctcgatctcctgacctcgtgatccaccctcttcggccttccaaagtgctgggattacaggtgtgagccacagcacccggccggcagatctactcttaagtgtcacttatcagattcgaagaagggttttggtttaataaagcattatgctccttgaaacaagtttgagaacccctgggttagaggacctcttgcccattgtgtgctcacacacacacgacacacacataccccatcccagtacgtaatgacttccctgacccggagagaaggcgatatgtcccccttacatctcagttggctccacatcgccagctctgtattccactttccctctctctacaaccccagtctatgacttttgggccatggagtctgggttcctgggcaacctggttcacatccttctcctgccggcatggcctggctccatttctgttcggctaccaaagccccaagctttgtagagcctgcctggccttgaggaggggaatgggctccatcctgagagcctgcaggagggtttaagcctcccatcccccattgctacagtagctcccccagcttttcattccatatcctttatttttatttattaaaaacttaatttttggccgggcgcggtggctcacgcctgtaatcccagcactttgggaggccgaggcaggcggatcacgaggtcaggagatcgagaccatcctggctaacacggtgaaaccccgtctctactaaaaatacaaaaaatagccaggcgtggtggcgggcgcctgtagtcccagctacttgggaggctgagggaggagaatggcgtgaacccgggaggcagagcttgcagtgagccaagatagcaccactgcactccagcctggcgacaaagtgagactctgtctcaaaaaaaaaaacaaacaaaaaacacttaattttttttttttgtagagacagggtctccctatgttgcctgggctggtctcaaactcttaatctcgagtgatcctcccacctcagcctcccagagggatgggattacaggcatgagccaccatacccagccacatattttttatttttgtttctatgtgttttctgtctgttctttgctgtctcctccatgtctagaacagtgcctggcacatgataggtgctcagtaaatacaggactgaagaagacagaggcagacaggccagatgtggctgctgtccttagggaattgacagtccatgacctatgagaatgagctgcagactgggaggcaggtgtcccagcatgggctcaccaagctcctaccctctcccggtccagctttctcacctatgaaataaaagtgaagctggacatggtggcccacgcctctaatctcagcagtttgggaggccaaggtgggtggatcacttgagatcaggagattgagaccagcctggctaacatggtgaaaccccatctctactaaaaaacacaaaaattagccgggcgtggtggcagttgcctgtaatcccagctactcgggaggctgaggcaggagaattgctttaacctaggaagtggaggttacagtgagctgaggttgtgccactgcactccagcctgggtgacagagcaagactctgtctcaaaataaacaaacaaacaaacaaacaaacaataaatgaaagtgatggattacatgaatggttttcaaactgggttcctcagggctcagtttgggggagaatgcaaaggttaaatacaaacaacaatggaatgtagtaacattggcgcttgggcgagtgctctgggtgaggaatgtggtgctcatggggagaagagccgcatcagagcaggcttcctgcatgaggcaaggaggaaacacaagagctgagagctgaaggagagggagtgagggctgccagaggagctgggaggcgatttcaggcagtgggaactggagctgcaaacccccagcctcctgcagtctggctatctgtaccagccctcacccatgcccaccaccctcagggcactcacatcccttcttgcactgatattttcccgtcctatcatgaccctcgtttgagggtgcagggaggactggagctcagagagggagggttacctggccagaccctaacccgctgagttccagtggagttccttccatcccccagcactggatggggctggatacctggagagggaccgtgctgctcttcctgggccctgcagcctgcctggctggtccacatcttcctgggccaggagggcagtatggtgcgagcttctagctctctggctggggccccctggcctactgggctggcttcctgccctggtggccctggcccagctccctagctcatgtgcctctgcagcgagtggtcagccccttcccatctgcactttacaagcctcatcgctgaatcctccccatagccagggagcctggcactctcctctccagagaaggaaactgtccagggtcacacagggacttatgggcaggtctgtgtgacctgagtctgggctctgaactggtgcttgcagggtcttgccctctggctctggcagcctgagtgttactgtaatccctgagcctttgaacaagcaggcactgcttcctgagatccccattgctgctgtcagcgtctctgtttcccagctccacactgctgccaggacagacgtatcttctgtcttgtagcatctccatttctcttccctttagatctattttttttttttttgagatggagtctcgttctatcatccaggctggagtgcagtggcgcaatcttggctcactgtaacttctgtctcctggattcaagcgattcttctgcctcagcctcccaagtagctgggattacaggcgcatgccaccacgcctggctagtttttgtatttttagcagagacgaggtttcaccacgttggccaggctggtctcaaactcctgacctcaggtgatctgcccacctcagcctcccaaagtgctgagattacaggcatgagccaccgctcccgggctggatctatttcaatcaccctccttcctctgcagcctgaaacttgaggctttgcccacttcccaaaggcacgagtagcaatgaccatttgttctgtcatttggccatagctctaggtcagaggacagtccttcatcaaatgtttgttaagcatgcaatctagacaggggaggacaagggccaagtaatgtgttaatttcttcattcactaagcacagagaatggagtagaaggaaggtggaaaggagaaggaaggaaaagagagaagaaggaggatagaaaggaaggaaggtgggagggagaaaggaaagaaagagggagtcctttaggttatctaagccccctcaggacttggtctggccctcacagtccaagaacagacttgggcttgagcctctgaccagccagatgactgagaagctgaggaacagcttgagcctcagttttttcctctgtaaatggggttgatagcagttctgacccagcgggctgttgggggagtcacagagatgctgggtgctgcctttgcactcaaaagggtccaggctaggtgtggtggctaacacctgtaatcccagtactttgggaggctgaggtgggagaatttcttgagtccatgagttacagaccagcctgggtaatatagagacaaactgtctctataaatttttttcccaaagattagccaggcatggaggtgtgcacctgtagttctagctgcttgagagtctgaagtgggaggataacttgagtacaggaggttgaggctgcactgagccatgatcacaccactatactccagcctgggtgacagagccagaccctatctcaaaaaaaaaaaaaaaaaaaaaaatcaaaggggtccagcatgcatcttcctgtcagcttacctaagggagcatgataaattgagtccctgccacgatggacatggggagtgtagtgggagggaatggcaaaggcaccacaggcagagggaacagcctgggcacagtggggggtgtgatgtggcacagcactgattgtgggaagcgagggatgtgggagatgaggcttcaggtagtcagagcgaggttgaggcaaagcctcacctgcatgctctagatgaggtccaattcctggtacccagctcctagcctagtaatgggccacttctcccagggccacagttttctctcctatcaaatggaacatgttagcactgctctatggtgccaatgaagggtataagtgtccagtgcccatttcctgccccagcagaggcactttcttttccttgtcctcttgcctactggggaactccttccatccctggttcctcccccagcttctgcgaggcccctcctctgagcccccacacctcatcaaaccctcaacaccgtctggtgttttccttggtgcctcttcaagatgctgtgagctccttgggggcaggtggtgcctgtgtacctctattttttttttttttttttttttttgagacggagtctcgctctgtcgcccaggctggaatgcagtggcgcgatctcggctcactgcaagctacacctcccgggttcacgccattctcctgcctcagtctcctgagtagctggtactacaggggcccgccactgcgcccggctaattttttctttttttattttttttttttttgagaaggagtctcgctctgtctcccaggctggagtgcagtggcacaatctccgctcactgcaaactccgcctcccgggttcacgccattctcctgcctcagcctcccgagtagctgggaccacaagcacccgccaccacgcccagctaattttttgtgtttttagtagagacgaggtttcaccgtgttagccaggatggtctcgatctcctgacctcatgatctgcctgcctcggcctcccaaagtgctaggattacaggcgtgagccaccacgcctggccttttttttttttgtatttttagtagagatgggctttccctgtggtcttgatctcctgacctcgcgatccacctgcctcggcctcccaaggtgctgggattacaggcgtgagccaccgcgcctggccctgtgtatctgtttttctggaccgccatcatgttcaggaaggcatcgaatattttgtccgcgactgcaatcacacactgcatcatccctgaaacgaggtttccacggataaggtgcagcaacagagagagaatcctagcaactttcaatcattttcttttgaaatggttttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctctgtgtctcctactcccttccaatatgtggtgactccccagtctgtcaatgtcttttgtgactttgacacttttgaagaacagttattttgttgaatgtcccctaatttaggtttgtctgatgcttgcccatgataagactagggttacaggatttgagggagaactccatagagtggatgtgccctttctttttttctttatcatttttttgagattgaaactcgctctgtcgcccaggctggagtgcggtggcacgatcttggctcactgcaacctctgcctcctgggttcacgccattctcctgcctcagcctcctgagcagctgagactacaggctcccgccaccacgcccggctaattttttgtatttttagtagagactgggtttcaccacattggccaggatggtcttgatctcctgacatcatcgtgatccgcccgccttggcctcccaaagtgctgggattacaggcgtgagccaccgtaaccagcctgccctgcgtaatttttgttgttgatgatccaaagtgcacccactcaccatctctggtagctgggaggagcaggtttttgggtgaaggtgaaagagccggagttggggatgtgtgtggctggggggtacaggtgcgaccactttgcagtccactcctgtgagtagggcattcctgagggagagaaggcctggttagccctggggctccttcgaggcctggccccaggccttgatacctagagcagcctgacacatgtgtggatggactgccaggcggtccccttaggaggggctgttctagcagggaccctggcttgggtgaccaccacctcctgccacactccaggatccctgtccctgctggaagccgggcccagggccatgccagccgtgaggggttcctcatgagcctcctccccgggacccaggccccatgcagctgccccctcccacctgcctgacccccctggcctgcacttccctccatccgaatcctcaatctccgcctggaattcccttccctcctcaaccccacctggaaactctcctcctcctcccacacagctgggactccctttctcccacctctgggggcccaaagctctggatgccaccctagccctcagctggcctcacctgtctcctcatagccccacagcttgatggtgtctgtgtgggcagcgcctcaacgtgccaggtcaggctgaggttgcctgaggtgttggcggtgccgtagtattgccaatgcatctcgttcatcaactcactcttctccttcatcaacactttgttggggtgcactgggcaggggaggtgaggggtgagtgagggctgggcccagggaagcagggaggaggccctgaggcttcaagggctgtgggagcctccagggccaatgcatggcagcagctgggtgatggtctctccggccctcatggcagaaaaggacgctgaggccggagaggcaggggcctgccctccctccactgcccacgcctctagcctccacctggcttctcccctgccctggtgtggcggagctcagtggataggcactggcccacctctctagggacccctgcagctcccactcactctgggctgggaccgtggtctggatgccagggagtggaaaggagctgaaggaactctcgcaggcgggcaggcctcccaagggattggttcagccagagaggcaggacacggacgggccaagtctcggtgtgcatagattagcgctggggaaagtccccgtgggggcaggctgtgggcagggaggagggctcaccagccagccaagtgcccgcacgagggaaggagtggccatcgtccagtgagatggtgaaggggacgtggccgctctcatagagcaggggcgacacgaagtgcacttgcccggaggagtccacatggccgagggtctggatgctctcctgtggcatgcaaacctgtgggcctggtggtggtaggaggtgctgggccactgcaggctgagcatctcgacagtctgggcccccaacctccctggggaacccatccaaccagctgtcctgtgccctcctgcctgtcctgggtctgaggggctccattcagcctgccagtgggtctgagccctcagcatgcacagggatgggggcgtggggccccagtgcccggcctcctgggcctcccaacctgcagatcacactggcgtctgtggggctggacatcttgaagtgccgcaccacaaagtccttgccgcccatcatggatcctgagtagggcaatatctccaggcagaagtcctggaaatccaagcagcaggtaccaaggccggagcacgtcgggtggcaggaacatggcccgtccagggcgccacagcgcatggagcagctctcttgggcatctggaggagaggatgctgagggcctggcctggcgggtgctggactggctgccccatgtgcagggcctgtctctgtttctcccacagcccattagacagcagcatccccaggaaaatgctggccgggaactgcacaggccaccacgttgatatggtagaaagtcacagggcccgtggggatgggatgaatcttagcatagaccatctggctgttgccctgactgatgggctagaatgcagcgagaagaggcaaaaggctgcacccgctcagccctgcagggtcaggagaagccccctgggcatgactgcccttcagccaccaagtcctctatcccacaggcgggggtcctcagagggccacggtagctggagccctcgacctctcttggctccccagggtgtctgtgaacagtgcgccttctgggggccctgaagactgcagaagaaccccttttgcttgcctggactggggtgggggatacagctgccaagagtcccattcgaggcctggtagggaatggtgcagggtctgaacttgacccttctcactctcccaggggctgcaattgagaccccaaagagagctccgccctcagggcagaaggccagggctgctcccctcctttctggggggaggagggacatttcaagcaggtgtcccagcagtggggaaagggaagtgggggtgcacactgcgaggggctgtgggtgctgggcccaaagcatctcctatgggccatgagacccacggcagggccacatttccagggactggcatggaggaagagttgcagggagggactggggcaggtgcgtgcccagctgggggcccggaagggagacaggtcccatccccgggctccagagatgccaccacccagggaagccttggctgtcccagccacacctaatcctgccgctcagagtttgcataatttaatcagtgttcacctcccttcttgagcagatgaggaaactgaagctcagatgcggacaggcaaggccgagccaggcccttggtggcttctgggagcccctgcagccagggcgggtggtaagggctgtggcctgggactggtcacttgggccctgccacctgggctggacgtccagacaggcgggtggtcctctcccagctgcagcttctcaaggtgtccaaaagggacccttgccacacttgcagggagtcagagctggccccagggcatgagcttaggccatctggtctgtgatctgccccagcgcttgcggccaggccagcccattgttccccagcctgttctctctcttgcctgggtggtgcctgctgggaaccacagggtgttggcagccacccatggctccagagaggtgggcccctactgaaagtgttagaggcatgtgctgggggacttggctcctgagtccccacacagagctgttccagggaagccacacccgcatttgatgtcttcccacctcccaaagacatttggtgagaggcccccaagaccttcagcttctcaggactgtttccagaggggagaaagtcccttaacccacaacggtgctcagggcacctctgcaggtgagtgtcctgtaagtggatgctcaggcgctgagccacggagagcctgtctcctggccccaggctggcgagggcattcatcccaggcccagggctgaggttgctccctacagcactgggtgcaggtgtccatcctcctgtaggtgaggctccgggtggttcgtctgagacagttcccaggaactggaggagggagagctgctgcttcctgtttctggcctgggaacccttgctgcgcgtgtctggagacgatggaagtccggtaggggctaggtgtgcagtctgggaagctccataccacaggccctgccgtcagctgagtaactgaggctggctcatctcagccccccaaaggtgggttcagccagacccatatggggccgccaagcctctggttccaaaagggcagtgcccagccctttaggcctttcttcttgggtggtgggtgtgtccagcccatgaggggcacagggcagtgaggagggtccccatctccatcctggacagagagcctgctccatgggaggtcccaggggccaggagggcccctgtggtgctgggaggggaagagagttgtgaagggtgggtttgggtccctggaacctgtgcatccccaagacagatgggcctggagccttcgggggcggggccagctctaggggcttgtttaatgctctgtggtggctgccttaaaatacttaatcatttttggtcaggcacggtggctcaggcctgtaatcccagcactttgggaggcctaggtgggcggatcacttgaggtcaggagttcaagaccagcctggctaacatggtgaaactccgtctctactaaaaatacaaaaattagctgggcatggggacatgtccctgccccctgccccttgtgcccaccctctccctccccctgccccttgtgcacaccctctgtaccccccttcccgccccagcctgtgtttgcagtgctacagggtggctgcagccttcgcctcccacagctcctcaagttcagagggctgggaacccctgggatgtggctgggatgaggaccctgcccctcgtcaggcatttccaggcaaggggcacagagacacagccagcccagcagctgagcccctcctatcaggccaggtgggaaactgaggcatgaacacaaccccagactggaaataacaaagccatcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactagggccccacacaccaggaggaagaacccagtgcagagagtgccagcaggaagccacaggggcagggaaggcgctcctgggagggtgggtggctgcgtcctgaggctgagcagggggagccggcctagggacaggatgtgcgcaggcgtggaacaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgaggacactcctgacacagagaccccagcccagctggcaggggaaggggagccctcaaggacccctgtaggttggggcatgtcccgccaggtggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcggaggttgcagtgagccgagatggcgccactgcattccagcctggtgacagagtgagactccgtctcagaaaaaaaaaaaaaaaagaaaagaaaagaaaaaaagaaaaatgacacttgccaaagcgctgtagggaagactgtccaggaccgtgtcactaggcataagggaccacggcgatgagattctgcagtgggtaagagactgggctcagcctcgaagacagcatgggcaagtgggatcggaccgtcaaggagcagggggaagactatccaggaccgtgtcactaggcataagggaccatggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttcttgctaaactgactttgcagaattcttgctaaaactagagtttataaggaagtgctcagatgtgcctaggagaaggctcaggagcctaaataaagcttgaccaagcagagaatctttgtcaccagcttggtgagagtgaggcccagagtgggtcagggcttacctgctcaggttgtacaactgggaggggtccgtcaggagcctggagtcttcccactgggggctgagtctgggccctcagggcacatataggtagatgctgtcaggcccgacaccccatgcagtgcagactgggatgctggtgcctgtggcacagactggtcagacccaccccaggctagacattccttgcagggagagctgaggctgttgatgccaggagcagacaaacaaggtcatcaccaggtaatgagctcgttacccacatcaggcaaggccattgctgggtaatcatttggcctcctgcagagccacctgccctgggacggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtcggggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccataccccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgctccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacacctgcctgtccacccctcaccaacacctctgcagtcctcttcagggcccaacagggtccccaggaccccgctcccattctgcccttgctcctgccaacctgtcttctctatgcccatgactttgggaccctctgccataagtaccagcccccacatctgtagcctctgcaggaacaagccctaatctggactcattgcaatggctcaggttctcttccagcctgtccatagacctccaggcagagatcacaaaactaacagctctttctgcaaatctggactctctcctacaccttctccaccatccaggcctccctgtcactcctcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcagagccagctgctggaggtcccagaggacgggtgactcagcaggaatgggggagtctgaggggttgacagagtgcccaattctcacctcctcctgcaccttccagagagacgagctgcagggagtgattgagtggatgaacatgactagagggacccagtcttctcctcagcagctgcttgaggacagtattagcggtcccctcaatccccccccccaacacatgcacacatgcactgatctgcaggggccagaccccagtggacccggggacacagcttccaggggctgtcttgccatgtcccttcccagacctgcctggattcatgccaggccaacctccacaatttgctgagggaggccccagggtccagggcacccagagtgctaactagcccctgggggtacagggagaacagcatgctgtgtgggggatactactctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctgtgtcctggggcccacccgggcctggcctctgtgcaggctagcactcagcatgcttagtgccacactcggcccaggagaaatgacccagccctgggctcagagaccccacagtgggtggatggaaaacagagtcatttaaatacaactgtgaagggtgctgtggaggaggggctcgaggtccccagtgtgggatggggtggtcatggaacatttccctatctaagtgggaaaagtgagagccaccaggaaaatggcaggggttggggggagaggaactgtgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatcactacaaaaaaaataaataaataaaataaaataaataaaaataaaaataaaaaaagccgggcatggtggtgcacgcttgtagtcccatctactcagcagactgaggtgggaggatcgcttgagcccaggagatggaggctgcagtgagctatgattgcaccactgcactccagcctgggcaacacagcaagatcctgtttataaaaacaaaacaaaacaaaaaacccagcttgagatggccagggatttccagaggccctaggcgggccaccttggagagtaagggagaccctgaagagctcgcatggaaggaccagcagcttggggctggagatgccacctggatggattcctccagctgtgtggactaggggacagggtgaggagataatggcctggactacatggaaggacgtcgccctgagccattgaaaagggctgtggggtccatgaccactcctggccttcccttgactatgatggagacagtagcttctagtgtaaaatgtgagctcagttcctgactcgtgtctagcgggtggtgcctggtctttggctggcgatgctccatgtcacctatgcccagaaactgggccatgccctttgtgaggacctgcccacaacgtcgttgttcccgcagggtccccggggaaccgggctgcccgggacccagccctgccagggttccctgcgccccaggccggaacccccagggctttggtcgttcccaaagccgtcccgcgggccccctccacggtgcgtcgcctgggccccagcgatggctaggctgcagcctggggctcccggccatcccgggcgctggcggcggtggaggcagcagggcggatggcgacgcccggccgcccgtgggcccaggcgcgtagtgcgtacagagccagcgaggtgctgcggcgcgtcacgggccgccggcgggacccggggccgcaatccaatgggccgggccaggaagacgcccgagccccgggccggctggctcgcctgctcggccagctccgggccgaagcggcttcgcggtccgaggtgccgcggctgctgaagctggtggagcgtgcgggggccggggcggcgggcgcgggcgagaggaccggcgcgcacagccgcggctccgtgtgctcagtatgcggggagccccgcggcagggccacctacccggcgggggtcctggaggtcagcgagcggcggctgcaggagggactcgcggcagtgcgcgaggagctgggcgccgagattgaggcgctgcgcgcggagcttcgagcggagctggacgctctgcgcgcgctgctgccgccgccgccgccgtccccgcctgcccgccgcgagccccgcgccgtcccccgcgccacgccccgcggcccgaccctgctgcggacgctcggcaccgtgagcgccctggtcgccgcctccaggcccgcagacgacgccccggacggcccagcagaatgcggagcgcaccgagccccggtcaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtgtagcgtggctctgagtcagaagggtgcccgggtgccgccagttagggctccggtactggagggagggggtgggcgcgggacgggcggagggtgggccacgtgcgtctggggagtgcggctgggagccggggtccttgcgagagactgagtccggctagagaacagggtggagcccctttggaccttagagctgggcctttgggccttgggtctgggtcagcctttgggccagggctgggtcagcctccaggggaacagccgagactcctcttccttggggtgactgcaggttctttttctttcaaggtctcagtgacgaggcagggtctccacgcactggaatagtgtcaaaccacacacaagggcacagaacccagggacacagggcggctgagacacgcagctggtgatggccctcaggacggtgtcaaccagtatgtaatcacattccacacggcaccaattggacagcggcctccggtcagcctcactctgactgcaaccccctctcactggacagcatcacctggacacagagcctcacctagtctgtgtcccgtggacacaactttgctttggacagtgacaccaagaatactcacccctttacttagccagaccacaggcagccaccgggacacaaacatctctccagagtcaccctccacacagactccacagcagaactcccagggaggcactggggcatggcttcagagcaccaggcagccctccgcggtgcccagcacccgctcagccagggcagcctgcagcggagcctggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcagtgggggaccgcgccgggtcacgcacccaccccctccaggccacattaggctaaggtcactctgtgcattatttcattatttcacatggagggtcgcccacggttgacagaaccacaagctgagccccaggcgcatcagagcgcagtgcacacctgctagggtgggggaagagcggggggctgctgcggggaccgaggctctgggggaggccaagactgcgtgccccttaagaggctgctgtgggccaggcgcggtggctcacgcctgtaatcccagcactttgggaggccgaggcgggcggatcacgaggtcaggagatcgagaccatcctggctaacacggtgaaaccccgtttctactaaaaatacaaaaaattagccgggcgtgatggcgggcgcctgtagtcccagctactcaggaggctgaggcaggagaatggcatgaacccgggaggcggagcttgcagtgagctgagattccaacactgcactccagcctgggcgacacagcaagaccccgtctcaaaaaaaaaaagaggctgctgtgggcggaagttacccgtgagcggtatggggtgaaagtgggagggtccagcctggggcacgctgtggaacagggtcatctgagggtgcagggcaaagagatcaaaacggggtgggagaggggcagcgcctgcgggaggagccaggcaaggcccggggaggggtgtggggggcgagggggaacggtggctccacctgcacccaccggatgggtatggggtcctcgaagacggtccagagcaccgtgggctcgcagtcaggcggggtcagtgacccagcgaagcgacagtagctcgaggtgttgggccgcatcgacgccagcaggaaggtggacctcagattcactgagagccctgggcggcagagggagggggattggaaccagcctccccgtgccctgctggtgccatccccagcaaaccccccgcccctgagccggaaaacgacccggtggctcctcacctggctcaggcactttcctcaagcccgacactatggcgcagaagttggtgttgctacagtcctgctcctgggaggggctccaagtgcaaggggttctgagtgggggagtctctgaagagggaactcagctggggtactctaagcaggaggttcccagtggcaggaggcatctggcatctgggaaatggggtggagggttctcgccgccactggccctgccgattcaggcattcccaccgccctatcctcctacagatcctatagaccctagagatccccccatggactccacaggcctagcctgtccacttccaggatccccatgaaccccttttttggaaacatacatagaatcacagccctgccttcaccgccagcagcaactccagcagcagggcctgcactcgagcccatcaccgtggcgtggtgcctcctccatgctctggtactttgtgttactgtggaccacatgcatctgggggtaggcacagatgtgggagatacccagctgcccccaccttgctctctctcatctccgtgggagcactccggccaccccaccttgtgcccaagtctacctccatagcctggcgctgcctgtccaggctgtgctccgagtctgctcgcctcgggccccccccgcccccagctgatgtgcagccgcagtgcgcggtagacaggcaacagcagcccagcctcccaaatctccaggtggttctgaggatcagtgtccattcagagtagcaatgaaggggaggaggcacacgacaccctctctacctcaccacctgcccaccttgtgccattagggcacagggtacgagcagaggcccttcctcaggccaggctgctccccagtggggccccattgcctccatggaatggaacccatggtgtccatggctcctgctggtcagcagagcagagttccacagactgcaggggaaaccctcccccacacacccagcatggcatggaagaaggcagagggcagccctcctggggtggggctctgagcccagctgtgtgtggtcagggatcctggccctgccagagaccctgactcctggtcctcaggggccatggctggttgtgatttgtagggtgggacctggcacctacacagagggcgcatctggactgctgtgtgaggatgctcctttcctgtgaagctagcccctgtggagggtttttggccctgtagggtgtctcagctcccgtgtgtagggggtcctggtccctgtgtacactcaggagctctcatgccctgtgtggggctcctgctcctgcctaggaggggtcctgaccacagggtgctgacctgtgtggctgtcattctccagggtccaagggcctggaggtgctgagtcatagcctcggaagatgaagggccctagggtagagttccgccggaccctgtgaaagtcaatgtcgatgagggactggcctgggcccccacaggcaggggccagcttcttccagtgggtggggactgctggaacaaggactggggcctttggggtgggggtggggtcagggaggcagcctgggggtgcagcagagagtggcccccatacacccagaggatagcccagcctcaggaaacccagctccctgcttcccccacacctgaacaggtcacagcatcccccttctcttgtaccctgcatctggcctatccatctagtctcccggttggctgccccatggtgagatgaaggcaaaagagtctctggcacacagttgcacacccacactgggacctctatcacctgcacacacttgggctggccacagtaacaggcacaccagccttgactgactcgggaccggcgatcacagcaggcccagactcacacacagggggacagtcacacacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctcactcagcctcacatgacactctgtcctcaccacacttggggtcctgggagtcgtagcaccaggcacctatagagacagtgggcaggaggctgagctgagaggccagtcatctgggccctctccaagccccatcccatcagctggggtccaagaatgaagtaggccaggggcttaggccaggggaggccagtgaagaaccttctctcctgtcacccctaccccagtattttctctccccagtccctccccactcccagtggcaagacctaaggggtggtggagcatggcaagagggtagattggagaccagacgggaagagtcctggtgctcactctcagagtctgcaccacaccagctgcaccgcaaggcgagcatgatgccaggggcgtgcgtggctcagtggcagccgcagctaggaaggactagaaagtggctagaccgcggagccaggatgctggcctggctactacatatttattcattagctagctgggctaggggcgtggctattgaggagaggatgggaggggtcagtgcccaggcagggccaccaggaagagcgcgagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgcccatgactttcggggcaaggatgggaggaaggtgtaggatgtctcttgccccgctgtgggcctggaactgccaccccatcccaagaccacagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtaatgtcaccctggtcttatctcatgccttagcccaagctgtgcacacaatggggtcctaggtccccctcacctcccagattccaccttcccagggatgggaccccctagaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtctcgaatgcctgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtccgtggtcacacagctcagggcaggtatttattagtacatgaatagcttagctgtgtcatagtctttatgtgaaaggcacaaaaaaaggcactttggcaggctcaaagtgtggggattataggtgtcagccaccgtgcctagcccactggatgacttatgatatcatatgtgacattgtgacatcatgtgagtcagggatgtaccccgttctcagctgctatatgctatgttacactgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcacctgaggcaggagaattgcttgaacccaggaggcagaggttgcagtgagctgagattgcaccactgcactccagccttggggacagagtgagactgtatctcaaaaaaataaaataaaataatctaggacaaccaagagaaggactcaggctcaccttactctatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgcaggcctgattcacagtgtatgtgagtcacaaatgtcacttatgacaccatacagcaggtgagaggggatagtcattactcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggagatgcagacacaaatcacactgtgtgctgtatcccatatatgtgtttaatttctgtgtttaagagagctgggttcatgaatgaacttagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgttcactgatacatatttgctccgtactgaagtgaggcagatgcatgagtgattgagaataatgctaccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcccaggtgtagcgttgactcttggaaatactgtggttagcattctgtgttttctgtagtatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccaatgtttttattgtggcaaaatatacataacagattataccatttttaagtgtagaatttagtggtagtaagtatagagagaatcttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccgggcacagtggctcacgtctgtaatcccagcactttcgggagccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactgtaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtacataggttaaactcccaataaaaagacataaatcggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttggggtttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcgataagcactctgtcctccaagtgttagcatctgcgttctggttgttgattgctacttttgattatggaagggcaaacacagaggccggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacacagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccccaaaacagcaaaccctgaggaagaggagagtctcatctccagagttactgcattattatattcaagtgtccagttttcaatacaaaacacaaggcatacaaaaaacaagaacatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagacgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcacttgaatccaggaggcagaggttgcagtgagccaagatcacaccactgtactctagcctgggcaacagagcgagactctgtctcaaaaaagaaaaaaaaaagctgaacacttcccaaatttgatgaaagacatgaaaataaatatccagaaaactcaatggactccaagtaggatgaaaaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagagtttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaatgtttttaatggccaggtgcggtggctcacgcctgtaatcccagcactttgggaggctgaggcaggcagatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggcggaggttgcagtgagccgagacagcaccattgcactccagcctgagcaacaagagtgaaactctgtctaaaaaaaaataataataataaaagtttttaattaaacaatttaagaatatagtatcattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaatatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatctttgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatttatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaatttttttttttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaacgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttctgtttttttttttttttaattatactttaagttctggggtagccgtgcagaaagtgcaggtttattacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttcttattgttcaactcccacttatgagtgagaacatgcggagtttggttttccattcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagcgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcactttaaataatgtacaaaatctacaaaaatcatatttaccaggacacatctgttaaataaaagcattgtttcgtgttggtatacatatatacaagactatgtataacagactgtttcccctccctgcaaccacagaaccatcacacacaggcacagatacacgtcggctatgccgctttccacgaatgcatggaacccaggacgcgaacccacagctcgaggtcttataccttcactactgagctgccgccactgcagcagcaacacctctgcggaggtgttgctgaaatcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgaccgcagtccttcttcgccagcaagtgtgggcttccaaagacagggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggtggggccctcggaccccttgtctctctctcccaatgccgccccctccacgccgcatctctacctttggagcgcagtgcccatgggctgggcagctgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacatttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccaaggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagctgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccaccctagcggcgccctcccatcccggggcctcgctggctgtgccctggatggaaaggtcccgcccctcatggccgggcccggctctcccctggctgcggtcggcatcctggccaaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgtgtgttttctgcacctggtacagctggatggcctcctcaatgccgtcgtcgctgctggagtcggacgcctcgggcgcctgtacggcgctcgtgactcgctttcccctccttgcggtgctggcgttccttttaatcccacttttattctgtactgcttctgaagggcggtgggggttgctggctttgtgctgccctccttctcctgcgtggtcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttgggtctcatgctgtcttttctcattcagaaactgttctatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttcccgcttacatctactgcctccgcctgcagccctggaaggctgtgcatggctgggccccgctggccccgggctgtgcggctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggtgggacagaggcctcccatttgggctggagagcaaccactggaggagcattcatgagaaacattctagcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgcggcaagtcgcccgctgcgcggacccggcctccgcccgcctcctgcgtcctgggggaggcggctgccgggggtggtgggggagggggagggggaagaggccgccctccgcccgggtgcggggagggggcgcaggggtgtccggccaggccccccgcctccccgcctccccgcagcagctgccccgcgcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcactgcaagctctgcctcccgggttcaagtcattctcctgcctcggcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggtgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggtttctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctaggaagtccataatatgtttgacccacttcatggtggtgtcctataaatcccaaaggtttttacttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggcgtccgccatggcacccagcttgcattttcattttattcattgtattcttcagttctagaatttctgtttggttcttattatttctgtatctttattgaacttttagctttgttcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacagactttcattaatgtctatgaagaagcaaatacctcttcttttttttttttttttttttgagacagagtcttgctctgtcacccagctggagtgcagtggcgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagactgtggcaaagcaagactggaatggagtcacagggctactttactgtccatagctgagactgagatcagcaggcctgttaccaagggtatgtaaaggcatcactgaattcctgggcaggcacgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggccgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttccgttttaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacatctgtaatcccagagtaatttgggaggctgaggcgggtggattgcttgaagccaggagcttgacatcagcctggccaacatggtgaaaccccatctctactaaaaatacaaaaattagctgggcgtggtggtgtgtgcctgtgatcccagcttcttgggaggctgaagcgtgagaattgcttaggagcccaggaggttgaagctgcaatgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggctgtggccagttgtggtggctcacacctgtaatcccagcactttgggagactgagggaggtggatagctagaggtcaggagttcaagatcagccaggccaacatggtgaaaccctgtctctactaaaaacacaaaaattagctgggagtggtggtacgtgcctgtagtcccagctacccaggaggctgaggcatgagaatttcttgaacctaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctatctgcctgtctatgttttagagacaaggtctagctctattgccctggcaacaatcagatgcaaccacaatcagtggcacaatcggctcactgcagccttgaattcctgggctcgccactatgccagctctttttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaatctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactgtaagaaaataaaacaacagatcaatatgcctctgatcattgatgcaaaaactctaaaaatgctagtatactgggtggggcacggtggctcatgcctgtaatcccagcactttgggaggctgaggtgggtggatcacctgaggtcaggagttcaagaccagcctgaccaacatagagaaactctgtctctactaaaaatacaaaattagccatgtgtggtggtgcatgcctgtaacctcagctactcgggaggctgagacaagagaatcgcttgaacccgggaggtggaggttgtggtgagccgagatcatgccattgtacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagttttacattatatgcacataccacgattcacttttccattttcctagtaatgagctttaagattatttccaatttttagctattaccaataatgtttcaacaaacacctttggacatctcttctgcaaatgtgtgtgtattctcctggagaaggtttaccttgtggaatttctagtgtgtatgtgtatgtgtgtgggtatatatatatacacatatgtatatattttcaactttactatatatttccaaaaaactcttcaaagtggcagatttaaactccccttcgccgtatataaattcacggttcctaaagcccttggcatagttttgtgtttttatagaaaagggcataaagtcttattgctgttgaattgtaccttgctcttttcagttgtcttttcacaataattcactatttatcatctgttgtgaatattgtgtagtagttcttaatcattttttctactatattatttattttatatcattaatttgtagaaatcctctttatataatggatattatacttttcaattatatattttgtaaatattttacccaattttctggcttgcatttaacctttatttaggatgcctaggatttttcattttaatacagtctaatttatttttcttttcttttcttcttcatgcattctggcatttgattaataagccatttgttgcccaacgtcattagttctctgtatatacttttaaatatcttaaacatgtaatattcataagtaatttcacaagtagtttaagatttgagtctttaacctaaatagatacaggattttgtgatatgctgtaatatacagatttttatttctatatggataaaaatttatatgttttttctgacatcatttattgaatagtataatttttctactgacttttagtatcatatcttttattacaagtccaatgtattcagcatatctatggatctatttcttggtgcttccattttttcccattgtttaacggtgtatcactgagccaaagcaaaccattttaattattataattaaaacacatttaaatattgataggctattattgttcagaataactttggttcttcctttccattgattattttaatatgacttttccaatcaagttctaaaaaaatactggtggtatatttattgaaataactttaataaaattaaatgaaagatcatgtatttgttttctgaattaattcttagatacattaatgttttatgttaccatgaatgtgatattataatataatatttttaattggttgctactgtttataagaatttcattttctctttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgctttctttttttcttcctctttctataatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttatttttttcctacatctgctaaggtaatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttcttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggattcggcccggtgtggtggctcacgcctgtaatcccaatactttgggaggccaaggtgggccgatcacgaggtcaggagatcgagaccatcttggctaacacagtgagaccccatctctactaaaaatacaaaaaattagccatgtgtggcggcacacgcctgtagtcccagctactcgggaggctgaggcaggagaatggcgtgaacccgggaggcagagcttgcagtgagccgagatcgcgccactgcactccagcctgggcgacagagcaagactccatctcagaaaaaaaaaaaaaaaaaaaagagtgcaatggaaagctggtagaaaatggacattgtttaaagaccaaaacaaccacactactttgctaatccctatcagctaaagcctagagaatatatgaggcatagatttacatggtgtttgactaaggcatgcagaatataatcttgacataggctgagtttatcaacatagatacatagagattctgaagttaaagtcttagcccaagaagttagaagtggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctgtaagaaattaaggattcgtttgttggggagggctgctggcatgcttgaaaagtactgtgacggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatctgactgttaggaatctttgatgaaggctgattctcagggagtgaactacatcagtgaccaactatttgtctttatataactgggtaatgtggatggattctaataaagggactacttacagcacagcaggaaagtcacaaagaaaccagacagaagagtgtaagtagtaaggggccaagcagtcatctgactagagacagtgccagcttgccaaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgagcattactgcctgagctccgcctcctgtcagatcagcagcagcattagaccttcacaggagcacaaaccctattgtgaactgcccatacaagggatctaggttatgttctccttatgagaatctaactaggctgggtgctgtggctcatgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggtcagaagttcgagaccagcctgaccaacatggagaaactccgtctgtactaaaaatacaaaattagctgggcgtgctggcgtggggctgtaatccctgctactcgtgaggctgaggcaggagaatcacttgaaccccggaggcagaggttgcagtgagccaagatcgtatcatcgaactccagcctgggcaacaaaataaaactccttctcaaaaaaaacaaagaaaaaaatatatatatattacaaaatttaaagagagtggtacaccagtaaaggacatttagcatgaacagaggttgcaggactggcagttgctctgatgagtcagtgagtacttggtgagtgaatgcgaaggcctaggatattactgtacataactatagactttatatgcactgtacacttaggctacactaaatgtatttaaattttttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggacttcagggtcttcagtggcaataacatacatgcagctgtcattctctatgataacaaggctttcttctggaagaactcgtggaagaccttcctgaagctgttttatagttaattttttttaatgagtagaagtactacactctaaaatatgaaaaaaatctatagtattatacatactgttgatccttgaacagtgcaagggttaggggaccagctcctgtgcagttgaaaatccatatataattctgggctatccccaaacttaatatatgatatatatcatatataatatatatgatatatctcgtatatattacttaagacatatatcgtatataatatatacgatatatattatacacaatatgtatgatatatattatacacaatatgtatgatatatattatacacaatatgtatgatatatattatacacaatatgtatgatatatattatacacaatatgtatgatatatattatacacaatatgtatgatatatattatacacaatatgtatgatatatattatacacaataagtatgatatatattatatacaataagtatgatgtatattatatacaatatgtatgatatatattatatacaatatatgatatatattatatactatatgatatagattctatacaatatatatgatagagattatataaaatatatatgatagagattatatacaatatatatgatacagattatatacaatacatatgatacagattataaacaatatatatgatacagattatatacaatatatatgatacattagatacaatatatatgatatagattatatacaatatatgatatagattatataaaatatatatgatatagattatatacaatataaatgatatagattatatagtatatatgatatacacgatatatcatatatgatatacacggtatatcatatatatgatatatacggtatatcgtatatatgacatatacggtatatcgtatatatgatatagatgatatatcgtatatatgatatagatgatatatcatagctgatatagatgataaatcatatatgatatagatgataaatcatatatggtatagatgatatatatcatatatgatatagatgatatatatcatatatgatatatcatatattatataataaatgatatatattatatataataaaagatatatattacataataaatgatatatattatgtaaaatatatgatatatattatatattatatctgatatatattatatattgtatattatatattttatctgatatatattatatattatatctgatatattatatattatatattatattatatataattatattatattatatattatatataatttatgatatatattatgtattatatataatttatgatatatattatatattatatatcatatatcatatatattatggtatattatatataattacattaaatatattatatataatataccataatatatcatgtattatataatatataatataatataatataatcatatataatatataatatattatattataaaatatattatactatgatatactatatattacatattacattatacaatattttatataatatataatatatattatatattatactttattatattacatatataattatacattattacatttcatatataattatataattatatataatattatatataatattatatattatatttaatataatattatataattatattaaatataatattatatataaggatgcaggatgtaaaaggaaattatatatatgttatatattatatatatataattatatgtaattatatatatatatttgggggtgccctatttcctatctcataacttattttaagaagcacagcataataatttgtggacttgggattcagtttttgaaacgaaacactgagccttcgatgaccttcctgtacctgtgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaacctttgtggtttcattttccctgattttgatttttcttatggggaacctgtgtggctgcattcaaggtatgttcatactggcctgtcaaatgcgatcttttcaaattagtagttaatgctttcaaaatatgttatttaaaaaattagcctctgtattttccatatgcagttataaatatgtttcaagattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaaattagccaggcatggtggcagctggtgtagtcccagtgtgaattgggattcagtttattcccaaattcccaaattatatatatataaaatatatatataatatattaaatatattatatatataatatatattatattatatataattttatgtatatatatatttgtgggttccctatttcccatctcataacttattttaagaagccagcataataatgtgtaggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcaccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatttttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaaattagccaggcatggtggcagctggtgtagtcccagtgtgaattgggattcagtttattcccaaattcccaaattatatatatatacatataaaatacatatataatatattaaatatattatatatataatatatattatattatatataattatatatatatatatttgtgggtgccctatttcctgtctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatcttctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaatttagccaggcatggtggcagctggtgtagtcccagtgtgaattgggattcagtttattcagtttattcccaaattcccaaattatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacctctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgctttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagggctttgaaaacctgtttacttgtgaatgctgttttgatgtattgtgtctttgttctcccgacccatcgtccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatagtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacaaggcagaaccctataccctccatgataaatgcagtagcagtgtatgtgggtctgtggaggttgaaagggacttggtagatgtcaagaagctagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcctgttaaccaggcacgcccctaagttccagtccctgagtcattcatgagtagcactgccaatgaactgacagccatgctgtgtccctccacatcccctaggtgactcgaagaagccttccaaaaagcatgtgaaaaggaagccctactctactaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaagaaaagctcctgtgctttcctaagggaactctactctacagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatttttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttcctcatacagtgctaatgttgaaggcctgaactacaacctctatttatcagccagtgaagagatcactattcaccatgcaagggagttccagcaccctctatgcctggaattacccacacctgcagagatcccaaatgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcgttatttatacattttcaataaatgatgatcttcataacataaaatcaatgatgtagtacactagaatactgtccctagtattgaatcttgtctctcagcaaagggttgcttaaagtcacgtgacagattccattcaactgatggcacatgctgtagcagcagttaaagcagtcatttgaaaaggcttttactataaacttacgtgtgagcctgaagtgggggataaaagaggcgattagctcccctgtgccatgtttctattatgtgcgtggtggaggaaaattacacaggaaggtgatggagagaacagagcaaaggattggacaggtccattgaacccataagactatggtgtggttagtgaatgagattggtcattttaggtcaaattttacccagagctggtgcagccactgcccattcttagccagaccttattgcaggcagctctgatcaatagtcaaggaggcagtggggcttgcagacttaattcattaaatcaccaaagcaccagcccacacggccacttttccagttaattgacagtagcttgcatattcaggtttgatcagtggaagggaagttactctttgcagacccatcttttgacaatcattttgtggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcatcacctttgtccacccacacaccttgggctaggaggactggagaaagacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctccataaaccataaggcgtcatgcccacggaaaagccgaacaggaaagcatgctccactgccccggagtcatgcaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatcctgctgtgttctcctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcaggaggctgaggcaggagaatcgcttgaacccaggaggcagaggttgcagtgagccaagatcatgccattgcactccagcctgggtgacaagagtgaaacttcatctcaaaataaataaataaataaataaatacataaataaaaattgagtatataatacacgaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccatgagttatttaaaagtgcattgctaatttgcaaatatttggggattttgtggctcttttacagttgttgattttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgactggtggtcagcagacaggacagaggtcctcatcagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacaactatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaagttctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacatttcggtcaaaaaaaattttttttttctgagacccaggctggagtgcagtggcacaaactcggctcactggaacctccacctcccaggtttaagcaattctcgtgcctcaacctcccgagtagctgggacaactggcacacgccaccatgcctggataatttttgtattttcagtagagacaggattttgctgtgttggtcaggctagtctcaaactcccagcctcaggtgatccacccatctctgcctcccaaagtgctgggattataggcatgagccaccacacccagcctaatttttttaagaaacaagggaactattttctaaattacttttgccaatttatatttctaccatgatgcatagcactaatttcaccgtacaatgtatggtaggccccaatatgtaagaaatgatgaaaataacacataaagattggtataaaacaaataagattatcattgttgctatcatctttgtcaaattctgaaaacaatctgagtatatttttatataaatatgcttggcaacatagctgaaaaacgcattatcagttacatttatcagtaacaaagacataaatttgaagggggaacaacacttgtactaacaacgcaatgtcagaattaacataaaaattctgctggtcactttggaatatttaattgcctggggcagtgtttagtagacaaatgagcatctatggagcactcaaagtaggggaatcaacagaacttgggtttgaaaagttatctgggtttagagcgtgaaactttgttagaggacacgcaccttgcatgagcgaggtgccctggtgtgtgtggacgtaccattatgcttggaggtacagcataatggtggcttcctccagaaagggacatttgggatggattcattccatctagacaacacagcctgatgtggcatggacatgaatggaggtgaaatggtcagtagttgagaggatcagtcctgacaagggccgaggtgaaaaacctgggaaccccttcaggtacaaagtcttcagttgaaaaaggaggtggtcacaggaaatactgagacaggacagcaaagcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatgtgggcttggctgtgcgtgttttctatcgtggggaaatatatataacacaatatttatcatttgaaccttttaaccaaagtgtgcactccatggcattcaatatattcacagggttgcataaccaacaccactatctacacccacaattttgatgatttcttacgaaaccttgtccacaataagcagtatagcaccttccccctatttccagcccatggtgattcctatcccactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttcttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgttgtagatttttgaatatatcttaaatatatttaaaatatattctaaattttagtctcttacaagagaaatgatttgcaaatatttccacctttgtgtagaactttagattcacaaacttcgttaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcgctgcagagttaaaacacaccagcattcaacccgtgtctcctctcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaggatataatttcagtacttctaattctcccatcagcagttataacaaaggattagtgaataaataccatagactgttttgcctagaattgaatccaatctatctattaaactttgcttttattcaagtgcaaaatgctaaaacacataactgcagtgacagccactgtggatcctcagaggtaaaagtagtcttgggacataaatcctgcaagctaatattgtttttacaggtttagaaaaccatttagctgggtttcaaacctcacagtgtgagcagtgggactctcatcaaactatagcatgtgcttcagtaccatttgtagactgactcattcccattttcttaagttgccatcagcaaaatgccagggactctatttcttgctccttagctcctcgttcttgcctgtctttccacgagggaagattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgcgagggtaaggttgccttgctttctctgaaatagaaatgttcctttcttggtgtctttctttttcaactgactttacatgtgaaaaaatgacaatgtccatgacaggtattaaatgcagttttctgagggggaggaagaagtgactcttagcaactgatatgtaatccaaaatggcatttagctatgacggcttcaggttgtagactgtatccttggggtccttgtccttggaagcaatgtcttctccttggattcaggattttgcacttgccaacctacgtggacctgagagatccaccatccagaagctgatgtcttttccagtgtgtatcctacccttgttttggaggccttgaagttgactacactttctgatcaagttttcagtattcattgagagaaacagagccttgtgcaaacaatccacaacatgacatacccctgaaaaagctttgtttctgtattgcaggtggtgcaggtggcccctctgaggcttgaatctagtaagtattctggaatcacttgccaagaaaacaatctggatgccaagaaaggtgtggcatccttgcctggtttcaatgtgaagagcctccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacgtgaagggccaagggagtggccccagctcccgagttcctgaatgaaacagtgaaaacacgaacccaggagtgtggaccagtgctgacgctgacatgcacttagtcatggggtgttcaccaccacacacggagtccagcattcatgtataagccctaaagcaacgagcccaagaggccccagacactgcccatcatcataaagtggcctccgtggtcacacaacccagggcagttataggctcatctccccacggaccggcatagtcatcagtgtgtcaaaagcacaaagatccccaggtgtttggctcagctcacagatccctttttttatttaacttttcagttcaggggtacatgtgcaggatgtgcaggtttgctacatatataaatgtgtgttatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacacgtgtaaatctcatacatacaacaggcaaatgcagaagcagtgtggtctcgcaagttgtaaagaggacagtcgcaattttgctggacttcaacctgggtagaagacatgagggaactctgtcactaaatcacggcagagttcaaggccacttgtagactatttcatgttacagaaggtggcctttagctactaagcaaaggcctctgtttctcatttctttcctgttcatcttcttggtcatccttcttccgcaagggaaacgagcccaagcaaaaggcagtttcaatattaatttgaccgaggttttgtgcagtttattatcatccgggtaatcaggtgcaacccagtctgcctagcagcccccctatctctgctctgtgttttcatttaataaacattttggtctacttactatgtgctagattttctcgagaccaagtaaatgagatagaatctttatgctggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcaccagataatgcatacctgaacctggaaactgattcccactgcagaaagtgttctgagccacatcccttagcttcactagtgcaggtccacctgggaggatgtcccagcatcagcttgacccatgctgtgatcagccacctccatacatcacaccaagcaagcccctgggtgattcacagtctccaccaccagggcactgaccttaactctgtgtttttctagctccccatgaggacaccgtacacgacatcactaacgaggacgccacacacgacatcgctaacgaggatactgtacacgacatcgctaacgaggccgccgacaagggcatcgccaacgaggacgccgcccacggcatcgccaacgaggacgccgcccacggcatcgccagcgaggacgccgcccacggaatcgccagcgaggacgccgcccacggcatcgccagcgaggacgccgcccagggcatcgccaacgaggacgccgcccagggcatcgccaaggaggacgccgtccacggcatcgccaacgaggacgccgcccagggcatcgccaacgaggacgccgcccagggcatcgccaaggaggacgccgcccagggcatcgccaacgaggacgccgcccagggcatcgccaaagaggacgccgcccagggcatcgccaaggaggacgccgcccagggcatcgccaacgagggcgccgcccagggcatcgccaaagaggacgccgcccatggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggttggggggggagggatagcatcgggagatatacctaatgctagatgatgagttagtgggtgcagcgcaccagcacggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgaggacgctgtacacaacatcgctaatgaggacaccatataagacatcaccaatgaggatgctgtatatgacatcgctaatggcacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtaggcatgaacatctgccagtgtgcattatcgatgtcatctgcagtttaatcaaatgtagacatgaacatctgccaatgtggactatttatgacatctgcaattcccttggtgtggtgctattgattggcagcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggacttcgacctttgactcaatcactataccccttcctattttctctctcaagttgtcgagagactatcagatctgtgtgacgtgtatggcatcatttcaccctcctaatgttttcttttctataattgcaggagccattgacactggagaatgatacgtaccctgaaataactcacttcctgaggaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcggggtatccatgctgcttgggaggttaagggagggggcatgaaatcaaaacgaaacaggaaatatgtgtcatattggatttggtcttttccgggtttattggcataatagttggaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccatttaactgctcattgactcttactgtagatgaggaggtggccagcagcccctgccctcccccagttggtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtaaaatgccaataaaacaattgcctatataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacatttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccatttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctacgctgattttgatgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcactgcactgagtggaaggaaggagaactgtgacaaaaattaaggaaggatgagagacgggagggcccttcatccagctgcttgcagagtcctcctgaggaggaaagccccgtggctccctggagaaggagcattgagggctgcgtgactcccacagtgaagtgtgtggtatgtctgaggacacccaggctggtggtccatgaggagccagtggcagagtgagaagcagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtgctaaaaattctgatggctcatcccatttaggggctgaaagttgcagaggtttaggaagctcacccacgatactggagcccccatctcctgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcgactcctatagtattgaaatgcataggttagcatttttggccaatttactcagcattctgggttaaaggcttttacttattttatttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttactaattattgtttacatttgaagtgttttatgaattaatatttaattgcatagatgaagattactagttataggcattttactaaccaatactcattaagcatagcgtggattcctatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttgggagtacctatctattttaaaattccaataacctgggaatttcatcccatgtctagagtcttttatgtaaaatatttccacaattaggagaaatatgtgcatggggattttctatgtagcggtgttttgatggaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgcagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctcccagacaaaacaaacaaaactagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggccaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccgcccaggttggtgccggactctccctgggcccccctgttctctcaccagccacatccattctccccccagaggcgctagtgactgtgcgtggctttccattcccaccacgtttgtctctaaccccagtggcagatcagtgtaagaacacagctgagtgctcctcgcctccttgccccttcaagggctcctcaccacccaccagatcaggtgcaaacttccaagccttactggatccccttccacattctgagctccgcctgccttcccatcgctatccttccccacctgcctccctggtagagaaaagcggagtgtgtgatgctgtctgaatgctgagcatggccttttgcagccagtccactgtgtacgctgcccctatcggagacctccaccttaagcctttccagcctggaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgctgaataaatgaatagcagttacaaaacacttgattcatatggaattaatgttggttctcaaagtgaaaaattacaaaaagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacagtgcttctcctcattgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaaccttcatcagaaaacaatgcttcattaatccgtgacaggacaagcgtcagcaaacttccaggcggctggattaggccttcatctatccatcaccttggagaggaacaaaataggtggcctgggaagataagcactatgtttctattagttaatatctaaagcggaggttaacaagctatggacacacaagccaaacccagccctcttggggttttttaaatctactttcaacttttattttagattcagtgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggttttttttttttttttaatggagtcttgccctgtagcccaggctagagtgcagtggcacaatcttggctcactgcaacctccgcctcccaggttcaaacgattctccctcctcagcctcccgagtttaaagtatgtatttttttaaagaaaatcctcttcagtgattttctaatttttctagattttctagtttttccatgcctattttcagcaggttgcattaacatgtacgtggtgacttagctttctgaaaagagctatggtataatgaatatatgccacttgccagaaaccatggtcaacaccatacatacctcattcctaagtgacctataaacatagcaaggctggcattaccatgcccattttatagatgaaaagatcaaggcttggtgatgctaagagacaggtctaaagctacaagtttacaaagtaacaaagtcaatttaatcataagcacattcacttctttgttcacttttcagatacaatgtttaaaaatatgtcaaatgataagcatttcctatttgttttactctgaaatatagtgatgtcctttgccagctacttaaaaatgttttgtccttactctgaaatatgaataactgatgtgtttgtttttgagacagggtcttactctgtcactcaggctgaagtgcagtggcatgatgtcggctcactgcaacctctgccttccaggctcaagtgatcctcctacctcagcctcccaagtagctggaattacaagcgtacaccaccaggcctggccgattttttgtagagatggggttttgccatgttgtccaggctggtcttgaactcctgagtgcaagcaatttgcccaccttggcttcccaaaatgctaggattacaagcatgagccatagtgccctgcctactgttgttttttgataacttgtttgccctcttcctccctttcttaccctccctcccctgatggtctccctctcctttatagatacagggccagtggcctcaagccagtaccttggatgtttacctctactgtattttgggctaggacattataattaaatttaataactattgaaacaaacgtcaagttaagattttgctacaagaaaggtgggtggacatatattaatagtttgggagtaaatgtcaatctttacgttcctgagaccttatattttatttatttatttattttgagatggagtctcgctctgttgcccaggctggagtgcagtggcatgatctcggctcactgcaagctccacgtcccggggttcacgccattctcctgtctcaacctccccagtagctgggaccacaggcgcccaccaccacgcccggctaatttttttttttttttgtatttttagtagagacggggtttcaccgtgttagccaggatggtctcgatctcctgaccttgtgattcacccgcctcagcctccccaagtgctgggattacaggtgtagtaagccactggcccagtctcttttttttttttcctggcagttactttctaaattacatgttttttgttttttcctttaaaacctttattgttgacaggtttttccacttacattatttatcttgcctgggccatgctcttccctaaaaattccactagagagaaactagcttccaagctttttcaggttgttagcagaagtaacttccttgaggctgtagctccgaggagctcagctttttgctgcctgttggctgaaggctgcccacagttccttgccatgtgggcttcctcaacttagcagtttacttcatcaagccagcaaagtggatatgtgtcccagtctcctacgacgcagtcctaaataatgtggtgaagggaagtcgtaatcaatgtcatcaatggactcagataaatcacatcatttttgctgtgttctctgggttagaagaaagtcacaggtcccattcacatggaagaggaagggatttcacaaaagcatggacaccaggcactttatatctatccatgcccacattttacagaacaagagaaagaccataaaatgaaactcttgagaaatgatcattcaacatatgactttagttgccaacctctcaggctacttttaaaaatataaacatatgttccagtttagatatatgaatatttgaacactttcctggagtccttcttttaagatcacaaatagggaatataactttatagcttagatgatatataaaaaataaagatcagatgtaaccagaaactgagtttctttttttttttttttttgagatggagtctcactctgttgcccaggctggagtgcaggggcatgatctcagttcaccacaacctctgcctcccaggttcaagtgattctcctgcctcagcctcccaagtagctgggactacaggtgcctgccagcatgccgggctaatttttgtatttttagcaaagatagggtttcactatgtcagccaggctggtcttgaactcccgaccttgtgatctgcttgccttggcctcccaaagttctgggattacaggcatgagccactatgcctggcccagaaactgagtttctactctggcaagttaaacaaaaaattagtacatatcaggctgggtggctctaggccacatgcaagcaagctgcaaactgaattgcctctgcagctgcagaaggctaatttctacattgatatttggaaacactaacagctagaaaacaccactctactcatttttaaaaataagatcatattaaatgatgttacatgcatcatttatatattgctcgcagtgccagcatcctcaaatatggttttaattttggtagatatcttgctagggggagcacatttccaagttatccagatatagggccctctttccttctctttctgtccacgtgcaaccagatgctttgtggagttaaagttgacatttatttaaatgccacttggtgtctggtttttcacctttaatttagggttttctagctgggatgtaaaagaatcacttggagggatttttcaaaataccaatggccaggccactagccagtcaatcagaagcaaaatctccttggatgggacctggaagtctttacagttttccagcattttaatgaacatccctgattaagaaccaccgggtcttaagagtgtgccatatgtatttttcaagttcctagaggctctccaaaacaaaacaaaaaaaatctgctttattctctgcctggtgttgatgcatcagtctctttagccgttagtctgatcctggaaatttatggtcataatttgatgagcaatgttgggaatgacttcttcttctttttttttttttttttgttttgagacagagtctcactctgttgaccaggctggagtgtagtggggcgatctccgctcactgcaacctccaccccaatactttcatttttaaatattatttatggcatccagatttgcataagatggactgggtcaatggccatgccctttataaatcaatattcttaagttctgcaaattcagtttcctaaagagccaaatcacatcctactcatcagcaaggcgggtagacatcattttcacaatcacttctaattttccaccattgtaaaaaaaataaaatatgtaatcactttcttattgtaaaataaagaatttacttttccaggacctactgcctccctgttccccccccccttttttttttttcaaacaatcttgaaccctttgtcacgagtcagttgccaagagaagcctatttgttggtttgagagcagttcatgcagacacagaccacttcctctgagaattcatttgcttccccaggatggaatctggctgggcctctgaccttgctggtcacgtgggccggggcctccatcagtcataccctggactcctatctgtgtctaaacacacgccccacccccaactgcacggcagccactcgcatagcactctgggagggctgtgggcatgagcagcgaggactccatcagcagctcccccacataagccctgctgatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccagggcaggggtcagggtttctcctctcacacagcacgtgggtggcaggaccaacaccgggtctgacctcccagccgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgcaatgaggacagagcttgcagagggaggacaggcatgcagaaggctctgtgtgcagccccagacctgggtaccttcgtcaccgtcctcaccccacctccgggtgcgcagatagggagcaggtctcctgtgttatggcccaagcagggctgttaggacactgagaacattccctcctcccgcaggagagagaggtccaaggtgccctacatcgtgcgccagtgcatggaggagatcgagcgccgaggcatggaggaggtgggcatctaccgcatgtctggggtggccgcagacatccaggcactgaaggcaggcttcaacgtcagtgagtgtcggcctgcgcaggacgggatggaggtgtgggcagtggtgtccccgatgagatctcagagtgctccatggcccaggcatgtcacatccttctctgtgtcttttcttcatttactgttttattatttttaaaaaagagaaaacaagagttgtacaaacagcttctatagaagccagtttttacaccatcgtacccactcgtgccacttggtgcagtggaccaggggcttctgcggggccttggccttcctgccttggggttggacaggaggtggaagcccaggactcagtgcggtctgtccactgccctgtatgaggatgtggtgggcagagggcactgatgaaattcagcgcaggccggggctgcagcctctccgcctccatctcaccaaccctcacaggctttgaaggacccggacctgcctcaaatgccaggggagggcactgagaccccagagggtccttcccagcatcttcaaagcaacaggattttgtgcctgcagacccttctttgcagcacacaccacccaccctgaccaggacccttagaatgcccagcatccctgggagggccctgtggtagtttcagctccctctgagggcccagaatgaacctggcctgtggtgaggatgtaagcaccaatggccaattgggtccaaaggaagacaccggttcaaacactgaaaccaatcagattctcccacggccttcctgctatcagaagacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccacacagtggtcagcatggcagggacggtgctttagccaaggcagggatggtgggtgactcactcaggatcttcaaggaggccgctgcatttccgtgctctttccagataacaaggacgtgtcagtgatgatgagcgagatggacgtgaacgccatcgcaggcatgctgaagctgtacttccgtgagctgcccgagcccctcttcactgacgagttctaccccaacttcgcagagggcatcggtgagcactggaggccttggcctcatgggagacgtctcctccacgtgcactgctgccctcagaggctgtgaaaagtgaggtgtgggaacccgagctgtgcttcctctgccatggtcggaattttaacccaacctcaaaaagcaggggaccaaaactgagcctatcctggaaggccttgcccatccccagagggctccccatccatatttctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtagcctgtgcatcacccttagggcaggtctgcctcccgggcccatgcacagaggacctggtctcccagcctgcaggtgcccctgtggtgtccaggatgtcgagggggtctctgcgtacttggtggggctgggaccctcccacttcccacctccttgtgtccctcactcccctgtttcattccatgctgagcctcccctgccttgggctccctggggagggggtggtggcaggagttgcccgagggcagctctgcccatgagcagctgctctagcggctcctcctgctgctgttcgccgggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtccctggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgtggggtgcccctctgctcccaccagacccccagcaccaaggaccttttcccccgacccctgtctgcagtaactcactgcttctaaggactagcaccactgccacccccgcccctgcctctcctctttgccaccctcctccctctgcactgtggccttaacaaagagctcagagctttggccgtggccagcagtgcatttggaccgcccccccttccctcccaagcacatcaggaagacctccccatcagcccagagctggccccttgtcctgggccactgagacccagaagtaccaaggctggagtcagcttgcagcacagccagggtcgaggtcactccctccctgaggactctagcacggcacagcccctctgcctctctcctggtggtggcgttgaaacagcaccctctgcttcggtcctctacaggatggcagagaaggaggcagtcaataagatgtccctgcacaaccttggcacggtgtttggccccacgctgctccggccctccgagaaggagagcaagctccctgccaaccccagccagcccatcaccatgactgacagctggtccttggaggtcatgtcccaggtatgggaagacagcctccagcccatgcaaccccagcctgacagaggtggcctctgcctgccccacccccagtcctgcccatcttccgacttgcattgtatgtggtggtggctgagattcagagacagggacttgcctaggtttgcatggatgggagtgatagggggtgcctaggccacctcctggtcctgctggtgcaccttgctgggggcttaaaaccaccccaagtgttcgagtgtggtggctcatgcctgtaatcccagcactttgggaggccgaggcaggacaactgaacccaggtgtttgagaccagtctgggcaatgtagcaaaccccatctccagaaaaaatacaaagaaaaattaggcaggcattggggcacatatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggatcttgggccccaaagacctcccaccagcagctgtgcgcccccttccgagccactctcctcttccccactccgcgagggcaggtcgaggtgctgctgtacttcttgcggctggaggccatccctgccctggacagcaagggacagagcatcctgttctccaccgatgtctaaaggtcccagtccatctcctggaggcggacagacggcctggaaacctctggctaatcaggccatctgtagagtgggaatcaagattttctgaggcatccttgggccacccccaggtgtcaggccatctgccaagagacagcggcccaaagcagaaggacaggtggcctgggcagatcccgcccaggtctgaaagccccaggctggcctcagactgtgggttttttatgtggccacccgagggcgccccaaaccagttcatctcggagtccaggcctggccctgggagacagggtgaaagcagtggtttttatgaacttaacttatagagtctaaaagatttctactggatcacttgtcaagaagcgccctctctggggagaagggaacgtgaccggattccctcactgttgtatcttgaataaacgctgctgcttcatcctgtgggggccgtggccctgtccctgtgtgggtggggcctcttccatttccctgacttagaaaccacagtccacttagaacagggtttgagaggcttggtcagcactgggtagcgttttgactccattcttggctttcttctttttcttcccagaaggatttttgtgcagaaatgggtcttttgttgccgtgttagtcctccttggaaggcagctcagaaggcccgtgaaatgtcgggggacaggacccccagggagggaatcccaggatacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaattttttccccaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaacatggcatcacttttttagaaagaggggcttggggcaggcagaggagagaagggagagcaaactgagagccaagtttccagacagtcctgcaggaggagaggatgcagctgcgcagagggaagcaggatcacatttaaggaagtgtgtggagtccctggatgacaccagcacccagtgcggctctgtctggcaaccgctcccaaggtggcaggagtgggtgtcccctgtgtgtcagtgggcagctcctgctgagcccgcagctcactggggagcctgacagcggggccatgtgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccgtgggccctgggtttgaagcagcctggctttctcttggtaagtggctggtgtcttagcagctgcaatctgagctcagccacctacacaccaccgtggccgacactttcattaagaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaactccactgagtggggtagtctggttggggcagggaccgctgttattttggcagagagagatgatccccactggggagaggctgttctgactctgcaggtgggacagggacagatggccaccagggtgacccggctggtcttcctttgctatgctaagccctgggacatggaggattcctgccacacagcctgggcccgggttcttacctgtggccaccgctctggcatgagcccctcagtcttgggtggtttctgcctggtccaggatttggtgttgctgctgagtccagcctttccaccacctccgcatgggctgtgggtgttgtcagctgcctcccgccttggcttcagtagctcacccagcttacaggggagctgccctgggctggagatgggcacgcaccctgggtcctacttgaatgaatgcagcttgaggagacccggccatatacactgggccacaggttaccttcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtggggggacgtcctgggtagagacagggcccgtggcagcagcaggctcaggggcaccctgcactggtgggctggggacctggtggagaccacgccaagggctggacaaggggacgagcctccaccctggcctctccgcaggcctcagcagccccttccacaggcagaagggttgacactgggttctgccctcactacaagagctgcaagtgccacgtgctgttctgcccaatctggtgtctgcaggtgagggaagggctgccgctggcccgtttctgagtgttcagcacctaagggtgacagcactgtctgtccctaccctccgggtcctgtttgaaaatcaagcccatgctcacaggccgatttttttttcttttagagacagggtctcactttgtcacccaagctggagtgcagtggtgcgattatagctcaatgcagcctccaattcccggacacaagggaccttcctgcctcagcctgccaagtagcttggactatagctgtgtgttttcttattattttgtagacatggagtctggctatgttgtccaggctattctcaaaattcccggcctcgagcaatcctcctgccttggcctctcaaaggttgggattacaggtgtgaggcaaggcacccagctcagccacagagccctgttgcatctctcttactaggagcaagagctgactgccccctcatccccattccagagtgttggggctgtgttcagccgaggccaggccactggcatggcccagggagcgggatcattcactgctgccccaaatctgagatcattccaccttgacaagacttcctcatccaatccctttacttgacagctggggaaaccagtgcacacagagcacccccagctcactcggggtctcagagctgatccatgagcggaggctgagatcctgggatcttgtcccccagcctccctgcaagcttactccctttctgctggaagagatggggccggacctcgaccagcagccctggcctggacatgactgtgctcatgcaggtattgaggccgagatgctccagcatcatatgtttttctttttttttttctttcttttttgagattggctcactgcaacctctgcctcccgcttaaagtgattctcctgcctcagtcttccaagtagctgggcctacaggcttgtaccaccacacctgactaatttttgtatttttactagagacggggtttccccatgttggccaggctcgtttcgaactcctgacatcaggtgatccacctgccttggcctcccaaagtgctaggattacaggcatgagccatggcgtcacttaaatgtagtgagaggccgggcttggcggctcatgcctgtaatcccagtgctttgagaggacgaggctgtcagatcacctaaggtcaggagttcgagaccagcctggccaatatggtgaaaccgtgtctctataaaacaatagaaaaaaatatccctgcatggtggtgagtacctgtagtcccagttactcaggaggctgaggcatgagaatcgcttaaacctcagagacggaggctgcagtaagctgagatggcgccactgcactccagcctgggtgacagagcaagactttgtctctaaataattaaataaatatggccgagaatggtgccttaggcctgtaatcccaacactttgggaggctgaggcaggtggttcatgaggtcaggagcccgagaccagcctggccaagacggtgaaacactgtctctactaaaaatacaaaaattagccagctgtggtggcaggcacctgtaatcccagctacttgggacactgaggcaggagaatcgcttgaaactggaagtcagaggttgcagtgagccgagattgcaccactgcaccctagcctgggtgatggagcaagactccatctcaactaaataaattaataaatacagagcaagattccatcttaaataaataaataaacatacacctgtaatcctagcacttcgggaggctaagacaggtagatcacctgaggtcaggagttcgagaccagcctgaccaatatggcaaaactccatctctactaaaaatacaaaaattagccaggccttttgacgtgtgcctgtagtcccagctacttgggaggctgagacaggagaattgcttgaacccaggaggtggagtttgcagtgagccgagatctcggctgtacttcagcctgggtgacagagtgagactctgtctcaaaaggaataaaaaaaatacaaaaaaaaatgtagtatgattgcagagtcgtgccgcggaagcctgctggtcctatccatgtagtgaaggctgatttcatacagaaatgtcacaataactttttttctttttctttttttttgagacggagtctcgctctgtcacccaggctggagtgcagtggcgcgatctcagctcactgcaagctctgcctcccgggtttatgcccttctcctgcctcagcctcctgagtagctgggactacaggcctgtgcagcagatgctggggggccactaggcccaggcagtcttgggacttgtgtctctcctgctgtgcatccatactgggtgctttagaaatggcaggcagaccagaagcccctgttgcaagtgaggacaaagtgtgggaaggccgtgagggtctgcagtactaaatggccttgtcctcaacctgcagtgcactcctgatgcgctggaaagccgcctccttctcctggtccaggtcttcagcagtgacccggtaccccagctctaagggaggtggcagcatcaaaggctcccctcgcctgcgtggcagcaggggaaacttgcatctacagggcctagaggcctgggatctgggggagccacccctgggggcgagtgtctgccctggtgctgtatctgccatcttttcacactgggtgtgacccgaagagacagcctgaggtccgtcctcactcactgtgtttcaggaactgagggtcagctggcagtgggatgaggctggcccccttctccgctttcgttccgggaggcctcccgtagagcggtaggggctcgagatggcatttcgtttggggcacgagctggtccgggaggtctgggatctctggttctgacctctgggcacctgctgcagctgtggctgaggcccagaaatgtgaagggcctccatccactccagtagtgaccccaacgtggggttcaatgtggaggggggaggggctgctgcggcagctgcaggagcagaagtgccacaccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacccctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacctgcagtgcactgttgatgcgctggaatgccgcctccttctcccggtccaggtcttcaacagtgacccggtaccccagctctaagggaggtggcagcatcaaaggctcccctcgcctgcgtggcagcaggggaaacttgtgtgtactgggcctagaggcctcggatgtggaggagtcattcctgagggcgagtgtctaccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctctattgtcccgcaggggccgaaatgcagacggtgcatccccggtgacctcggggacccttctctgatcaccaggattctcttggactctagggtccttgtcctgctcaggcatccctgccccgctctccttgagggccctcaacactatcttccctggacacaagtctggggacagccggctgttgtggaccccaaaggggtgactcccggctcctgggccccacagagagtccatgttctcagtgcagtggctgagctggaggacgccctggaactcggagcacgcagcactggcttgctgtggtacctgtgcaatcaaattgaaggcaggatcccaggaaggaaggcagggcttgcaggatcacggaaaaccttcttagagttgtcttgacaccactgatgtcaagtgtccgggtgcttgtaggatggcctgccactcagtccacgggcaggagcaacggggagatcccacaagcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagcgagcttaacggattaataagcgcagccaggtacccgcgcgaggcacttgctggcaatggcgggaggcggacgtggggggtcatgcaataggtacgggaaggagagaggcgggcacaaaggttgcgggagaaacaggtgcccacaatggcggcagatctgcccgtggatcactgaagattcctgctctcctgctgaggtggagattgcagtgagctgagatcgcaccattgcactccagcctgggcaacaagagcaaaactcagtctccagataaagaaaagaaaaagaaaaaaaagaggccgggcgtggtggcttatgcctataatcctagcactttgggaggtcggggcagacggatcacgagatcaggagttggagaccagcctggccaacatagtgaaaccccgtctctagtaaaaatacaaatttagtcagacatggtggcacgcgcctgtagtcccagctactccggcggctgagactggagaatcacttgaacccgggggcggggaagggattgcgatgcgccgagatcgcgccactgcactccagcctgggcaacagagccagactctttttttttttttttgagacggagtctccctctgtcgcccaggctggattccagtggcctgatctcggctcaccgcaagctccgcctaccgggttcacgccattctcctgcctcagcctcgggagtagctcggactacaggcgcccgccaccacacccggctaattttttgtatttttagtagagacggggtttgaccgtgttagccaggatggtctcgacctcctgacctcgtgatcagcccgcctcggcctcccaaagtgctgggattaaaggcgtgagccaccgcgccgggccgagactctgtcttaaaaaaaaaaggcctgggctgtggcactttgggagtcggaggcgggcggatcacgatgtcacgagttggagaccagcctggccaacatagcgaaaccccgtctctactaaaactacaaaaaattagccgggcgtcgtggcgggcgcttgtagtcccagctactctggaggctgaggcaggaggatggcgtgaactcgggaggcggagcttgcagtgacccgagatctcaccacagcactccagcctgggtgacagtgccaacctccgtctcaaaaaaaaaaaaaaaaagagagagagagacagagagaaaaaggtttattgatttaatgtacttttatgcctgtgttcttcaatttgcttaggaaagacccacacttgagagctgggactgtgtccctgattgtggacatgaaatatgtggtttcttgccaaaactagacactgaataattacgatttagttgagctagaaatccatttggtttcttccatattttcccaaaattttcatcctttttttttttttgacatggagtttcgctcttgtcccccaggctggagtgcaatggcgcgatctcagcacctgctggcaatggcgggaggctaggggacgctggcggcataggtactggaaggagaggcgcgcgcacaaaagacttgggaagacctggcgcgcacaatggctgcagatccgccagtggatcactgaagattcctgctctcctgttgaggcggggattgcagtgagctgagatcacaccattgcactccaacctgggcaacaagagcgaaacttcgtcacacacacacacacacacacacacacacacacacacacacacacacacgaaagaaagaaagaaaaattagtggccaggcgtggaggctcacgcatcccagcactttgggaggtcggggcgggcggatcacgagatcaggagttggagaccagcctggccaacagagtgaaaccccgtctctagtaaaaatacagatttaatcagacatggtggcacgcgcctgtagtcccagctactccggcggctgagacaggagaatcacttgaacccgggggcggggaagggattgtgatgtgcctagatcgcgccactgcactccagtcttggcaacagagtcagactctctctctctttttttttttttttttttttgagatggagtctccctctgtcgcccaggctggattccagtggcctgatctcggctcaccgcaagctccgcctaccgggttcacgccattctcctgcctcagcctctggagtagttgggactacaggcgcccgccaccacacccggctaattttttgtatttttagtagagacggggtttgaccgtgttagccaggatggtctcgatctcctgacctcgtgatcagcccgcctcggcctaccaaagtgccgggatttaaggcgtgagccacagcgcccggccccgagagtgaatatcttttaacagtgtttttcctgatcttttccaacatcttcattgtggttctgtcctttattttttggttaaatccagaggtttacttctgcctgtatctttccaaactattaatctgttcacaatcactctcccatttaaacccttcagcagccccagtaccttcgtaataaggtctccttagcttggtatccagaacacttcaatactgggctttgacccctgttctccttcccccacctctgtttaggtgcttcactgagctgcaccgaacagctcttggccccttgaaatctctgcagtctccttgtctccctctgctggaatattcttctctcacttcatctgatcattgccttcaaaactcagctcattttcttatttccttgcccttttcatgtcccttgttttcctccgattaaattaatgttccaaactcaaaagaaaaacaactcagctcaggcatcaccttgcctggaaggcttccctagtcctcctgcctcccgcagacttgtctggcaccctgtgcatttgggatttggcacactatgtctcatctgcggcctccactggacgatgagaccgtaagtgtgtggcttgacggaaagttgttgactctgctggggtgctggtacagtgctgggcacggcagtgttacagaggaagtgagccacttagtttctgcccttaggagcttttcttctagttgcagttgaccctgccagctgtgagacacctcccagtagtgcataccaactttcaaagtctgtttaattgtatcttagtgtctgattccaattttatttcttgaaggaggggagtgtctctaatgtcttattttggcacccagagaccaggtaggcatcatttttgtcccaaattgtggaaggaatgtacatttggcacagattacttcccttttttctcttgtacgcctttcaccttttttgtttttgtctttttttttttttgagtttgatgtgtttggacagtaagggtttacgagattaagattaaatttcaactttgtctattgtgcatatagcctaaggaaaacaaaaagaggaaaaatacattgcctctaaaaagaagactcattattcaactttttttatttttaattgttttcagagactgggtctcaccctatcacccaggctggagaggtgatcacagctcaccgtagccttgaactcctgggttcaagggttcctcttgccttagtcttctcactagctgagactgcaggcccgcaccagcacacctggctaattttacaaaaattgttttggagagatgtggtcttgccatcttgcctaggctggtgtggaactcctgggttcaagcaaacctcccaccttggccaccctaagtgttgggattacaggcgtgacccattgtgcccagcctaaacttttttgttttttttcaatgctgagctgtacacagaagaaagtaaaggtcttggtcaagcctaggaaagaagtatgcaaagaaactggtggcaggctggatgtgggcatatttcggggctttggaaggtgaggaggagaggattgcttgaggccgagagttcgagaccagcctgggcaacataacgagaacctgtctgtacagataaacattttataattagccaggtgtatgtaccctagaacttaaagtataataaaaaaaaataaaataaaattcgccaagtgtggtggtgcgcacctgtagtctcagctacctgagaggctgaggcagggggatctcctgagtccaggtgtttgaggctgcagtgagccaggatcacaccactgttctccagcctgggctacaaagcgagactctgtctctaaagaaaaacatactggtggcattgtcaagatttgtcaagaaatagccattatgctgggcccagtggtgtgcacctgtagtgccagcttttcaggaggctgaagtggaagaatctcttgagcctaggagtttgagttcagtctggggagcattgcaagagcccagtctcaaaaatattaggtcaataagatttattttaattaaacaagaaaaagaaatatctgctaaaatttaaagctcttctattcttcctctgtctcttctagtgttcttggggaagatcccgacttagccattttccagtggcacctcttccaccatgagttcctgaggcagtccgatggggctactttattccagaacaatcacagtgagaccttttctcccaataaatgccccttttctctccttaatatattctcttgcttacaaaacactggtgtctccttatcatggtttggttctaccccactgggcccaagaattcttgcccaggagcaactgaattttcttcttgcttgctttttaaaactttggtggggtagagccaattttaaatcttctgatccattttttcattgcttttctcgcccttctgcattttctgcaaattccgttgaatcattgcagttacttaggtttgcttcatctcccccattacaaactacttgctggagttttcaaccctagttccctcatttttatgatttatgctcatttctttgtacacttcgtcttgctccatctcccaactcatggcctctggccctggattattgttttagccttttattttttgtcttcttctacctcaacacttatcttcctctcccagtctcctgtaccctatcaccaaggttgtcattaacctttcatattattcctcattatccatgtattcatttgcaaataagcgtatattaacaaaatcacaggtttatggagatacaattcacataccttaaaattcaggcttttaaagtgtacctttcatgtggtttttggtatattcacaaagttatgcattgatcaccaccatctgattccataacatgttcaatacctcaaaaagaagtctgtactcattagcagccatttcacattcaccactccctctggctctgggcagtcactgatctttgtgtctctatggatttgcctagtctaggtatttttatgtaaatagaatcatacaacatgtgaccttttgtttggcttttttcatttagcaaaatgttattaaggtctattcctgttgtagcatgtattagcacttcatttcttatatgctgaatgatatactttatttgtccatcagttgttcatgctttatttgtccatcagttgatgaacatttgcgtttttgccactttgggctattatgaataatgctactgtgaacaagtgtgtacaagttcctctgcaaatttttgtgtggacatatcctttcagttctctcaggtgtatatctgggagttgaattgctgggtcgtgtagtagctacgttaaacattttgagaaactgctaaaatgttctccagagctgtaccattttacattctgtgtgtgaggattccacgttctccacttcctcaccagtgtatggatttgggggtatactttttaaaaagtgggattgggctgggcacagtggctcacacctgtaatcccaacactttgggaagctgaggtgggaggatcacttgagcctagtagtttgagaccagcctgggcaacatagggagaccctgtctctacaaaaaataatttaaaataaattagctgggcgttgtggcacacacctgtagtcccagctacatgggaggctgaggtggaaggattccctgagcccagaaggttgaggttgcagtgagccatgatggcagcactatactgtagcctgggtgtcagagcacgactccgtttcagggaagaaaaaaaaaaagtgggatgatatttttgacacttttcttcttgttttcttaatttcatacttctggaaattccattaaattagctggtaccactctaactcattgtgtttcatggctgcatagtaatattgcataatataaatataccattcattcatcaaagttagcagatattgactgttaggtgccaggcactgctctaagcgttgaagaaaaacacacaaaaacttttgcattcttagagtttattttccaatggagggggtggagggaggtaagaatttaggaaataaattaattacatatatagcatagggtttcaccagtgagtgcagcttgaatcgttggcggctttcttagtagtataaatacagtactaaagatgaaattactctaaatggtgttacttaaattactgtaataggtattactattagtcactttgcaggtgaaagtggaaacaccatcgtaaaatgaaaaataggaaacagctggttaatgtggctctggaatttttctaggacataaactgatgagctagaaaagtaaatgtgtcagtccttggtagcaaagtttgtacatttataaattttatccaaatcctcttaatctagtgattaatagacactcttcacaaaaggatgagtgaggtatatgtgtatgtgttgaaaggttccgaaggatgcaactgagagtactttttttgtgtcatggatccttttggcagtctggtgaaacctatagaccccgtctgagcataacgttttaaaatgcatacgtggcccggtgtggtggcttacacctgtaatcccagcactttgggaggccaaggtgggtggatcacctgaggtcaggagtttgagaccagcctggccaattagctgggcgtgatggtgcgtgcctgtaatcccagctccttggaaggctgaggcaggaaaatgccttgaacctggaggttgccatgagccgagattgcaccactgcactgcggactgggccacagagcaagactctgtctcaaaaaaaaaaaaaaaagaaaagaaaaaaaaaagcatacataggccaggtgtggtggctcactgctgtaatcctagcactttgggaggcagaagcagggagatcacttgagctcagcagttcaagaccagctaggcaacatagtgagaccccatctctatctacagtttcctgcagagatcaaagtaaagttcagtgtaggtggttgttgttggggaagacactcaggaagaggacatgggctgagtgttcagaaatggtcaggatttggatggggagggcattctactcccagttaagtcctgataatgcaaaggcctcagcaggccttttacagattggagaaatgactgtcagtggttttaaggaccagtttaggtgggatgatgctggacacagaaaattggtttgaatgataatgagtttgggatttcggcttaaagtaagtccccagagcccaggccactgctgctgagccccagcctgggaactggaggaagcagtcccagttgctgacctcttgtggtccctggcttcgggtgtgcagtgcatccttagttgtgactccttgattaatatttttagcttctggctgggcatagtggctcatgccgataatcctagcactttgggaggctgaggcaggaggatcacttgagctcaggagtttgagaccagcctgggcaatataacgagacctcatcttactaaaaatcaaaagcattacctgggcatggtggtacacacctgtagtctcagctgcttcagaagttgaggtgggaagaactggttgagcccagaaggttgaggctacagtgagctgtaattgcactactgcactctagcctgggtggcccccatctcacacacacaaaaaaagagcgagaccccgtctcaaaaaaaaaaaaaaaaaaaaaaaaaaaaaaaagggagttcctcatttgccatgagtggacacctgcttctttactgcttcaaagtgaacacagctattccttgtaaagggttggttttactgtaaggaaatctagaacacctgtgtgtgaatgccccctgattttcaaagaaatgagtggttgcatcaaaatcaagcttatatttgtggaaaatcacatgttgccaaattctctcatcaagaaccctttattaactgactaattgtgggccatggtggcaggcacttaacaaagaccatggcagcagacctccctcaactggaaccctcagttaagcgggattttgtttttattttggaactccaccttcagaagggcaaaaatcacaagatgtggtagcaagggtttattctagaaattagcttccaagcagttgtcagcccagtctgtatgtcttccgcatctataattatagtagcagaagagaatggtgagcctggggcactgcaagatcctaaatcaaagattaaggcatattaactctaccctcgctggaaagtggtcagttgtattttaaaaagctttacaatagactttctaataatgagagttgaagcaaagtttccacctaaccctgtaattaaattcaccagaagaccccatttcccattatccagacgaccaaggctttgccgaacaccaccgtccctgccctctaggagaggtcatccaaggccagcaatgaaacagtcaatcaatttgcaaatggacgggaggacactgacaggatgtgttcactgggggtaggtgtctactgggggagagaggccaggcaagtctgtccttgttttcagtctagcaggagtgaaggggaggccagagtaactcctgagtggtcaatctagaaaggccttttggaagggctggaattttaggcatttttcttaagtaagaggagagtgacgtcctgttggaatcgtggggtaggggatattctgggcacttctaaaggggtggagaaacctgaacgtcctgggatgggaaccctaagggcgtagatttgtaaaaattgctgcagtcacttgccatgaggactgggtatctgggctagagacaggtgggtgacatcagaaagctgtgagtggatatcctggaagaccactgagaggaggagccaggaatggcaccagacatttctgaaggtggggggcccagaggtcgaagcaaagcggggcctgtttctgtaccaaagcaagagcttctgtatatccatcaaaacataatcaggccaggcgtggtggctcatgcctgtaattccagcactttggggggctgaggcgggtggatcgcttgaggtcaagagttcaagaccagcctgaccaacatggtgaaaccccatctctactaaaaacacaaagaagccagacgtggtagtgggtgcctgtaatcctagctacttgggaggctgaggcaggagaatctcttgaacctgggaggcggagtttgcggtgagccgagattgcaccactgcactccagccagggcaacaaaagcaaataaaacaaaacaaaaaaaactccatctcaaaaaaataaataaataaaaccataatcagagcaaagacattctaacaaaactgtgaactcggagaaattagtgatgcctgcttcccgtcaactttcaggtgtccaggccttctctttattaaaacagaaaaaaaaatctgataccagttgtgtgttctttctttgatgtagtgcagtttgcccaggcttgccttaagttggtgctatttttgtgtatttaattctgtttccgcatgtgacccattgtctgatgcttcagaatgcagtctgctgcctcctttttgatagcaactctgagaacaccgtctctgctctcggcagggcactgggtacacctgtggcatcgctggtgccatggcatgaggcaggcttcccacttcacttctcaaggacccattttattaactctccttcccccaggagctccatattttgaaatcttttgtttcccagacaattagggagtaattaaaccttttttcccacatgataacaagtatgatcgttcacacttgatatagtccagttctaaagcaaaattagtctagtggtctgggttgcggatgaccaaagcacacatatgttccatccattaggttgcttagccctgtggttagggaaggtggggttattgttaggtgattttgaaatctccaaggtcatcagtttcccaaccccatgtgctgctttggataacctgggtggtgtttgcccactactgctttgcattggtgaccttgattgaccatgctaggtggcacttttcagcagggtgaggaaaggagatgcacagttgagcagccgtcatttcctccgggtccgatcacacctaccctatcccagccagatacaatctatccctttttaaaaagactttcagagaatgaaattttacagtcttttttgtataatgcccccaaaaggaaatcttgattttcacttaagatttgatttgaagtaagtcatgatttagaacagcagataaaatgcattagggtaaagtattatgtaaaggtaaggtgaagagatactggtttctacttcaggaggtagcttatatttgtttgctttaattaattaattaattcattcatttttgagatggagtctcgctctgttacccgggccggagtgcagtggcacaatcttggctcactgcaacctccgcctcccgggtttaagtgattctcctgccttagcctcccaagtagctgggattacaggtgccctccaccacgcccggctaatttttgtatttttagtagagatggggtttcaccatgttggccagtcaggctgctctccaactcctgacctcaggtgatctgctgctccagactcccaaagtgctgggattacaggcgtgagccaccgtgcctggcctaatttttgaattttaattttttgatggaggtaacggtgactataattctgttacaagaatgtagaaagtcacgcctgtaatcccagcactttgggaggctgaggtgggtgaggtgggcagatcacaaggtcaggagattgagaccatcctggctaacgcagtgaaaccccaaatataaaaaaattagctgggcgtggtggcgggtgcctgtagtcccagctactcgggaggctgaggcaggagaatggtgtgaacccgggaggcggagcttgcagtgagccaagattgcgccactgcactccagcctgggcaacagagtgagactccgtcaaaaaaaaaaaaaaaagaatgtggaaagtaaaatgtgaaagttcccctccttgtctatgccccttattgactttgatatagattctttatagtttggtatatattctcccagacccttttctgtgtatatacttacacaaatatattttttctgacataaatggaatcatgcagaacatattgttcaacaacttgattttaaagggatgatttacttcactattttttcaggcttaattttatggctatatcagaactgatttggttattttatagctggctgaagctgtaatttgtgaaatcattggggagtagtgagcctccttccataactatataacaataaattttgctatatcaggagagcaagtcataataaaaatattacccttaaattttaatgtatttagtgagaataattgacttgtttattctgcatattttcttcaaaaaacacataaattcatcaaattaagcacgttcgtattttattgactattttgctataattttgaaattatgttaaattaaaatgaagcctgtttgaaacctgttaagatgacaaccataaatacttagttttgtgtctaattcagttaagcgttcttgtttgttcatggaccagaaaaaaagttttcctgtgttttcaattcccaagtgactcctccagatagaatgaactggacccgagtagtctttaaggttgctggctacgggctcagcatttaagactttaacccaaaggaagagaactttttttctcaagccctgcagcaacagttattgctgtaaaaagattatcatttcaaagtgttgggttacttctcacgttcatgggaatgactttctttaaaacctctgggagcaagagcagtttcttggatggctcatctttagacctgattttttttttttttttttttttttttgttcagacatttattgagcacttcttaagggccaggcatggtgtgaggcactgggatgtaacagtgattatgacaaagtccctcagggagctcacagtctaatggtaaactacagagtaaactgaggcacagagtggtaaatgacttacccaatgaggtagaaatagctaggtatgtgaaaatgtgggagcagagctggagagagggcaaggtacaacttgtcctaagtaaaaccccttggactgactcaacagcaaggctgcatacacaaacattacaaaatctacttgcaaaaacctgaaaggagtttccaattatcaccatgactgaattcatgtttcacaatgaattcagctatttcctgatgacatttctatccttgcccccaaagccactgggcatgccaccgatctgctgggagacagcaattaggtagacagcttaaaaccaagaagtatctgactccaattttagcactgaaaaccatattaaaatactttaattaaatccacaaacataaatgtgtagcacatttatgatacttctacatgtagaagtttggaaaaagtctcttctaaccctcatccagaggattctaataagttatagataccaaagagattagagaatttgtctgtcactttccatatatacattattttggctgtacgagagtgaaaagtgtcactcagacatatttcgtaagtaatctcaacattatacagatatatacaaagacatcacatttaaattcgtgtgtacatctatgcaatgtacaacagtaactgcaaacatgaaccagtgtaaggcaatttcttttgtgacatatgacatactccttgaagggaagggtagagtccacaaagaactgtccttttcagcctgactgtctgtcttcatgacactctgtgatgaagctacttcaggaggcaagatgtctatttcactgacaaaaagcagtgaataattataaaaggagttgttttcaaatgtggaaaccacaattactcagtaatctaagtggtgaactcctcaaagacactactggccatgatgccgctactgagaacgagagcacttcatggataatttattgctctgagaatcaaatttgatgcgtaattctccaggaagatattcccaaaaaactcagtgatacataaattctcaaatgccatcagttgcttacttcaagcaattcttcactttgctgaggattttcttcttcctcagggccttctggatgagtgctctcagatgaagaggtcctgacaccttcagaccttttgttactggtctgaccctgctccacttctcacaaatagacatcgataggtccgttggtgctccttatgtgcactgtgatagagtcttctctgggagctggaacatccaatctggtttctgctggagctttaactgcaatgacgatctgttcatggaaggcctgaatgctatgaatgtcttgataggtcacatatgctagtctttcattttctttgtcatctgttaactcaaacagctgctgagcacaatccttaattaactcatccaaagcatcttccattgctggtaagtcagaaagttcctcctgtagcttcttttgttggggaactgctccaaaattgctaagatcagatcctatccatctaatatggttcttggatttcttttcaacgaggtcgattccatctaagacatcggtgatgtcatacactctccgctttcggactcccagtttcgttgcaaccttgtttaagtcaagaatacccccgggagcagatttctcatggacacatattgtacattatcttctaaattaatccttatttttgatggcagcaggccctccacgttgatggggtctcctccgtcgggtgcaggaggagactgggtaatctcctcgccggccgctgctgactcatgctgcccggccgggcgtcctgctcccctcgcaccccacgagctctcccgccctctcgcgctcagctcgagcaccgccccccacgcgccgatttccaagggcccagcacctaaggggtccgcggcctcctccgaggcgtcgcccggctaggccgtccctcccgccagtaaacgcggcacggcctcacgtgcccgggagctcccgacgcagacggaaaaggagcagggagacccgcggatctcaagtcgcccggcccgccatcttcccgcatgcgcagtcaaaatagttgctcttctggagagatggctgtgggattcatgtgtcataggcatcccttcttaaacatcagtgtttgactttctatcccttgtcctgagacctctgagggtagcccctgttttagcagaatctacttctaatactttcctaagaaggctttcccaagaagttcattcaacaaataaccgagtgccttctacaagcactcattgttctgttatctccggtgccacagaattcacagttaaaatcatgactaacattttaagtcgtcacctgatatgtatttttaatctttaataaatagaagcattaattaaatacactgtgacattcgggaactcttttttattcctaaggtacatcttttttcttgccattacttaacctcttttcttcctgttttgttctcagctcttctttacagccatgagttactagtgcccggtgccaccacgaagagggggtatctgtaggagtaagatgatgaatagcagtggtaaggggagagcgaggagaagggagggggctctgaggaggctaaagggcaaacttttattcttgaaaatacacaaatatcccaagtcctgggtgtgtggaacgtccttattactgctggggatgttgcttgtctgtgggaattgggaatttcacacctagctctgaatttctaggaagcccgaacaaaagagaaatagaaatagagaaatcacatacttcccaccagagaggagacaccatccataccagaggagactcgtatggggggtggtgaggataaggccgatccatcttccccacctcatactctgcctcctgcagtgtggcctccctgagggcgccctggcaagggagggtgtgggaccctcatcagtatggctcttacaaattcccagaagctgctgtagcagctcaaagaggggcaggctcttccaggtctgttccttgccagatgccctctcccagcctgggggtaaccctaagcaggcattgatctgcactttgctcagagtcactggtgacctcccgggtagccaagagcttcccccttctccgtgagccctctgagactgcaggtcccagacggttgtaaattctgcctggtggaaattgccaaggctccaaagcaggcacctgctgccctcaggagcctctgtgcagggccattcttctccctgcaagcagcacttctcggagacctttctggttttcctcttcagctttgtttggcagtggtttggtgttggtttggagatggtggtgtgttgggaattatgcttcacatagatggacatgtttgttagcgggaggaatgatggtgcagatattcattccgggcttaccccaaactaggtaaccctttatgacattgtttagagatgatttgctgaacagtttcataatgccttctgatgtttcagtacaaaaaatagcttgctgaacaatgttacaatctgtcttctgatatttcattacaaagaagcaagagcacattctgagcaccctgcccagtgctttcaccttgtctctgttggagcaggtgattggttccagctctgcgttttggcacctctgtggctgggcatccctctgaactgtgcacttctagaagggagcaacaagatagagaactaatatgcctctaggcctgagttcattttggaaaaatctttgtagatttcttgcccaatcctcttattttaaaggtgaattgtcctagagggaagaaaaagaccatggtgacctgggtgggtaaagggtggaagtagtactggaaaacgcccctaacaggagatgagaaagagactctggtgcacgtcatctttgttttaattaaaacgttatgcaatacaaacattcgccttcccactcttccccctaccacagaggagctgtaatttcccatatttggaatttggggagagctgggcctcatttgaagataaggccagattcagtctctgatttggggggaagtaagtaattgagagagccttgaggactgtggtatttatggtgaatatatcagaactatgtgtgcctccttgtcatcatttattcaacacctctgatgtcctagagctggtgctatgcccatcagtatctgactctcgttttcttctgcatattttcccttttgcaaatgtataggcattcagctttaatcaggtaggctttttactctgtgatctgcaacggggatgactgaagtcatgtggaggattttaagtaactaatctcttaagacattcagagcataatcttccctagcccgtgatcatcctgcctgcatccgagagatttgtgaggctctgcaaaggaggctggatgtggactttggcatcctttggagagactgggtgtcttccttgctggtgacaggtttttgtttgcttttggcatgggaacaggacctgctgttcatttaccatgtcaagagagttcaagatgccccatgaatgtgaccagtgtgttactaaatctccgtactggtacagagaacaatggcaggccaaacacacatgaagaccctgtctaggctcattgatgtttatgcagtttgtgtccagggctggttctcagggagaaaaatagataagatctgcaaaatagataagagaggactgctggtcagtggtgttccctgacatttttccctgaatgataccaggttaatcaaaagataaggatctaaaatatttttgtgctctgcttataatttgaatgtgacttcatatgtgtgtcatctgttggactaaattggattgcagttgctcttcaaattgtcattcctttattttctatttctacctacctcctgatgttagctcaggttcctgctaccaaggtgtcttgcaaaaaaatttggtgactattactctaagtgaagcctttgatactttctcttaatacaatggttaaacctctaacaacgtagactaatgaggaagattagtttgaattagtaaaatgtctgaattaccaaatatttttcaagaacttcactgttattacttttaagtaaatactgtaactcaaactaggctaatagaatgcctaataaagatccttaggggatcctgctttaggagagaaataagaatgatttgcaattagtgcaccaattgtttatgtaaatggaatttctgaaatactagactgagcttgaaaaccgtttgttcccttaagtattttaaatagtccctacggaacccctgtgcatgctggtagttgtttatatgctgtatagagacctgtttcacgaagacataactcaaccttatatcatcagtatcagaaattccaagttagtgatggccaggatcctcaccttccaagattagattagatctctctgccaaacgcttccatagcacatgcaattgtctgttgtaacactaatcaatacatttaacaaatatatgatgtattctgctatatgctttgccagtgtgtgaaatggaggagacataaccctcatctttgtgtagtttataggctagcaaagaagtcaggcagtaaacaaataaatgcatttataattaattacaatcctgaagttagattgtacttttgtaagtaatggtttaatcaactagattttaagttccattaagataggggttacttctgtgttgtttgtcatggtgtcccaaatccttccttagcctactgcctggcatagagtaaatattaagttgagctttattgccattttgataggtcagaagcagtcgaatgtcaataatgtcacatagttcaacctaatagttgctcagtcaatatgtattgaatgttgaatgcatgttgtaatcagtgatcctatggtaggctgcatttcacacagttttctctagccaaagaaatgctagctatggttttgaaaaggaattctaaaacttcaaacagctaaaactggtgatatagactgtgggactggagatctgtgagactggagtgccttttgtccagtatattttctatgcagttcttggtacatttcccagcctcaggtgggagcatgtgtatttgggtctggagtgcttgtcagtagcccaaagaacctgggaagagtatgctggaaagctaagatggaaggcagggataggagctgtttggcctgaagaagaaagtggcaggaaagatattggcatagccaaagaagccttccctttaagtcctagtgtagggagacttacttttccagaccagagctcatgagatcatgcactcattccacagatttgtgtgagtctgtgatgcgctcagttatggctaggcatgggcgttccttattgtgagcttcctttttgtgcctggaacttctgtctgaagggtggtgggctggactgtagaccactggtcctcagaggcaagggttgaactgaggagaaagccccagctggatcctgctgggagaagcccagcactctggcctggggcctgctccctatctgtggaactgggagtagggcccaggctagggcttagatcagagcttcccaaaccttctgtgttaagaacgtttttgcatctgtttggatttcatggctgtttttccattttccgtgcacacatgtccaattgtaccaccctattataatgcacactcttttctcacacccacaggataatttgtagttccacagctatttgttgagcatcctcatctgccagcacaggatgggggtggcaagtgaggggaaacacagatatgtggtattggtccctgcctgtggtagacgtgattggttacctacagtggctcttcttttctcttcctgctggcaggacccagttgggttggatgccacacctctcccacacgccactcaaggaaaggtgaccctgcctccagctctagggtatgtgctgattgagctgagcccatcctggaggcccgtagtttagacatggttttggccactgaggtatgagaagtctgctgggagatgctgggaaagatgtttttccttgtaaaaggaaatgcagaagggacagcttctttcactagattctcggacgtgaagcagccatcttgttgcaatgaggaaagcaggtttgttgaggccagcagacgggaagagatgggaaaaaccctgagggccaagcccctgaagactgaagcgtccaatctccatacattttgtcctcactgttgaagccagttgagtgggaattttctactacttatagtcgaaggcaacctatattagacactccctcaaaggagcatgaaataggatttcttcttgtaccattcagattatcatcaaaaagcacattattcagagacagagcttagctttgtggtaaggcagaaaggagaggggaaagcaagttggtaggaaagagttgagtgaggagattgtattttaaatgggtcctgagggaggattaggatttgtgtgggaggagcagaagggcgttctggggaaaggaatggtggcatgagcaaacctgtgaagacaggtatggatgtggcactgccgaaaaacagggagattatgtcctgactaattccgtggacagattctagagcacctcaaattgtgagtttatatggtgacacgtgacttatgcagcgggaaaagtattgcaggctcatgaatgggggagaaaggaatgaaagtgggccttgggaagaaggataaggattaagtagctgggtaccaggttctttggaaggggaaaaaagtaaaaggccagtgacaagctcaagctactgaaataactcacatttgagttgatagcagtgcggggagggagtgaagctgtcaaaggaagattgtaataaattaactggcaaagaagggtaagatggatatctaggagaggaagatggaagaggaagattttaggaagatgctgtttgctttttgccactatggctttgaggtaatgaggaaagatctaagtaatgaggcgttgaattcatttgaaaatagggctagactttgggaatgagaggccaagggttaagaggatgtggtagaggcaactcactaggcatgcacatactccagattttccagcctccctcacagttcagttggggccatgtgactagtgttagtcaatgaagtgggagaggaaggaaccagggaagagccatgtattcctccattgattcctcccatgccacagcagccttgggctagggccagaaagtgtggctgccaagacggggagggctgtccttccaggaccagactttgacggttgttgctcagctgggaaatgctggtagaagcgagatctgaagctgtaatgggtggcagtgctgacagctatttgtgttgggtctgggtggtatgtggtcttcagggtacagttgtccaccttctcctgacttgatttgctcaggggtctgcattcaatgggctggagcttgctggccgactcattctacctctaggactctcagtgtttctgggggcaggtttacatcttggctgtccagggaaggggatccttgttcatgagctgtgctagtgagaaggctgctctctccacaggcaccagaatgccaagtgccttgcagaggagaatgtttgggtggctggtgtccagtggtgaccaggtggagcgtctcaattatctggctaaacatggagcttcaggaagaagttccagatctccagacttgaataagaataaggtgcaaatcccatctttcaaatctttcccactctcagaagagtcaaaatgtgccttttctgcaagcagtccggagctaggcactttgcatacgctttgttacaatgttgcatcaatctcgcctggctgaatcacggtgttttcctaagggtaaagggccccgtgagtgctgggaggcctttggcatctggttttcgtcaggcagcaggtaaaagtgcagatggcgggtctgatcgtgctttaaaaaaagcagagttagaaacgtgggaaaggcatttgagaggcacctcttactctgtgtgtgatctcccgtgcatcctgtttccttctgtaaccaaacacctcaactcctaatacccagaggaaaacccttcagacttgggagacagccggcattgctggcactggcctctctggagcttttctcgataagtttgaaaatttaaagacagtggtggcactgtttctctgttgaatggagagttgacattcttatttttccttcctcttctgcaaaactggggtgtcatcagatcagtgtttgctgctgctgttgcgttcttgggtagccactctttttttttttttttttcagagggagtcttgctctgtcgcccaggctggagtgcagtggcccaatctcagcttatcgcaacctctgcctcccaggttcaagcgattctcgtgcctcagcctcccgagtaactaggattacaggcgtgtgccatcacacccggctaatttttgtatttgtagtagagacggggtttcatcatgttggccaggctggtcttgaactcctgacctcaggtgatccgcccgccttggcctcccaaagtgcttggattacaggcttgagccaccgtgcccagtcagccactcttattttacacactgcttctggctgataggcctacaaggtctaagcttaatcccaggaaaagtgctacccgaatggtctgtcagtcagccttttgtttgtttgtctcgttccggtcatccttgcctctgtccacccagacaacattcaatcaacatttgttatggagccagcagtatgattttgcaagttacttttctaaactctcatttcctcatctgtaaaataataggagatactcattagggtgattctaagagttaaatggaaacatctgaggaaagcacttagcatcggtctggcacatagtaagtgctcagtaaatgatggttgtcattattgttgagcagagccaggggttgccaccccggtcagctgattggctgtagacatggtgtgaccatatggagctgggatttgggccacactcagcacatagttgtgatccataaatgcacaacctttggaccccattgtcacctcccttggaatatcttggtgttcttgtttcagtctgataaggccattgtagctgggttctaggtatctctgagcatggagcactcacgccagcctcagacatcgctgtcaagggcatcagcagcagtgaggtgattcctcagccggtcatttgggcatcgctgcctgggtctctcctgagcttcagctcatcttttttgtcacctgccatacctttgcctctaagtgtcccccagtttttattgctgccctctccatccgcaccagtgcctctctctgccagttccactgttctctcgcctgctctttaggatttcctttgttttgcctccttgcctggtgctttcagcgagcagcgctgacgtcatctcaggaaccgtgctgcgtctgagagaagaacctgcagtagctgtttaagtgtgcggtgctggcagagtacctccctgaaggtgtcctggggaaagtgagtgattgctcactgggtggtgagccaggggcagggtttggggagatatctgcattagcaagttagcatcacttgaaacacaggcatgtaacgggcaaggatgtgctcttcagctaccaggctgtcctggctggagccggtggccacagacctgagggaccccggctttgttcccttagctggctttgttcccttaagctgcctttgttgtctcagtgtagctctctctacctcctctgtatttcaccactgacaactcactcgattctccctctggcaatcttagttacctgtgaatactctttaacgccatcttctgccttctcaatgaatgaaggagattctctccttgactatttgtgagccaaaacctaaccttctcttggctgatcagtattaatatattgtgctgagaggaaattttagaataaaattagacatcaaaaagaactggcacaattagtttccaagccgtttaaggttcctggaagtcttctgaatccatcctctttgtggggacccaccccaattctccatcttcctcctaaaaataacgataatggcgtttcaccagaagccggacaaaagaatgctctgtctgtttcgcctgtgggaagtgacaggaactgctgaaacctgtgttctgtgtcacagagccaagggttcacacagtgcagaaacaaatcacagtgtgtcacggagactttttctgtctccggccccactctgtatttgagcccaaatgtggagggagatgctgcagttgtgggaaggcacttccgtgacccctcattatggtagaggaaatgagaggcctgaggccacagccaggctggccttttgcaaaatggtcaaatcagcagcaatttggccctggctcccactttgtgccccacccaccaactcctgctatctcccatccccactcccagcgcagtcgcgtccatggctcccagggccccaccaggctgccctccctgtctggctgtgctcagccgctgtcctggttctccccagcatttcagtactttcctgagtcctcctgctggtccttgacttggctggttggaaggtttgtggatcattagagccacttactcacactgaggaaagaaaacagaagtgggtatttggggaaggcctatgtgttgcttcctctgtgtgttcactcacatttgctgatttcatccctacagttcccctgcccggggagtgttatgcagccacctgtacaaatgaagcagttgagacccagtaagcttgtgtgatttctccaagtcatagccagcatgggccactactttgagctctagataaagaaaaggaacctagtgttttaaagatttgcttcattgtggtataatttgcttgcatacaacggaactcaccagtttaaaatatgtaattctttgttgacaaacatgagcagccacacaaccaccacctatcaaatatggaccactcctctgtccccaaaaagttcccttgtgcctccttgctaccagcccctctcctgcctccaggaccccagcctcaggggacctgaatcctgccactacagttttgcactgtacagaatgtgatgcacatggcatcctacagtgtgtagccctttgaatctggcttctctcgctcagcacagtgcttttgagatccctccatgttcttgtgtgtatctagttcacacctttttattgctgagtagggttccgttttatggatatagcacattttgtccatctcttcacaaactgatgggcatttgggttgtttccagtttggggctactatgaatacagctattaggatgtgtacaagtctttgtgtggacacaggttttatttctcttgggtaaatacttaggagtgggattgctgggtcatttggtaactttgaaagaaactaccagactgttttccaaagtggctgcaccatcctacctccccaccagccatgtatgaaggggaccgggtacttttgatgcctaatctaagttcttttccctataccatagtgtcactggctgctgaggtgcgaattgctgactatcacattcacatgccctgagcctgtccttttcacaggaatttcttggaaagtctgaccatttggagccagttgctggtggggaggtttcctgaggaggtcctttcatcacacagggccgtctcctctgatggctgatcaccacacacaccctcctttgctgcccatcctttctgccgtcaccttggttcataattaagattcacctgtgggtgacgtgggacccacttgcagcccatggacactggaacagtccattctgtgcagttcacttcctggctttcacggcacctactatgctggctcctggccagagatggagttagaggtgtcctgtcccaaatgaacctgcatgcagaagccactggggcagtggggacactgcctcagcatcatcacagctgccagaggctgaattgctgctgtgcagggctgtgtggaactgctgctgttatatgcgcatctccggtctggagcttgctgctcagggctctccttaacaagcggccaaatgactgcagttttctgcattgctttcctgtgaggtccctgatgttttgaaagagccaaaaccagacagggatgctatcaggttgcagttctgctctgttgtggtgtttctgtgaaatggagaggaggattttgaggaatgtgtagttgggtttacttttgtctttatttgtgggcatgtttcctgagtgaggaccactgataattaggtgttctttggtgtaggggcccagatggacagcgtggacccctttctaagggattgttgtcacagtgagagggctgagcactgaagtttatcttgcagcatgcgtgctgggagcagcccctccaaattggtgcacgtgtttggggagggcagagaccagggcacagactggctggcaaactcgcctgctgggctgaagagtcctgaccttgcaactggaagctctgctttcctgccctttccctgattcctgctaattttatgacctttcatcagtcacctgacctttctggacttcagcgtcctcactgtataatagaaagaatgatccctctttcacagggattggaggatctgccgcgtgtcaaagccctttctacacctgtgacaacacaagatgtgcccgtagacacctttctgaacatgggtgtggcagaaggccaagctcacacccagaaagccacctgcccttctgctccttatccttgtcagtcgctgtgcctgcatccccaggaggacctcacgggactgggagggcctgggacaggctggcctcagatcaccaggcattgagacctcctgctagcctcaggctgacagtaataaatgtacaaaagaggacagagctgctgaggagcggctgggagtccagacacaaaggactgtcggaggagtgagtcagggcctctgaaggtcacttgaggagtgtccgccctgaatcattgacctgcggcatgaatggagaagtagctgggataccagccctggggcagttccattgggtggatctttagaagagagaggtggcgtgggaggggtaagagcactgatttgggaatcagagacctgggttctttaagtcaatttatccaggactagctgtgtggccttgggcaggttgacagcagtttcctttctgtgaaatgatcaactccagaactattgatacctgtcacattgtgtttggggaatgaggctcaacagccgagcctgcaccatgaccccggtgcctctcccccatccccctgcgccttttggaccaagaagtgcaggcacagatagagctttcaagcctcttttgttcctggatggtggatccctgtggttaatgaataattgctttaggggcagaggtgaggggagtgagtattgcaagtgaagatgggtgggacagggaggttccaggtggtgaaatattttcaggcaacaatctgcagagaaacttgaccatgactcagctaagcagtgggctcactggcaggtggccctggtggccccctgctgacatctgctactactgtgtgcttccaaggcccagcgagcagcaccggtgattgatgatactacagcgcatcccaggagctggtatcccagggcagcgctgcacctgctggcagccaaacccttcggggcaggacaccggcccacagcctcggagcgcccagttccaaccatcaattttaattcttgtgaggcttttctttttcacatttggttaccctgttgaaccaatctgcttcttcccaccagtatgacagtttttagctcagttccaggccaaattttgcactggcccgagtcccactgtttgtttctttcatgtgtatcttttacatcctgggagccctgaccgactcccagtgcctgagccccttcccctaagcatgaggactcccgcctcaggtctgccctgttccagctgctggaaggcatccagaattctaatgttattcatcatagttgcagtttcactacaaagcatatggtttgacctcttatccttactaagtcatttcagacttagggaaaaaatacccacttaaggaaaattcttttaccaaaaaattttgtgtttttttttctaataagaggtaattcatgcacatgttaaaaatcaaaagcagatgtgaggtgtgtgggaaaaaaatgaaatgttctatatttcaacgtaaaactttgggtgacaaaaacttcagtgatttttaatggtgattataatatcaatagtacttttgaaatcagatgttgggctggggcacagtggctcatgcttgtaatcccagcactttgggaggctgaggtgggaggatcactggagcccaggagttcgagacgctgtctctccaaacaaacaaacaaacagacaaacaaacaaacaaactcaggagtttgaagctgcagtgagctattattatacccctgcactccagcctgggctacagaatcagacccagtctcaaaaaaaaaaaaaagaaagaaatctgataacactttatttgatgctgcagtgttgtaaaggatcatcagacacacaaatttgataattaaataatgttcctaagtcttctgattgaaataataacacaatgcaaaatctcttttcctggcttcccttcctggtcttccttttgtcctctcttcctgccagctctgctctctgcccattctgaatggctgtctgctgcagtgatcagtgctcttctttggatgttctttgctccagatgctttatggcatttccttcttttaattttctttctttctttctttttctttctttctttcttctttgttttctttcttcttcttcttctttttttttttttttttttttttgagacagaggcttgccctgttgcccaggctagagtgcagtggcacgatcttggctcactgcaacctctgcctcctgggtccaagcgattctcgtgcctcagcctcctcaatagctgggattacacaccaccatacccagctaatttttgtatttttagtagaggtggggtttccccatgttgaccagctggtctttaattcctgacctcaagtgatcctctgccatggccttccaaagtgctggaattacaggcgtgagccaccacgccccgttcttcttttaatttctattgtgaaaaatttcaaatatgtaccaaagtggagagagcagaataattaaccctcatacactcatcacctagttccaacaattatcagctcatgtccaatcttatctgtaccgtcactcccgtaccctccctgtagaattttcaagaaaatccaaggaacacctggtgtattcccacatgttaatgaaaactcttgttgattaagctgcacttattagtaatttattttcccatttaaaattaattttcagaataccaagaaggcaccatttcatccttatatctgattggtgaaaagtgtagtagtcaaatagtaccaaggttgacaaagacatcaaagaatagaaacacttaaacactgatcttggcaatgtaaattggtgcactgatgttgcagagcaatttgggcaatgcctagtgtggttgaagataaccttggacgaagatttacaagaatatttattgcaatgaaaagttggaaaccacttaaaaatttatcagtaggaaaatgaatacattgtgctatagataatgattatccagacagtggaccatggtataaagcagttgaaaggaatgccctggagtgacatatgtcaacaaggattaccctcaaaaatgttttgtcaattaaaacagatgcaaaagggtgcatacagtgtgatgccattttaaacagttttatagcatccaaaaactctgtatattgtttatggctacatacataggtagtaaaagcataaaaataaatgtgcaagagtggtaaataccaaattcgggatgttgtcatttctgggatgggtggaatagtggggcttgaaagggggtgaaatagggattgaagcacagcctgtaatgctttctttcttgaaaggaaaaataaaaaaactaaaccaggtgtggcaaaatgttaagatttgacaagtcctggatgtgcacagacatttgttatacatgtgtctgtgtaaatggttccttattcagaaatgaaaaatctgtaattgttcatcttctgataaacttgcaatggctgctgttgtcacatgatgtcattttcttgactggagctaagaaacttggcattttttgttatttaatcctgagaaaatgcatattttcttctttcttccttccttcctttctttctttcttttttttttttttgagatggagtcacgctgttgctcaggctggagtgccgtggtgccatctcggctcattgcaacctctgtctcctgggtaagggttcaatcgattctcctgcctcagtctcctgagtagctgggattacaggtgcctgccaccaagcccagctaatttttgtgttttcagtagagacggggtttcaccatgttggccagattggtcttgaactcctgacctcaagtgattcgcccaacttgacctcccaaagaaagtgcatattttctttgtcatcttatgatagtagatcatggagctcctttaacttaatggattcctagaggccagtgactcctgatattttccagacgcttatagctagaaaaagccaagtaatgaagctctgatgctttgacttgctttgacttaacaagcttagggaagaagcaatgacactgtattttctttctttttgagagaaagtaagaacagcatgaaaggagaaggcagaggaggaggatcccttcttgcctctgtgtagaccgatcctagatgcagcttccttctgtcatctgcaggtggttgggacctgtctccacacccgtggtttgctcaggagtagggaggacaggcctgagaggaaaaaggacttgagctgggctttgcaaaggcacagtagaatttaggtagataatgaggagtggttgaatagatgtgtcacggaattaagggtccatctttagcaagacacaaaccctttaagacctggtcctgcctgtccatcttcacttcttagtacccatctctgtccaccctccccttccagccagacccagtattggccctattggcgagctcacctttgtcctctggccttggctttgcacgtgccctgacttctcacatggaagggaatgagtgcctgtgcctcacctgtccctgggctgcctgccagtctcctgcatactcccagactctgattgcggcaatctcccaaggaatgcacctcctgattttccaggctgaccacccttctgtagcacctggtacagttagttgctttgttcttaattctatgcttgtcttcctacctgtgacttttttcctgggcagtggtgcagctggaatggttcagcatgcatgcagacttttcacgtgaccctgggcagatacttaatcttggggtgccacactcatctgcaggtggggatggaatggtacccaactcctgttgtagttgtgagggttaaacattgtaacacatataaagcaattaggggagggcctggcaagactctgctgtaggagttagctggtcctattgctgttttccccatttcttccttttctctttttctctcttcctcttcttttttcttttccatcttgtttttagctcaccaacacaagagatggaaaacgatgtaagcatagcctttaggtgtgaatgactcctggtcaacttggaggaaatggcaaaatccagtaagacgtaccggggatgtttggagggagtggtgggtgtcagagtgagtaggtggagtggggccagactttagaagccttggataccaagacacggagtttggacttgatgtgattggcaaagtggaatctccggccattgtttatctggtgagaaactgctgtgggagacctgtatggcagtagtttactgagtggactggcaagagtagggaaaagagtggcagtaggagactaactttaaaatatgctgaagacctttaatattgaagagcagcgtggctggattaggcagttgacaagtggcactgacacaggagagactagagagagaggagcaggactccctggcttgatgaaagaacaaaagagagggagctacaatctttggctttgagatttgtagctagttggactgcaggaaaccacaaaaagagtgagggtagctggaatagcatatttttgttttatttttaagatgtgtgggatggcctaggatttggcatcaaagttggtgtgtttattgagtatagttactgtggatgccagcaagaaggagagcgatccgatatatttacaggcaggacaagagcagtccacatccgtaagcaggaaaacagtgtggccaagtattgttttcggacttctttggctgcgttagcatgctggagggttctgtccttgacctttctgaattgactattgtgtttggtgaaagtagaggtcacactcatctgaatcacctaaagtcatctgtatgactttaaggcaagaaggaacagcaagtgtgtaggttggcaagtaagataaaaaacagtccggatgagatagactgatggcctggccctgttgatggaacaagggtgaatgcaaggttttgaatccagctgcaaagtgtaggagggggaggctgtgggaaggatggagggttttagttggcaggtgtctgccacgtgatgtggcctctaaacagccatcttgtctgcactgaaagaaggtggtctgcttgcttcatccttgtccacaagctggtcaggccacttgtggagtatagcatgcagttctaggcagtacactctgaaggacggaaacaaactggaacctgtttgtaagacacagggaaaggaaatgaacccatagaacatgagctccttcagggtaaagattgttcatttgcatctctctgaagctttagtgcctacctacatcagtgtccaggcctagtatgtgctcacctgttgtccattgaataaataagagattggggttgtcctgtatccaggacccctgagcccaatttgagttcaaagtaaagaagaactttcgaatagtgctttcccctggctgccattagtgggaatgtgcatctgcacgcaggatgtccacaggcacaggggagtcaagcttaggtgggtggttagaccggtgggcctcaagattccatcactctctccatgcgctggactctttgatgggagagagtaagggagcgtgagtaaaagtccgtgatcagtgagggtggccaggagcaagtcgatttgtaaatgaatgtgctggcaaacttccttacaaaggcactcccccaacaattttttataatttctagataaaatgccctgatttgaaagaaagtcaagtagaatttgagttaatagcgtgaattgcagtcccatctgctcagctccatggcccggtagatctgtggagccatttgtcacaatttgttttaaagccaggaagaaaaacactcctggacactgcccaacacttctcacggagatgctgtctttggagtgtggaaggggtggggtgggtggtgagaaagctgggtgggacagaaggagggccctgtgctttgaggcaaaagacagggttccagcccctcttcactggcttgcttgtgaccttgggtgagtcatgcagcttttcaggcctcgctcctggtgtagaagggctagacagatcacagcttctccaagtctgggccagatgactgttcattctttcctccattcaactaatattttttgagctctgtttaggtgccacacaccattctaggagctggggatccagcagtgccaatactttttctagttttaagactggatgctaagaacatcattgtctacttcatgctattggagagcagcagttcttccaggcataagaacctggaagaaccagtttgcatgaaaactgtcctgagctcgggaaaggctgtcaccagccttcctcttgacgtgcttgaggccaaaaaggggagatagggccaactcagagtgcatgaaaaccaagccgtgaagagtggatagctgaaaagatgcctgtgaaagcaactttgatcagggaaggaatggtggactcggtatggggaattcttcttgggaaggtgattgtggagcggctctcaggagacaagaggctttgtttgatgactggcaaaggccttttgagagggtgtggtcggggtgatggctggcacctgtgaggaagacagttgttctggcgagtggaggtgtactgggaaagggtgttccaggagaataaccagttgattcatcccacaaacatttattgggcacctactgtctgaaatgcaaggggacacacaaagatgagttaaggatttgacttaaggcacaacacaacacaacacaacacaaggcaggaatggttgcctgcataaggcactgaggaaggttccctagcagagatgacggatgagctaggccttaaagtatgagtgggcattggctgggcgtggggtggagaaaaggcctttccagatgaagggctctgaaatgctttatgagtttgccttggcagagaccagagaccccataaccagatgctgttcatttgattcttggaatcatgggaatacttcagtgccccaaaaagaagatgccgttacaatgtttgaagatgacattctttgtgcttaagctgccttaagccttttcttaaacagcctggatgtgcagcaaaaaagagtcctttctgccccgtgttgtagggcattggaaaggatgacgtactgggaggtggctgatgcagcctccagtgcagaggcctggaaaagtggatgatctgtggctacaggagggagaggttagggtgggtgaagaagcattatgaatgagcagaatctaggaacactccatgggtgagggtcatattaagaaatgagagaagggcacagactactctatgccaggaagagaactggggaaggccaactataacagggattgttttggaggaatggatagtgtagacagtcacagtgaatttgtttaaacaaatatctggaattggtgactcaagggcttggtcaagctcagtggcaaaaaatcagtgagaacaggaacatgaagtaagttagagatggggcctagacgtttgggattctactgtttagaagcaggtgttgcagttatccagtgctgcataacaaatcatcccaaatcatagtggcttaaagcaaaaattagtttattctctttcatgaagtctgtatgtcaacatcaggaagggctgggctcgtggttctggctcagtctttcatggggttgcagtcagatagtggctggggctgggacactagagagctggagcagtggagactggcatctcattctcttcacctcgtctctcctgtgggctagcttgggcttccttatagtgtggtgggctcagagcaggcagatggcttacacagcagctcgggctccaagtgtgtgtcccaggattgctggcagaagctgcattccctttttgtgacctagccttaaggtcacagagtgtcacttctaccagagctgtagcccacctagattcagagagaggaaacacaggttctgccctctcgatggaaggagtgtcaaagtcatgggtaagcagagcaggcatgggagatgtcattgcaagccaactttgggaaatacattttgtctccggtggggaaattgcatgaacaaatgaactccctcatagcagagaatggagagtaccacctgagatttgatgggcaaactgagaactgggagagaagcaagagaggaggcagcgagtgactgaggagatgtgggcagggagagaggaggaaagccaggtgatgttctgggcatgaagccaggcttgctgtgggtgctccaaggcagatgtgaacgagtgaggatgggaaagaagtggggttggccaggaccatgggaacacgtggctcttgtttttcagttgttctctccactagctggagcctacccttttttcctcttagatttttaaacagcgttttattaggagaaatttaaaattatccttgtcttttttatactgtctcctcattttgctttgtcgtggcatgtgtttttacacatttatttttgaataggtaatgcattcacatgcgttcaattaaaaaggataccaaagaatgtacacagtgcaaattaagtctgcttctgacctaattcttccagagaccatcgccgttactggtttcatgtgtgtctttcagaaaatattctctaccgttgttgcctctttgatgccgactgtacacactagcagggctgatttgctcctgctttggttttagcctcgatggcatagaggcccttccatagcatgaacagccctctccagacccatctactcacctttgtgagagggcagagcctgcagactcagggctgacctcagccctggattctgttcaagctttttctgaacctgtaattttaagtgctgcttctaattcaagtcagactttttctatgttggcttttcgtttttgctttctatggtttctcagtgttctttcacccctaagatcatgattttgaatttttatttttggttctaaggcgcagagagtttagtagacaagaaggaagggagaagacagaaggaaaaagctgccccgtacagagacagagggaagggggctccaaagccgaaagaagaggtccccacgattgtgaaattttttgttctctcacttacatgcacctttccctggcataggggaatatatagttagggaaatgcaggggctttcaatactggtatcacagaattacacagtcttggagctgaaaggggattttaaggattgtctgggtgtttttcttctttaaaaaaaattttaaaattttgcttatagggaattcagccttagagaaaaagttaaaagattatgtaaggtctcttcttccacccaactcaaaaaacacccccaaaccaaaaccaactctgctggactttctgggatggttgatgacctactgagatctgatttcccagagcaggaggtgggaagtgcttgatccagcaatgggagggaatgcttgaacccaggatatcccaaatggctggaatgtaggacagtggtaccatgcccaggctgggaccaacttcttagctggccttcaaagggacagatggcagctgaactctgcgtaatgcccaaatacagctcacagaacccaaagactgtgtctctgcagcgtgcagcattggtctatagcatttgaagctattttttctctgtaagtgtccacaaaattcgtcactttacaatgagcttggcaggatagctgcagtgaagaaactctccacacaggtcccagtgtctcttctggaattttgcctgagcaagtaaatcaaatacttggtaaacacactgatgtcactgtccctagccatggggatttagaactttttcaaaacccctttctctctgtggccccacttgtttctcgctgcagccttttatttttctggagttggctgtggttctccctccatgctccaggccaggttctgtgggctggacaggtatggcgagttaatcctgccagacgaggtcagctctgagttaatgagtacagcctctctttctcccctccagagcatggatttctttcttaagtttgaggagacaaaaatatatgcctgacaaaggattaccgggaagaattaaacacgagtccttcagcatgcacgtatccatttgttgccttccgggtttgctttcttctcagcctgcgaggctcctcattcagtatgctgtgttgtgtggttagctgttccatagtcatactgaaagtggcttctcagatgctgcttgagtcctggggaatgtcaccatccgatgacagtctagctgagagatgctagcacgcccaccccttcttccccccacagatccatatctcatctagctgtacacaaaaggcaactgataactcctgttatcagcactaggtggggtgggaggttttgggggatggtcagcattttttggtttcgatgaccatgtaagtattttaaatctgcagctctggcaaactgataacctccacaactatatcatcagagccctcattaatggaatcattttctaatttgaacaccttgtttgtccttcctctcatttcttagtgaacctgtcagtcttccccagcccttcactggttgagttgtggcagtttggagtcttttgcttttcaggaataggctctgctctctgaccgtttctgtgtcttgacctttgtggcgagtggagctcatttggtagttatagggtctacagttgatggagacattgaggaggattgaatgccaggtattttaaagtggccttgaattaactgttttttggcatctttctcaaatggatccatgggttatcatggcctgtggaggcacctcccatctgaatgcttgccatccatcagctgagtgactgttgacctttgctccatatgtcctcctgtgggcttggctggggaagctcacttctcagaggcacatggcaggatggtctagagagttggttgggcccagggaatagattctctgtccagtgatgacctcatcaacttctcccaagcagttgcctaagacctgcgaattgtggacagctccctggatatccccacattctcttgcctgttaactacatctctttactatctctctggccagaccaccccctttcactcccagtggaggtccagtgatctgatttggttggggtcctcagcagctctcacctggatcaccgcaggagcatgaaggaatcttctgccagggcccctttcccatcactcctgccagaacaatcttcccaaggcaggatttggaatatctgtttccttatttacacccccagtggctctccactgctcatagttcaaagcccatgctctttagtagagcaccctatccctgccctggcctggcccctgtctgctgcttcctcttggtcttcctctactttcatggaccctaccacccatcaatgtcaaactgctgcagtactctggacctccggctcctcgtgcagctctgcatagattcgagctgctctctgctgaggtcctatgtgatgtcctccccaccccaccacgatctagcagaaatacctactcatcctaattagaactgggcacaagcaacctctcttgtgtgaagcctttcctgacgcctgtggaacacctagctcggtgtcctcagtgcatctttcacagtgccacgctttgccgcctctgtttacttatctatctctgcctcctagactgtaaagattgggtcttgtagctcatcagcccagtacagtgtccagcaaagaggagacaccatatatatttgtggaatgaatgaaacagaagcttagagtcagagattgtgggtttggatgccaactctgtatcccactgacaatttctccgagcctcagtttgctcatctcatcagcgaaatggggaatgtacacttccctcacagggtggctgtgagattaaagtaagaagacacctttggaaatgctagtttgctgcagatttggctagtgcctggaattgagcaggtactcagtccttatttcctgtttcaggtgataaccagagagaaagcctctacttcaggagaccgcatctcattgtgccttttgtcttcttccaaagaggcttctctgattttgcccctaattaggagggcgtgcctggagagccccttaacagcatctgggcagggcttgccaccagggggcagaggcttttgaaccatcactgctttgtcagagcctgtagcgaatgttcaaagcccaaatcttgttccaaatcccattccctccaggacccttgtcctcagtggggatttagaaatggccccatgctgtatgtcacgtccttggctctgtgtaagtcagcgacagcctgcatgttaatgcctaaactgctttctcaagattcctccaaccatctgtcattcaggtgccttccttgtaccctgaaaggatgattttcatcagggctcacagtacctgttaatgcctcatgaaggcatccagttggaagaagcaagagaagagatgcgttagagggctcggaagggatcaacatggaatggaaagtttaataactcagaaaataggagtttttaggaaagtggctaaacagctttaagaaaaagtaaatgaggtcaaacctgttcaaccaggcccttgtgcattaagcagctcaaacagagggcaactgattaaccatttgacacttcacacacctgcaaagttgacctgaccaggctggctccagccaattttgcaatcattttctctctccacccattccctatttcaccatcagcccccctcccccacttcaggctccttggccacctccctcctctccacttacacaacctgaattcatctgtaccaaaatattcacccctctctgacttctttttttgggttttatgaggcaggtggtctgagaaattgcttatgactgttggtcctaattatgaatctaattcattcagactatagaatacttagaaaacacaaagtgcaaggaaaaaacaatcccttattacccgacctccctttagcgttttttaaatatactagcccagtcctttttccacacatatatagaggtgtgtgggtgtgtgtgggtgtttatctttacgaaaatactttcaaatccttttatagcctttctccccttttacttagtagtgtgctttcagcatttttaggtgttcataaatattgttctctgcagtttttaaatggttgcatactgtttcaccacatgtggagagtgctgtaactgactgatggattctttgtttggggaccttttcctgcttttgtgacccaccccactatggtatagtgctcattcttgtaccttcttttggaagtccctgaactctccagcttggtcttgtgtatctgcgagggccctgtttcccagttctcttctctgggctgctgaagaattagtctctacctccacggttctgttttttgcatctgtgatgctggcttatctgtgcctccctggaaagaaagagcagggcccactgcctactgcctggtcatagttatgctcaagaacatggtccttgaattgaatagggaaaatgtccaatccagggctacccaccgatgacagccaagcacaggagcctgagccaccagcaatgaaagtcaaagctgagggagaaggagcggccatccattgttaccattcgtaacaggtgcttgggaaaacccccagaagcagtgtcagggctctcactatttatttttagttgtgtgtagatgttcatgctttatgagtgtgctagacatatttcagggtgcctgccacccacactcttggtggggaacggtttggggcccttcacattccctgttgcccaaagtggttatatgctgggtaatggaatacagatgcccatctggtcaagtccacctagatctgagtgtgttggggaaatgcatattgtaaatgaccccaaaatctacaactttgggggcctggttaaaagaaaaaaggtctcccagccagtcagactgctttctggggaatttgcactgagaaccacagtggtgagtgcagcagcaacaggcatgtgtaagctgagtatttggagcacagaaactatggctgagtaaaggaactttgtccctgaagagtggcgggagctgtcctgaggagggcggtctaagtcacaaaggttttccagttctggtccttgcaaggcatagctctgctgtgatcctcactcatgggttgccctgaaatcccacagtgtctttttgtatcctttctccatcctccccacttctccccacacactagagctagttgttggggctctgcttattgcgattatccagctatcgtccaggaggatggcacattggctagtgcttccactgctgagagggtcacagcagtgccttgggcagagtcaggagaagaggaatattcctgttttgtaccggagtgctttccagggtgaagagctgaaggagctgctctgagtaggacacggcactgaggttcctttggagaccccaattcacagcctgggcattcgtagctaggcagccccattttctagttttgtgtctccatggcctagtgttgggagacagaaggtggggacactgtgttgaaggacacagcagactgacttatcatgggcttcctgaagccagggccacccctttgtatccaggtctagttctgatgccacttgaaaaagccccccaagtgcttttgctgttggcgccccgcatctctctgctgcctggtagctgacattctgaccctgcctgcagatgcgctcccggcatgttgtcagcagggccctgggcttagcagtcctcttcctgaagctgtgagagcattgaggggtgcacagctggggccctgccagctccaggaggaggtgcaggcagtgctgagtgtggcgggagctgtggaagagttattccagtcctctttaggagagggtggtggtggcggccagtagagggactgtttgaaatccagcagacacctttctcccagactgaaaacctggggaccagactgagagtctggagaaactgaggtatcctaggtccagaaatgaagcgtaaaataatagcaacagtaattgctgtgaaatgtatgctgtgagaaggaatgaggcacttactggttcaagtgatggtccttttactggaactcactctaagctgcggttcactgagcctctggacttctcagagggagtgttgccatgaagctgccctctttaaaaaaaaaaatgcccaacactcagcctatttccattatctccaaaaccggagggaaagaaagagcggtcagagtaattacagggagaacatttccaggcaagtaatctgatcttgccttttaatttttttcccctctagaaaatagaaggcaaatactggcacttatatttacttataagcatttctattagatgctgccttgaatctaggtggggctgaaaacagtgtctattcctgtggctgtgggcatggctggcctagggcaggctgcagggctccctcgctgcctttcttttttgatgctgcttctgtgctgtccttcgcatgagagtgagggggaatgcaggtgagagggtggcaggactcaggtgctatccctacctttgctgggaggagtggaggatagaggcaaagaaatgagcgataggagaggaggagcagaatagaagggcaggaagtggggtcttttgggctttcctggttccaagcatggcatagggtgaaagagccatggacatcctgaaagtgataaggtcttccctggggtttcagtggtcatggataagagaagctggggattgtacaaattcaggtggggaaaggataagcagtagaaggcatgggcttgttggttatagaaaaaaaagtataaataacctaaatattcattaatattggaataaataaaatgtggtgtaatcctatgatggaatactgtgcagctatataaagaagaaaaatgggaactatatttgatctcaaaaactttgaggaggaaaactgaggaacataactcaatgaaagggatgataatgtttatgtaaaaaatgctgaaaaataatgtatatttttcagtggttacatatatctggatataaaagcagttttttggtttttttttaagtctggagagctctatccttaaatcacagtagtgctaatctctggaaaaatgaggggaagcagggttagtggtagtagtcagaagagataaaagacttaaaatactgtattttttaaaacatttaagtaaatattctaatctaagtaaatagtagcatgtttaaaacatttttgagttatggtttagcagtcctctaaggaagcagcgtcaacatttagtaatgagggaattaggcagcagcttagaagcagccacccatccctggggctcagtaggtaaatgtctcaacctaggacaatcgggcagtctagtgacacagcagtgcagacatcagagagatcagtcaggttgggatgaaatgaattactgggtttgcagtccttttggctggttctgtagctggcagttacatcttcttagaagtagtatcaataatttaacattcattaatcatcatctttagaccagctctattttaggtaccactggggattcagataagagaaagaatgaaagagtgaatgaatgatatttttgtccttggatttaaaaccaggccaggccctcatcttgtcgcatttgactgtgaatttggtctgtctgcttccagtcctgccctctgctctgtccttcacctgccaccagagtgataattcgaaagtgtaaatctgatccgtcttcttccttacctctgttaggctctttctcaacttcccctgtcccagaggaggtgtttgactttattaatgtgcctttcggtgcccttttccgcctggcactgatgtgccctccagtcatgtgacaaaacgacctccgcaaacttcttgctaatcctggaatgcactgcggtgttttcatgtggtatatatttcccttgcgctttgggatccaattcagatgacactacttttttgaaggctttttgaatgctttcactttctgaaagggcttaaccttgcactttgcacctcactgctatcgtataccattaaaatgattagttatgtgtatttattttaggattgtcagcttaggacaacttgtcaactatgtcttattaatctctccctcacagtttctgtcctagtgtccatcataataggtactgaaaaaaatgttgattgaagccatagcatatgttcttgttacctttctatgtaacaaatgtttcccaacctcagtggcttaaaacaacaattttgttatgctcacagaatctgggggttgagaatttacaggcacggcaggcatggctggaagttccaaggctgggggcagctcacaggggaggcttgttcactcacatggtggcaggtggagctgggtggtgattggctcattcactcacatggtggcagggggacctggctggagccagctctggactggagcacctgccctgggcctctccatgtgccttgggccccctcacagcatggcctcaggaccgttggctttcttatgtggtggttcagggcaccctgagtgaaatggaagctacatcacttgtcatgacctaggactggaagtcacacagtgacttcctgcccagatccacagaggagggaattattctaaactccacctcttgatgggagtgtgtggcatggtcacattgcaaaagagcgtgtgggaaggagatattgttactgctgtgtctggagaatacaacctgccacggtgtgtgggagaaattagttccacagctagagttaatatcactactattgctactactgcaactagcggctaaacatttattgagcacttattgtgtgccaggaattaagttttaaatgtagcaactcattaaatccttccataacactgtgacgattataccactttacagatgaggaaactgaggtgcagagaggttaagtaaccagcccaaggtctcacagctactgcccatgctgtgggaagtcagtgaaggcgaagacttaggaattcactccgaactttaggtttgctgctggattgtggcagtgcatttatcacatgggagttgatggctgtttcaagagccatttttttttttttttttttttttgagacaagatctcgctctgtcacccaggctggagtgcagtggcacaatcattgttcatggcagcctcggcctcccaggctcgaggaatcctgaagggacctttttttttttttttacatagagtgttgctctgttgcccagcccacagtgcaatgacatgatctcggctcactgcaacctccacctgctgggttcaagcgattctcctgcctcagcctccggagtagctgggattacaggcgcacatcaccatgctgggctaaatttttgtattttcagtagggacagggtttcaccatattggccaggctggtctcgaactcctgacctcaggtgatccacctgcctcgccctcccaaagtgctgggattataggcatgagccactgtgcctggcctcaagggacatttttgatgaaagtatggatccagataaggtccttgcacctgtgggcttaggaagctgaacctcaagctgtcctggttttatggctccacttgtgccatctggaccttggttagactgtcccttgatggcagtgacattgaccgagtgggctggagtgcagtggtgcgatctcggcttgctgcaacctccatctcccaggttcaagcaattctcctgcctcagcctcctgagtagctgggattacaggcgtgtgccatcacacccggctaatttttgtatttttagtagagctggggattcaccatgttggccaggctggtctcgaacccctaacctcaagtgacccatctgccttggcctcccaaagtgctgggattacaggcttgtgccatcacacccggctaatttttgtatttttagtagagctggggattcaccatgttggccaggctggtctcgaacccctaacctcaagtgatccatctggaagtgctgggattacaggcatgagccactgtgcctggccagtgcaagtgcctttagccagcttcatttactccctaactccttgcctcaggttctgcatccgtaaagtgaggtcactaggagtatttacctcagagggctgttgcaaggttaaagctggttatacaagcagagtacttggaacagtgtcagttacctggctggggctcagtaagtgctggctgtccttattggaaaggttcaagtgttgtgttttcctgtcacctgatctggaaagaggtcaaacaaaggatcttttagcccatgccacttcctgtccttccttggctgaaggctgacaggtaagaatccccagaagttgtcaccgatgtgcctgtggaagtgccttcccgattgctttccctctggagcctttaagttccatgaagcacttagttggcctggactccacctattcagcatgctgtggcagctcagttcagttcccatttttaacttgggactgcatagattccccaacatttcttttaggacccggtgaccaagaaaatccagtcagtgctttattacttctcactgatattcacagagcacatttagtgtgagccatggaataagaaaactcttagtcacattctgtgtcatgagaaggttacttaaccttgaaaaccatttccttgtctggtaaatgtggctgtaatgaaatcgaccccattcactgttgtgaggattaaatgcgatgatgtatgcagagcaactaggacagtgcctgggaaagtgctgctcatgatcatttatcttcggtttagaacaatatatacttgtttatttaaaaaaggagataatagagaaaaggtattgagaaaaataggagaggagaaaatcactcatattctcaccattcagtgaatcagcccagtatcatcaatgttttgtttggttgtttttgtaggtgtaggatttttttttttttaacgtaattttcctgcatatgcagttttgcatttttaacccaaacttaatgttctttttaatgttcttgtacttacaaagatttatcctgtttttagattgatatctcaccttggcagaaatgagataaaattttaaaatattcatttggtggctttcacagtgttatttgatctctagggtctcctgtgagtttgctacatggtgcgttgtattactttcatcttatagatgaagaaagatattagtgtggctgagtcgcatgcagaatttggaggagcatggtgccgaatgagccttgatgattgtaggggccacaactggaaaagtagatgtaaaatggtgaggtcgatccctctgacactttcacatgctcagtcacgcatcttgaacgtataagttggatcctgtgcctagagaggtaggtttctgagccaaggcatattccaaaaattcatgagaagctggctttcccaggcacagtgagccctcccggctcactaactcctgaatcatacctcctgcccctagccaagtttatctaggacttgagcacaaagaaaaagtgggagcatctttgaacaaggaatatcttgaaaaactagttaagtggtatcatatatttgtgggatgggtgatttcaaaacccaatctaaaaggacaggaccttgctcattgacaatttattgtctgatgcaatgtttcttaatctttttgggtcttggattcctttgagaatcttttgaagtttatggactcttttcccagaagaacacactcatgtgtatgtaacacaattttgcattcaatcttagggactgcaggtgtctacattagttatatattggtgtaaaaaaaaaaagccccaaacttaaggcttaaaggaacaatagatgtttattatctcacagtttctgtagttcagaaagtcagtaacatcttaactggatacttctgactcggagtctcttaggaggttgcaatcaagatgttgttggggggaaaggggcaggttcagtggctcatgcctgtaatctctacactctgggaagcaaagccaggaggattacttgagcccaggagtttgagaccagcctgggaaacacagtgagaccctatgtattagtcagttctcacattgctataaatacatgagactggagaatttataaagaaaagaggtttaattgtctcgcagttccacaggctgttcagggagcataatgctggcatctgctcagcttctggggcaagcacaggaaactttcaatcatggtggaaggtgaaggggaagcaggcacgccttacatggccaaagcaggagcaagagagagaggggggaggtgccacacacttttaaacaattagatactgggagaactctaacaagcacagcaccaaaagggtgatgctaaatcattcatgaaagatccattcctgtgatccagtcacctcccaccaggccccacctctaacattggggattataattgaacgtgagatttaggtgggtacacagaccccaaccatatcatcccatctctataagaaataaaaaagttagccaggcatggtggtgtgtgctggtggtcccagatactcaggaggctgatgtgggagggtcacttgagcctcagaggtcaaggctgcagtgagctatgattgcaccactgcactccagcctgggtgacagagtgagaccctgtctcaacaacaacaaaaagatgcctggggttgacattatctgaaggcttgactgagttgactgaggctggagaatctacttccagtcacatgctagccaagttagtgctagctgctggcaggaggcctcatggggtcctccccatatggctgctttgatgtcctcataacatcgtgcttgtctttttatgacctagccctggaagtcacattccaccatttgtgcatttcctattggtcacataggtcagtcctatttagtgcatagggcaaggtctgagaggggagtagtgctcactgcccatgccctctcctggtgcacgccgcttccagcacccagaagctctcctaactccattatttagggttttcatatgggatttcattacgtgggtatgactgatcaaatcactgaccaatgctgattggatcaatctgcggtccccctcttgtccttggaggtctaagggcggggctgaaaactccacaattctaagcgtggccagctccttccttgaaactgcctccgtgctcaccttcagtcacctcgttagcataaactctgggatggccaaaaggggcttcttataaataacaaaaggtactcccattgcttaggaagttccaaggggtttaggagctcagtgccaggaactggggacaaagaccaaatatgtatgtatgtatatatatatactacagtagtgaattttatatagcaaacatgcattatttttctttttggctaaaatttttttctagttataaaactggtacatactcattgcagaggactgggggaaggagtaaaatattaagaaaaaaataaaaatcacttgccatcctgtcacctagtattttctttctagttcttttcatgcagttatatataacattttgatctttctttttatgttacagaagtcatatttgcttattgcagagtaatccaaagagtacagaatgtctaaagttaaaaaagttatttaaaaaaaatgatccttgcctgggaggaactttctattgtaggctgagaggggagatagaggggctgtgggtcagaggatgccctggtcagggttgggcgcctgtgtctctctggaggcagcagaggtctgcacagcggggtattaccattatagggaaatggtggggtgggatgtgtggaaggggaattaaactgccaagaagaaaacaattctttttatgttgagaagcattattttcaggggtcagaagccctttgtggggcagagggaaattaaggaggtatttaataaacaggtgcagctgaatgtgtgtggttaaagtgcaatccagtagttatttatttgtccggattgtttataacctgcttccagcctagacaagttgatttgaccctgctgtcctggctcattcaggccacttaacactgtttacctttgggtggggaggacgtgcatgatccgctggcctagtgcctttgtaaggtctgtaaatcggatgcattctggttaaactcattattgcatcacaaaagccagtatctgatgggtctcagctgttttcttttgcactggggaagactggaggagaatgaaacttccttgaaccagtgattgggtctctaccaaagagagaaacttaaagccagtgagagccttaagatatttcatttgagcacttggctggcaccatgtaggtagagacactttaaagtaacagtgctttgctacacctgatttgaatcatctgtggagcttcaaaaaaaaccctaattaatcctaagaccagttatgtcaggtggggtccaggcactgttattttttttaaagctccccaggtgattccagtgtaggtccaggattgagaagcagttcttgaagatgctggtgtaccctgacctgcctccagccttctttgcaggagatggatgggggttggttgtagttgctctgtcatagaacactgcaattctaaggatgcctaatgttatgaatgtaggtaaattgtttgcaaaatgttctgtgtttcaggaatactgcaatcatttgatttaagtgtcaccatatgtgtgtgtgtatacagtcatgggtcacttaatgatggggacatgttttaagaaatgcatcattaggcaatttcattcttgtgtgaacatcatagggtgtatttcaacaaacctagatgggatatatattttcatttatatattttattatggaaaatcaaatgtcccagcactgttactaaatatcagtcatttcccctacttgatctgccatgccaacattaagtgccatatattagatctctatatatgctccattataatcttacaggatcactgttgcacatgtgtttcctcattgactgaaatgttattcagtgcatgactgtacatatattaaaaatgttatgcaccatattttaacatactgatattactaatgagttgtcctcatggtgactttaaatgtcataattaatgccatcaaccagaatatatcaaataaattcagataccacttgttctgtttatttccttcccctgccaattttttatttttcctggttctgctgaagccaagatggggtgctgtgtaagattttgtttgtgaggaaaggttctgcatgaattaaagttttgcaagccatgggcatttcattgtatgggccgttttgaggtctgtcatcttgcagattagattagcttacactgaggcacagtcacctgctgggctgggcagagagctgcactccactagtatttgagctgtcccggctgttcaccagctggatccacttcagataggcatagccagggcagccgccattcccatttgtgggggaaaagggaagctatcacaagaatgggctgcagctgtgggatgaggtgggcagcccagtgatggtgtcattgtcaaggggccgttgaaatgtccttaagcagtcattggccaaatcctgtcctctatggatccagagccacagaatgttccagcagaaatatgtcttagccagcagctctttattgaggactgattgtgggctaggctctgtgctagggtctttacagatgttactaaatcttctcaataaccctatgagacaggcattattatccccatcttaccgatgagaaaactgaggcttagagaggttaagcagcttatccaagatcacagttaataagtgacaaagccagcatcggaacccatgctagtgctctctaaagcgttcttagaaatcatgtgatagatgagaagatcaaggtctggagaagaaaagcaagttgtctgagatgacacaaccagctctaattggtggcaaagctgcgcctataactcacctgcgcttttcacaacctgcagtacgtgaccactgccgaaatgaagaggcaggggtgtgccccctcccaccttctgagtggctcaggcacaatcaatgttgagttggcacgaaatgagaaattaaactcaccatgccactttaagaagaacatggagaaggcaggcagaagtgaccttggagaacagtatctgagccagaaggcaggaggtcagcgggggagtcttgagtgggaaactcaagggtagcctgactgtccttgtcacaggtttagctgggcactgttagttcccccctttgtcagtttgtgggaatctgggcatcagggatctgtttcagcccttcacatttgtatttgggtgtgctcagcttaaaacgatagcagcctgcaggagctcagctctgcctccatttatggagggaagagaaactaaggaatgctccttggggtggtgttggggagcagctacatgggaaaatgaagggtgcagcaccagtaaaaaggtgctcccaggactccctcccaccagcactcggaccaaggaagaagcatttaatttcagccagattcctagatggttgcttttatttgttttcatctgaatttgtgccaaggattcaacttttcctgcttattttattaaaaactttatacacagcattaataaatagatataaaactgccgtatacatgacaaacagaggggctaaatgaaattcccaagggtcagctgttgaataagtaacaaaagcacatcttggcatgatcaaattcccatatatgcaaattagggacagtgctttaccacagagtgttttaattaatatttataaatcacagagtgcctttgaaagggccagtaagctgtttatattattatcatgtcacacaaataacaaaccctttggagattgctgcctactttgcattttggtctgagaagtaagtgagcatgttgcgtgtgtttctctccctcgtaggtgtggtgtcagcacagcggcaggtcaccgttcaggaaggacccttgtaccgcacggagggctcccacatcactatctggtgcaatgtgagtggctaccagggaccttctgaacagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaacccaaccctattgcacatcacagatcttcaggcccgggatgccggggaatatgaatgccacacacccagcaccgagaagcaatactttgggagttaacagtgcaaagatgaacctagtgggtaaggagaagctgtcttcacgttgccagcgtctggcctgactcagttctttagtagtgtaattttgctttatgccatgcatttgactttaaaaaaaatcccaaaactcccagcatattttaggggtcaacagatagcacaaggaaactaaatttctgtgttcacttctaaataataggtggttgagggtgaaactttaaaaagatctaatgcagatgttaagaatttcgtaagttaactaaccctgtaactggtgaaaagggatatgaaaatataaggcaaggacgtttgtggttgatgatctgaatgacaaggaagatgagacgtatgacatcagttgggagagaggagaaacctctcggaaggataggcctttgggtagctctgagacccacggggcactgctgaagcaggaagcacatgtggctgcgggtccttgctcagaccttgtacattgaaggtcctttggctccatgcgtaaggaactatgaactggctgtctcccttgttgctccttaatgctgaaggaaacatgaggaagagggatgcaggagcttccagtgtgggcagcactggtcacagtgtttgccagtgtcaaagggttaaccatatcaaggctgttctgtttttctgcctatattaatgtccagtttttattatcacaactaagcagtgggtgttgctagttcttttattaatacacatactatcatttgtttatttttcctttctctaactagtctgtgttccagcaggagaccttttttttctttttttttttttttgtgtgtgtgtgtgtgtgtgtgtgtgacggagtttcactcttgtggcccaggctggagtgcagtggtgcaatcttgcctcactgcaacctccacctcccgggttcaagcaattctcctgcctcagctcctgagtagctgggattacaggcacctgccaccatgcctggctaattttttgtatttttagtggagatgggggtttcaccatgttggccagactggtctcgaactcttcacctcaggtgatccacctgcctctgcctcccaaagtgctgggattaaaggcgtgagccactgcacccggccatgtgatgggaatgttctgtgtccataatagatgctgcatattgctggcccagctcctgaggctctttggacctccaggaatcggtgtctctaccaggaacccttaaccctgacccggactcccggctgggacccggggtgttggagtggcaagagcgctgtcaggcctggtgaagggtgtgagctgtccaacagggcagggaggaggcagggcctgttctgcagttggacagacagagccctctagctgctttctggaagactgaagggcaggtgatgttggagggagggagtgcaggcaggggctgtgagggagttcaggtcagaaacaggtggcgcctggattcaggctgtggtggtcacggtggggatgaggggctgctttggattgtgctggggatgtggggtggtgcgctgctgcatggctactgccaggtctctctgctcttggtgtctgcatccagggctgggagggggtcaaatgtatcacactatcggccccaggcccaccaagcctggggaggtggccacccttccacgatggcatttggatgttccctgtgtgtggggagggcacggggactccattcgtagaccacctctgggacagtgtgtctgcctctgaggtcagatgctctgcactgggacagcgtggagtggagggaaaccaagcttggggctcattggaggggcttgctggcagacaccgccctttgtgggaaactgactgtgggagaggggaaccccaacctctgtcaccacatccctcttccctgttgtcacacctgtcacctgctgccgtagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcaggtgagtggcaagtccagcgtcagagcagggcaggctggcggtgcctcctgagccccctttgccatgcttaccgcatgcacatcctgggcttgtgcaggaatgccctgtcccctacctgccctgctccgtgcaaaaccctgtgcctgggagacatgctgagagaattcatggaaacaaatgtgttactgacagcctctttgcctccagagttcaactggagacagagaaaccagctagaggcagagggaggtaacacggagtcccccagaaaggtctgggctgtgcgtgcttcaggtaacctcccttgaccttcaggagaacgagaaggctgcctgatcagagagtctctgaagaagattctgtggctacaggcttcagcagagtgtgagggagaccccggttatttcctcagctgtttccaccaaatcctcctgtctttcgtggccaacaccccaggcaaggcttggggcccccgtctgctgctggacggtaagtcctggccccgtggcagtgaatctgtggggcgctctgattgtgggcactatggaagctaaaccccatgctccaggtggggtggagggtcttcagaggactcctggacagtgccaggctctaggctggggtgggggacgcaggagaaaccaggccaggcccatccctgctggagcttctccctaagcagtggaggctcagccactgtgaggaggtaggccaggccctgcagaaagaggggtgtggaaatctgggggctcccaggaagggccgctgctggagatggggttcttaccaggatgggctctgaagataagcagggaggatttgggagggcagagatgaggcccagagcttctggcagagggcatggcctgcgcaaaggtctgggggccggacagcctgcacgtattctgggaagcgggaaggagactccggccttgtgtttctgaggcccgactttagactgtgccctgttggggaggggccagggcatgtctgaggctgggcctgaccctgctccttaccccgtgggtgcagcagagccatgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggaggtgagcggggcagggcatgggacatgggccctgaaaactgggcaagtggacctgagcaataccttcacccctctgagactcagtttccccacatgcaagcttcgcttggactctctcagtagcctttgggaaggggacggtgactccgagagcagggtgtgggtctctagagccaaacagggccccttttctcagttctaagagtctctgtttctttggataaactccactgttttgttgtttggttgttatttttacttatttcttcctatctatctatctatctatctatcatctatctatctatctatctatctatctatctatctatctatctatatctatttagagatggagttttgctctgttgccaggctggagtgcagtggtgcaatctcagttaactgcaacctccgcctcccaagttcaagcgattctcatgcctaagcctcccaagtagctgggattataggagtgcgccaccacgcccaacaaatttgtgtgtgtgtatatgtgtgtgtgtgtgtgtgtgtgtgtgtgtgtgtgtgtgttttctgagacagagtatcgctctgttacccaggctggagggcagtggtgcaatcttggcttactgcagcctccacctcccaggttcaagtgattctcctgcctcagcctccacagtagctgagactacaggcatgtgccaccatgcccagctaatttttgtatttttagtagagacagggttttgctatgttggccaggctggtcttgaactcctgaccttgtgatcctcccacctctgcctctcaaagtgctgggattacaggtgtgagccactgcgcctggcctaattatggtgtttttagtagagatggggtttcaccatgttggtcaggctggtctcgaactcctgacctcaggtaatccacccacctgggcctcccaaagtgttgggattacaggtatgagccaccacgcccggcttattcttttcttttcttttcttttttttttttttttttttggttaggagacaatttctttctttcttttttttattttattttattattatactttaagttttagggtacatgtgcacaatgtgcaggtttgttacatatgtacacatgtgccatgttggtgtgctgcacccaccaactcgtcatttagcattaggtatatctcccaatgccatccctcccccctcccccctccccccaaggaacgctgttgcccaaacagggacatgaagggcttattctttttttaaggtggagtcttactctgtcacccaggctggagtataggggagcgatcatagcccactgcagcctcaaactcttgggtttaagtgatcctcccgcctcagcttcctaaagtgctgggattacaggtgtgagccatggtgcctggcttctactgtgttattctattttagactcttatctcatgttatatataaagataagttccctcctaaagacttaaacagaaaaaatattatgtttttcatattttgagacagggtcttgttctgtcacccaggctggagtgcagtggcatgatcatagctcactgcagccttgaactcttgggcttaagcgatcctctcacctcagccccctgagtagctaggactacaggcgtgcatcatacctgactaattaaaaaagactgttttgtagagatggtctcactctattgcccaggctggtcttgaactcctggcctcaagtgatcctccaccttggcctcccaaagtgctgagattacaggtgtaagccaccatctctagcagggaaaaaaaaaatgttattaataaagtatagcaatttccctttttgtcccaattataaaagtcatgtacatttgtttgcttaataaagaggaaactgtctgggcaaggtggtccacacctgtaatcccagcactttggggggttgaggcgggcagaccactgaggtcaggagttcgagatcagcctggccaacatggtgcactctgtccctactaaaaatataaaaagttagccgggcatggtggtgtgcgcctgtaatcccagctactcaggaggctgaggcaggagaatcgcttgaacccaggaggcagaggttgcagtgagctaagatcatgccactgcactccagcctgggcaactgagtgaaactctgtctcagaaaaaaaaaaaaagaaaaaagaaaagaaaaagaagaaactgtaatcccagcactttgggaggttgaggcgataggattgctttagaccatgagtttgagaccagcctgggcaacatagaaagaccctatctctacaaaaaagacaaaaaattgcccggtgtggtggttcttacctgtagtcccagctactcaggagactgaagtgggaggattgcttgagcccaggaggtcaaagctgcattgagccaagactgtgccactgcacttcatcctgggtgacaaagtgagaccctgtctcataaaacaaaggctgggcacagtggctcatgcctgtaataccagcactttgggaggccaaggtgggtggattacttgagcacaggagttcttgaccagcctgggcaacatgatgaaaccccatctctacaaaatacacaaacaaacaaaattggctgggcatggtggcatgtgcccatagtcccagctacttgggaggctgagatgggagggtcaattgagcccaggagactgaggctgcagtgatccaagatcacaccactgcactccagcctgagcaacaaagagagactttgtctccaaaaaaaaaaaaaaaaaaaaaaagaggccaaggcaggcggatcatgaagtcaagagatagagaccatcctggccaacatggtgaaaccccatctctactaaaaatacaaaaattagctgggcgtggtggcatgcacctgtagtcccagctactcaggaggctgaggcaggagaatggcttgaacccgggaggcagaggttgcagtgagctgagatcgtgccactgcactccagcctggcaatagagcaagactccatctcaaaaaaaagagaaagaaactaaaaacaaaaaccccaaaactcgaatggacttctcttccatcctcctttgggcaggtgggcagcagggtgtgtatgcggggccagggtggaagcctgcaggttctcatgcctttatgtgccacatggcagggacacactgcgggacggtggctctgcagtggatgcagccattgcagccctgttgtgtgtggggctcatgaatgcccacagcatgggcatcggggttggcctcttcctcaccatctacaacagcaccactcatgagtgcctcagaagaggagagggagaggggcagggggtgtgggttgggccgaggcacagctgggtggcccccaggctcacgtggcataaagggttttggtgggtgggcctgcctacctgcttcttctaggaaaagctgaggtcatcaatgcccgcgaggtggcccccaggctggcctttgccagcatgttcaacagctcggagcagtcccagaagggtaagccatgctgcagacttggggcatgggtgcagagctggctgagccaccgggaaggggccttgcccacagaagcctgctcccgtcagggttcaggggcagttctgtcaccccccatcccttcctggccccatagcaccctcccacaatgagtggtcaggaccatcatcaccacggtaaagggccgggagcttctgttatttctgctaaggcctccggggccactctgtgcagcacatggaaagaataattattatgctagcagacctcatggatcagggctcactggggcccatgctctgctctgtgcttttcacccacgagcctctcacaaccctccctgctcctttgggctaggggatgctgtgtggattcccattttacagggtggggatgctgaggctcagacaggtcatgcaaatcagctgaggtcacacagctgggaggtggtgaagctaaaattgaacccaggctgtctatatcctgccttttcaacaggcatcccattcactcatttgttcatttgtggggatggcgctctagaatgtgaggtggagtctctcttttctaatctggtcttaagtggggaggaggcccccaaattccccaggtacctgaggggaagccactgtccatccaggaagccactgtctgtccccaaaggaggcacaatagattgtgagataaaagttggaggatgggagggtctcaacaactcacgcctctaatcctagcactttaggaggccaagtcaggaggagcgcatgagcccaggagacctgcctggacaacatagcaagactccatctctacaaaaaatggaaaaaaaaattagcaggtatggcggtgtgtgcttatggtcccagttactcgggaggctaaggtgggaggatcacttgagcccaggaggttgaggctgcagtcagccatgattataccactacactctagcttgggcaacaaagtgagaccctgtcaaaaaaaaaaaaaaaaaaggctgggcctttttttcacaggctcacgcctgtaatcccagcactttgggaggctgaggcagatggatcacctaggtcaggagtccaagaccagcctggccaacatagtgaaaccctttctctactaaaagtacaataattagtcgggcgtggtggcacaggcctgtaatatcccagctactcaggaggctaaggcaggagaatcgcttgaacccacgaggtagagattgcagtgagccgagatcatgccactgcactccagcctgggcaacaagaacgaagctccgtctcaaaaaaaaaaaaaaaaaaaaaaagttggaggatggaggggcaggacacactcaccatagcaggtcttagacttcaggtgggggtcctgggtggtgccctttggagtcttctgcaacatactcaatctttgattttttttttctttttttttttttgagacagagtctcactctgtcgcccaggttggagtgcagtggtgcgatctcggctcactgcaagctctgcctcctgagttcgcgccattctcctgcctcagcctcccgagtagctgggactacaggcgcccgccaccgcgcccggctaattttttgtattttttagtagagacgggttttcactatgttgcccaggctggtccctcgatctcctgacctcgtgatccccctgcctcagcctcccaaagtgctggaattacaggcgtgagccactgtgcccgaccaatctttcatttgtttttaatactcattgagaaactcagcatctgtagacatgaagttgctgagggtaagagaatgcgggaaccataggcttggcaccttgtggacgcttaaaaccatttatttgactagaatgtattgagcattgtcttaaagaatcagctgttgttcctgaagctggggtgaaaaacaaagacggcagatgaaatctgtgacactccaggtgggaggagaaactaggcaagtgcgggtgtgttacgggctgtagaaaaacagacctggagggcctcaaaatctgggactctatggagggtgacctagtcagggaaggggacatctgagcaaagacccagaggcagagatggggtcaggggagttatctcctggtctgctatccaggtgtgatggcagggacagagccctgtggggagctggggaggctgcagcaagtgatccaaggggaatggcccaggttgtgcgggatctcttaggttatggtgaagcctctgcttcctgtctgagggaagtgggggctcgtggagtgtgtgactggaaggggatggatctggtctatggaccccttggattgctgtgtaaggggcagggagcatgtggggacctgtccggaggtcactgcagtaattcgtggagagggtgctgggaagtggctgacgctgcacagacacacttggaagtggagcctgtggatttgaggatgggttgggtgtgacgcttgtgtagggagtccccggggacccctgatcttttgtctgtacctggaaggatggggtgaccctaatggagacaggcagggttctcaggaagcaggttgagcagacactcaggagctcggttttgggcacgttgaagtttgagatgctttcttcgagcaggcaggtagatcctcaggtctggtgatcggaggagcagtccaggccagcaggtcaatttgagagttgtcagtgcataaatggaggctgaagctcagatgtcaagcagaccaccaggagagagagcaaagacagaggggagagtaggagctaggatggcaggcgggggagactcgggtggagccaggtgctgggatgcaggggcggctctcagggagagtgatgagcccagtaaagctgagagggggcactgggtctggcagtgtgggggtcaccagagaacttggcaagtgtggtggcatgagagcctgattgggctgaggtcaggaggagatttttttctgatattgatacatgatattttctatatttatgggtacatgtgagtgcttgttccatgcatagagtgtataatgatcaaggcagggtatttggagtctccgtcaccttgaatatttttcatttccgggtgttagcaccatagtcctctcttcgttactttgaaatatacaaaatactgttgctaagcatcgtcaccctggtctgctatcaaagattagaacttctcctgtcttggctgggcacggtggctcacgcctgtcatcccagcaccttggaaggctgaggtgggtggatgacctgaggtcaggagtttgaaaacagcctggccaacatggcaaaaccccatctgtactaaaaatacaaaaattagcctggcgtgctggcctgtgcctgtaatcccagctactcgggaggctgaggcaggagaatcgcttgaacctgggaggcggaggttatagtgagctgagatcatgccactgcactgcagtctgggagacagagcaagactccatctcaaaaacaaacaaagaaaaacaaaacaaaacaaaaaagaacttctgtctaactacaaggtggaaggaatcatatgctgggtgtcagaccttccgggatatatgtgcagcttctaggaattgaaaccaccagctcttggaaacttgtgccaggcttcagggtgggagaggcagttctagagccacagccgccaagccaaggcaaatggccccatcatctctcgcaagagcaggagagtccctgggggcagaggccatagttgtacctttctgggcaaagggtcagtgtctgtagtgtccatatgggcagtggggctcaggggggaagcaggcccaggggtctgtttccaatgacctcctcaaaagtcagaactggaaggcaaaaccccttataggctgagtgcacctgtaatcccagcatgttgggaggctgaggtgggaggattgcttgaggccagagtttgagaccagtcttggcaatgtagcaagacccctgtctctacaaaaaataaaaataaaaaattaggctgggagtggtggctcacgcctgtaatcccagaactctgagaagctgaggaggatggatcacctgatgttaggagttcaagaccagcctgaccaacctggtgaaaccccgtctctactaaaaatacaaaaattagcaaggcgtggtggtacatgcctgtaatcccaggtacttgggaggctgaggcaggagaattacttgaactcgggaggtggaggttggagtgagccaagattgtgccattgcactccagcctgggcaacaagagtgaaactccatctcaaaaaaaaaaaaaaaaaaaaagccacgtgcagtggggtatgtctgtagtcttaggtacttcagaggctgaagtgggaggatcgcttgagcctgggaagccaaggctgcagtgagccatgattgcaccactgcactccagctgggacaacagagtgagaccctgtctcaaaacagacaaacaaacaaaaacccttatagttggttggagaaactgaggctgggagaggggacaggatggaggttaaggctcagtcttgcctctctggggcagtagaaaagaggaagggagccctttcttggggctggctgtgtcttgaaggtggcctgtgcttgacctgggtcagggtgggatctgctcttgttttggcacattctggtggagcccatgagtcttacaggataaggccttgtggtcagcgagatgggagggggtctggcctggcacaggattttagacatgcaggcacctgtacagacagacacctcatcctgggacagcaaaacccagccgcatgctactgcttcccctgctgtgccctcctcagacatccctggtccatgtacactcctacctgctgagcccctcctaaaaaaaaaaattaaacatcccctcctaaaaaaaaaaaattaaaattaaaaaataaatttaaaaattaaaaatccccttctgctaggtgtgctgttcacgcctgtaatctcagcgactcaggaggctgaggtgggaggattgcttgaatccaggagttcgagatcaggctgggcaagatggcaagaccccaactcaaaaaagaaaaaaaaatctttcctcctaagcctcattgccccatctgtaaaatgagtcagggactgtgcctgggatgctgcctgctagagatcccgatgtcccccactcagggtcactaactgtggctctctctccccaggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtctgtgggtgcggccccctgacacaggcagggcaggcacagcccaaggaccttgcaggccgtagcagcagtggagcggccctctgccttcaggaccctgtgctgataatgggatgaggagatacagacccttcccaccacgtgtggggacacattctgagcatggggtcccagtggccactgtggctggccacgtgtcctgagtggcaagggacactaggaggctcccggaagggacactaggaggatgagcgctgagtgacagggccacccacctgtgacaggtgctgcccctgctttgtgctggtctcctgtgtgggcaggtgtggggggtggtctagctgagtccaccccacctgctgcctcacatgagccccctctgccccggtgaggtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctggtgagtgggtaacctcaaggacctgggtgaggaactctgcagtggaaaccctgagctgtagcccagagccatggggtcctcctgtcttgcctgagcctgcaggaagttcctggtggaggagggtcagtgactggccatgtgggtccacagctcctgcttatatcaaaaccaagagaggccacacagtccaggagagcaagtccctgttggggtaaatgcaggtgtaggcaagagccagggctagggaagcactagaatacagcctgaagatccaggaggacttcttggaggaggtggcggctgggctgcagataacttcgttaggcagagagaggaagggattcctagcagaggaacagctgggctaaggcccagtagagggcgctttgattcaccaagagggttacaagggatgagggtcgccttgagagaggcatggggaaggggatttgtggggcaggggcctggagcttggctgtggctttcttcaggtaatttttgtcactgtttcatggaggagggtgattagcgtgtcgacctttaccactgaggctggaaattggcatgccaataccctgtctggagctgactccaggagaattaagagcctccctccctccctctatccattcatcgtgaggagaagaggccaagcagcagggacaccggcaggaattctccagttagaaaaggccctctgagccaggtgcggtggctcacgtctgtaatcccagcactttgggaggccgaggcgggtggatcacctgaggtcaggagttcaagaccagcctggccaacatggtgaaaccctgtctctactaaaaatgcaaaattagtcaggcatggtgggttgtgcctgtaatcccagctacttgggaggctgtggcaggagaatcgctagaacctgtggggctgaggttgcagtgagccgagattgcaccactgcactccacagagtgagactccatctcaaaaaaaaaaagagagaaaaggccctctgaggccaagcttggtgtctcatgcctgtaatcccaacactttgggaggctgaggtagaagttgaggtcagggggtccaagacaagcctgggcaacatagtgagtctacaaaaaaaatattgagaatctacataaatatagtgggggtgggggtggggaacaagaaaacaaaaaattcaaagcatagtgaaaagaaatatagcaaaacccggccgggcatggtgcctcacgcctgtaatctcagcactttgagaggccgaggcgtgtggatcacggggtcaggagatcgagaccatcctggctaacacagtgaaacctgtctctactaaaaatacagaaaaattagccacatgtggtggcgggtgcctgcagtcccagctacttgggaggctgaggcaggagaatggcgtgaacctgggaggcggagcttgcagtgagccgatatcgcgccactgcactccagcctgggcgatagagcgagactccgtctcacaaaaaaaaaaaaaaaaagaaagaaagaaatatagcaaaacacaacaaaaaaattaaaatttgctgggtgtagttgtgcctttagtctcagctactggggagggtctgctggaggatcacttgagcccaggggttcaaggctgtgattaagccactgcactccagcctgggtaacagagcaagatcgtatctctaaaaaaaaaaaagaaaaaagaaaacactctctggccacagatgagagaaggcagacaggaagccagtaagccaagcaggcagagggcaggtggccccagcccagctgtcgggtggtgagcagtgtcagggagacaggagtgccggagctggtgaggttcccaaggaggtgaggttgcctgtggccccctcccagggcacagtcccacccctccagtagtgcactctgtcctccctggtaggtacaggcttttccccaccaccatggtgcagccatgcctgcccccaacaccactggtgcagttccatcctccacgcagtggtgcagccccatcccagcacccattcgagctgctgtcccattgcagggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaaggtgagtggtcgcaccacagccgtgtggtaggacccatgacactgcctctctctccccacgccccacccctcctgcatctctgctcgccccccatgccacgtctttccatcactgagctcctgaggtgtgtccctgcgtcacagctcaccatgtcctgaaggaggcagtgcagagcaacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcgggagccctcaccttacttcactctcaccacagccttctgaagcagctgctgctattggttattaaacgctccttgaggtgggcaaagtggctcaggcaggtgttaaccctctgagcccctcagagcctctggggctcagcaacatgcacctggctctgatcaaccagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtaaggggcaggggctggctcactgtgggtgtggggcctgccgtagaggcatcaggtgggctccccagggtggctacagcctcacatatgctttatgaatccattcctgccacagaattcgattgcgggcctactgtgtgctcggatggactcgtgggtgacccccagtcttggcttctgccccacagaactgacagtgcggggaattagtggccaccctcctacctcaggtcctttgcacatgctgtggttcttgagtgctcagtgctgagatgaggaatgcatgggggcattgcagccctcgggcatggtgagatggatgggtgaaagggagagggccaggtgaacagagacctcggccacccactccctgtcactccaaactaatgcttcccagatgccaccctcagccctgcaccacctgacccactcacccagtagttgccccagctccatgctgggtccctataagaccctgtcatatcccttcccactgaggatcctcacatccctccttacctacttgggtccttggcattcctgggcggatctgcagacccccccacactgaccagtgacctcccaggaggggcgtcagctgcccgggtggtgtcttctctttccctgtgagcattctgcacctctgactcccgctgcagccagtgacctggtgtcttgtctctctgaggggacagagccactgcagcgtgtccctctgccctcctttttggctaaggccagctccttcatctactcactggctcggggtgctgttcctacaatgctcctgtctgcctctgatgatttatttctttatcacggattattcccgaaagaaaggcagctgttgttgctctagaaacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaaaaatgtaaaaaaaacccaaaactgcccaagcatcaatgttcccttttcctggattctgcagtgtggacatttctgccggatttcctaactctctccgtctccacccacatctattgggattcgtgtttttctgagggattccacagtaggttactgatgtcgcacctcagggtgtgtctcaaaagtgagacttgaacatagcacagcaggatgtcggggtgacacaacctgctgtcccttctctttacctacagtaggctcccttggctgttttgtttttgttgtgtttttgtttgtacacagagtctctgtcatccaggttggagtgcagtggtgtgatcttggctcactgcagcctcaacctccagggctcaagcaatcctcccacttcagccccctgagcagctgggaccagaggcacgtgccaccaaacctggataatttttgtattttttttagagacagggtcttgcccagactggtctcaaactcctgggatcaaactgtcttcccacctcagcctcccaaagcgctgggattacaggtgtgttttttctttgagacggagtctcgctctgttgcccaggctggagtgcagtggcgctatctcggctcactgcaagctccgcctcctgggttcacgccattctcctgcctcagcctcccgagtagctgggactacaggcgcccgacactgcgcccagctaattttttgtatttttagtagagacggggtttcaccgtgatcgcgatctcctgacctcgtgatccgcctgcctcggcctcccaaagtgctgggattacaggcatgaaccaccgtgcctggcctgttttgttgatttttaaagcccagggcagtagtcttggaaaatgtcccacatcgtggatttgcctttctgtttccttgagggcagattcagacagaacacctttccctgggattggtcaactaatccgtggggtgttgctgaaactttattttattttattttattttatttttgagacggagtctcgctctgtcccccaggctgtcccccaggctggagtgcagtggcaggatctccgctcactgcaagctccgcctcccaggttcacgccattctcctgcctcagccccccaagtagctgggactacaggtgcccaccaccgcgcccagctaattttttgtatttttagtagagacggggtttcactgtgttagccaggatggtctcgatctcctgacgtcatgatccgccctcccaaagtgctgggattacaggcctcggcctcccaaagtgctgggattacaggcgtgagccaccgcgcccggtgttgaaactctcttgaggcattttcttcggccttcgggtccatcctctctgtctcctctttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctctttgggtctgatgaagtatccaaaatcaagctcctgaccatccccaaaccggccccttctgccggcctcgctagtcggcaccatccttgattcttctctttctcccacccaggccatcatctcttgcctggttgatacccacagcctcccctttgggctttatccttatccccgtcatagctgccagagggaccctgtgaaaacactccccagcctcctcattcctctgccctaagcctgcatggcacagagaaaaagccagttgttatgggacctaggaggtcctgtgggatgggccccagcctgcatcttcatcctcttctccccaccctactccattcactctctgcctatcgctcaccagcctataccacctgcctcagggcctttgcactgaccatttaggccacattccaggctcttttcacacgttgcctcctctgagaagccctccctgaccactctgcccatacctcatgcctcttgattccccttacctggcctgtggtttcagcactttccctgggtgtgtttgtttttcttggcatgagggcaggacttaagtgtctgttccctgttgattccccagtgccaggcatgcagtgcaaattctagaaatattttttgcatgaaggaatgagtgattgaatgcggcaagggtctggaggctgaggaccaggcagacagacattcagagttgctggaacgcgacagagacagggagtcagactggtcatgcaaggtcttgggcctgcccttgggtcctggggagccacggaaggttgtgggtgccagagggttgcggtcagagtcacagtcaagggccttctgagacctgtgccccctccccaccctccctccccacctcctcaggccagctctggggtctcagcaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcgggtgctgtctgacctggctgggcggtagctttggctccaaggtctgctccccggtcagtgggatcctgttcaataatgaatggacgacttcagctctcccagcattcaccaatgagtttggggcacccccctcacctgccaatttcatccagccaggtatggggtggaggtccggggggtgggggactggggtggagaggggcgggtgtcctgggcaggcagctgacgggcatccctgtcttctcccatcggccgcagggaagcagccgctcttgtccatgtgcctgacgatcatggtgggccaggacggccaggtccggatggtggtgggagctgctgggggcacgcagatcaccacagacactgcactggtatgtgtcaccccttttctccctggccctgcccactctgcacagcccccaagccaccctgatcacactcccatgccccaggccatcatctacaacctctggttcggctatgacgtgaagagggccgtggaggagccccggctgcacaacaagcttctgcccaacgtcacgacagtggagagaaacattgaccaggtgggccaggggttggagaaactgagtcacggtgtggggtcccagggcatcctgggctggaggcctggatcatcacagagtggacaatggttggtgtcctctctctagtgcctgggccatctggagcccctgtgacatgagagccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccactctctgggcctcagtgtattgtgtgtgaaatggagccatctggctggggaggaacagagaggtgggattcggagatcttcacaatgcggacactggaactagcctcagcatcttcagcatggggagagcaaggcacatggctgggggccaggggaaggttcacaccaaaccctgccccttcccaccctgatccctcagactttggggccaggccctcccttactggggctgggcagtgacactacctaggatcagccaccagggggtgtcacgaccctggcgctttcttaggcagagggtggccagccgatgctgggaacccgggcgccttctcagacccgtaggcgtccagctcaccctgccgatgacactggaggtgaagctgagggtccgaggaatggggactgggcaacaggctggaggaaaacatctcggtcagagccatgcccctggggggttcccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccggaaggaaacagctcgacacagcagccttcaccattggcagcccctccaggcctccctcggggcctgctccctcctctgtgcacagttccaacacctggagcagggttctgggaagggctggtggaggtgggctggtgggaggcggtgatcacagcccaacacctggagcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacagggttttatgcctgtggagtcaagtcccactgggtctgagctctggagggctgtgtctctggggctctgcaagggtgagatggaggtgggctcaactggtgtacaagtcactcttcaatccttattttatttatttaatttttttaaaaaaaatttaaaccaatagagatggggtctcactatgttgaccaggctggtcttaactcctgacttcaagcagtccccccatctcagtctcccaaagtgctaggattacaggggtagccactgcacccggcctcaatccttatattggcctgagaggaaaggccgtggccccatttgcaggggagaagactgaagctggaggggcaggccttgctctgggttgcacagcaggaagagaagtgggagctggccacgaggcttcctggacccgacacgctggtggggtacaccctggttctctaggtcccatggggctcagcccaggactacctcggggggtgagggacttaaatcgtctccttcattctcatcaccccttcccccatcatttcctgaggaaggacattcagggacctgaaggggtggcctgcccctccacacctgtgggtgtttcccatcagctgggacaagagactgagaaaagaaagagacacagagacaaagtatagagaaagaaaagtgggcccaggggacctgcgctcagcatacggaggccccacgctggcaccagtctctgagttccctagtatttattgatcattatctctaccatctcagagagggggatgtggcaggacaatagggtaatagtggggagagggtcagcaggaaaacacgtgaacaaatgtctctgtgtcataaacaaggttaagaaaaaggtgctatgctttgatgtgcatatacataaacatctcaatgcattaaagagcagtattgccaccagcatgtcccatctccagccctaaggcagttttctcctatctcagcagatggaatatacaatcaacactgagacattcctttgcccagggacgatcaggagagagatgccttcctcttatctcaactgcaaagaggccttcctcttttactaatcctcctcagcacagaccctttacaggtgtcgggctgggggacggtcaggtctttcccttcccacgaggccatatttcagactgtcacctggggagaaaccttggacgatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctccggtggtccctgcaccctggcctctgcctgacgaggatggtggggagaggaggggggacgtcccccacactgctgtctccactgttcctgctgcccaggcctctgggcttccaggactgcagcgggtgggtgggtgggctggcctgagcccaggaatgcacttcagttcctggttgagcaatgtcactgaggcttgggagtcgggtgggggcgggaggaggcgtccgcaggcccccctaccgtgagaggcagccgtgggaacagcctacctctaaacaatcactgcagcccaggctgaccaggggctctggccggacataggggcctggcaggctgtgtgccctgtaaggacacagtctgtctctgtgcctcagtttctctgctgcccagatggaggggcccagactccaggtgtacacatctggagcaggcagtgttcagttggggaggaagcggggaggactgtgggggccatgtgggaaggattccaccccacatcacctgcacccctgctgagcctggtcaacggagcccctcagtgggtcctcactcccctggttgcctcccatttaggcaccctgaggcctggggagaacagagccaggccagtgtccccagagaggctgcgctgccagcacagtagtagcggatttggattcagagaagcagacctgcagccagggtgggaaagagctgcaggtggggtggggcccccacatggcacagcccccctccctggaggtccatgctgcatttccaggacagcaagtcccagggatggatggtgcctggtgccaagggctagaggcatggtctgtctgcatttcccatgtaagtgtctcatagtcaccagcatttgatgctgtcaagaccccctgtcctctgtgcagactgggaagcccttggtcaccctgggggggttgggggacccaggccaggctgcagaaacataaggacttgaacccgggtcctgagtgacaccaccttgggtcctcctccttctgcctctgttcagctccaccttgatgctgactaggctgggccatgcggagagggttaggggatagagatgggagctggggagcagggctccactctgggaggtgggcagccttgccggatccagggcagagttaagcggccccagctctgctttcccagagctgctgagaacctggggaatggtgtggaggttccagggagccctgcccctacctggcaaccgcagtgcagcacgcaccaagttctcctgcacattgcgacagtgtgaccatgggctctggcgggcagtaggtggggcctttggacctaccagcagtgagggagttaacacagcagctgacttctctaggcaaagaaaactcccctcagacgctttgctgcctggcctcctgccaggaacaagcaggagctgaaaactagaagttgaggcatgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccatctgcccaccggcctcccctctccttctgggccgcagagccatggcccaggactacggagccatgggtgacctggtcctgctggggctggggctggggctggcgctggctgtcattgtgctggctgtggtcctctctcgacaccaggccccatttgacccccggcctttgcccacgccgctgttgctgctgactccaaggtcttctcaaatattgtacggtgagtgagacgtgggaggaagctgggtggcctttggcagccagcccctcctggagaaggcgtgtgtgtgtgagcatgtgtgtgtgtgagagattatgtgtgagtgtgtgtgggtatatgtgtgagtgtgtttgtggggtgtgggtgtgtgtgaatgtgtgtgatcgtgtttgggtgtgtgtatgtgtgagtgtgggtgtgtgtgaatgtgtgtgattgtgtttgtgtatgtgtgtgtgggtgtgtgtgagtatatgtgagtgtgagtgtgtgggggtgtgggtgggtgtgaatgtgtgtgattgtgtttcgctgtgtgagggtgtgtgtgactgtgagtgtgtgagtgtgggtgtgtgggtgtgtgtaaatgtgtgagtgtgagtatgggggggtgggtatgtgtgaatgtgtgtgattgtgtgtgggtatatttgtgggggtgtgtgtgtgtgtgcacgtgtgtgtgtgtgcacgtgcactggcccaggaagcaggagccgtgtgtgtgggcttcagcacctgcagggcttgagcgcaaggagacagcctcagggcccttgcacagaacaggcggcagggtgtgcccgtggggcagatggggacttggggacaatggtggtgtgtgagtccatacctggctccaggattcaggaggcccatttgcatatcccaggtgggaacctgtctggccccgcctgaccctgctggccggcgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacacacaggatgccccttcttgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgttcattcattcaccttttcattcattccttcttccctccattcccccatctgtgcatccttccctgccctgattgctcatgccacccccccccagcccctcctgacctggtcctttggtttctcttcagggctttctgtctcctcccacagggctgagaatggcagctcagggacaagtaggggctggggactgcttagtctccccagtggctctcaggggatttgagggtttgacgccagctgccaccccaggctgtgcccctcctctgctcgggaggacatacagagatgcgacacccacttaaactcgaagttgcaaagatgcaaatgagactggggtctcaggcaccagagaccacccgtgggcacgtggcttttgggagtggggacctgctgccacagatctctgaagagtctggacctgctgggtctccccgagtgactgtctgggggtctccatagcatgccctgctgtgtgcgtgacggtcactggttgggtaggggtctctactctaaagctccctctgccggcatcccctccaactctcccttggtgaagagaggatgtggtttgccccagtgttttatcaaacaactctctccacttccagttttaagaagctgggagtggaagagagcctggggctggccccagctgctgctgtgaaacaggggtcactggacgctgggaccctggccgggctggctggaggcctcaggaagaggcctgctacagcgtcatcctggccaagattcctccctgcagaggaccctggccacgctgccacagggtctgctggggccaccagaagcccatgctcctgcctccatctctcccctctgtgctcacctctcaccaggaggccctcccagagttcagtgtcctgctttttttttttttttttgtgacggtgtctcactctgtcaccaggctggagtgcagtggcgcgatctcagcttactgcaacctctgcttcctcggttcaaatgattctcctgcctcagcctcctgagtagctgggactacaggtgccagccaccacgccccgctaatttctgtatttttagtagagacggggtttcaccgtgttggccaggatggtctctatctcttgattcacccgccttggccacccaaagtgctggcattacaggagtgagtcatggcacctggcctcatctcctactctttcagcaccaggttttattcttgggattctgctacagccggagcccctgggtgcgagttcctaaggtttctgtgagtgtggacccagcaccgtgcctagtagacatacaaaaggagcatggtgacagtgaggtctgtcatctccagcataatgactgttttgatccttgtaaaaaaggtgatttttggctgggtgtggtggctcacacctgtaatcccagcactttgggaggccgaggggggtggctcacttgaggtcaggagttggagaccagcctgggcaacatggtgaaaccatgtctctactaaaaatacaaaaattagctgggcatggtagcaggtgcctgtaatcccagatacttgggaggctgagacaggagaatcacttgaacccaggaggcaaaggtttcagtaagccaagattgcaccactgcactccagcctgggtgacagagcaagacttggtctcaaaaaaaaaaaaaagaaagaaagaaaagtttatatttttgttctaatggttatcttaatatcgtcattctataattatatgttttatataattataatagctatataagatataatacccctagtatgttgttttttggatattctacttgctcctgatggttaatttatgtgtcaacttggctaagctatggtgtcctgttgtttggtcaaatacttgtcaatatcttgctgggaggttatttcatagatgtgattaacactgacagtcaattgactttaagtaaaacagattacccaccataatatgggtgggccacctccaatcagttgaaggccttaagaacaaaaactgaggtttcccagagaagcaggaattctgcttcaagactgtaacacacaaaccctgcctgagtttctggcctgctgactgctctacagattttaggttccagacttcgagatcaactcttacctgaatttatagcctgctggcttgccctacagattttaaaacttgctagtccccacaatcatgtgagccaattcctaaataaatctctctctatgtataatctattggtttagtttctctgaaaaactttcacatccagtttcctggttgttaagaattaccgaaactagctagtaacttctttttttttttttttttttgagacagagttttgctcttgttgcccaggctggaatgcaatggcacaatctcagctcaccgcaacctccacttcctgggtccaagcaattctcctccctcagcctcctgagtagctgggattacaggcatgtgccaccatgcttggctaatttttgtatttttagtagagacagggcttctccatgttggtcaggctggtcttgaactcccaacctcaggtgatccgccgccttggcctcacaaagtgctggaattacaggcacgagccattgcgcctggctcctagtaaattcttcttttctgtgatgtgtctcttacctctaataatacttttcttcttaaagtctacttcattaaaaatagttatgctgggcatggtggctcatggctgtaatcttggcactttgctggaggtcgaggtgggtggatcactgaagcccaggagttcaagaccaacctgggcaacatggcgagaccctgcctctacaaaaaatacaaaaattagctgggtgtggctaatataattctaagttggcacacttgtagtcccagctacttgggatgctgaggtgggagaatcgcttgagcctagaagggagagattgctgtaagccaagatcacatcactgcactccagcctgggagacagagtgaggctctatctccaaaaaaaaaaaaaaaaaaaaaaaaaaagttatacagctttcttggttagtacatgcatgacatatttttcatgatcttccacctctctgtacccttatataaaaggcattagttgggttttactttattttcaattattttaatttttattgtccttttaaatgtaactaatgatttatttgggttgaaacccaccaccaatttgttttccatgcctattctatttcttcttatctcctctcacatcttgttttggatttattatttttattatttaatttcctccttctctattagtttcataactgtgcagtcttagagttattttaaaagatgactggattattttagagcttacaacatgcatccttcccttatcaaagtctaacatgagctagtactttttgttgtggttgagatagagagagtcttcctctgctgcccaggctggagtgcagtggagcaatcttggttcactgcaacctccacttcttgggttcaagcaattctcctgcctcagtcacctgagtagctgggaccacaggtgtgcaccactatgcccggccaatttttgtattctttttcagtagagacagggtttcaccatgttggccaggctggtcttgaactccggaccttaagagatctgcctacctcggcatcctaaagtgttgggattacaggcgtgagccaccgcgcccagcctatgagttagtacttctatcctcttcctagtcagtacaagaaccttggaacaggaactaaatttacccccagtgacttatatgctaatatttttgtgtattttaaatatgtgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttcagtgcaaatcccagatatataactgtaccaatacatatttcagtatgttttatttattttaaaccccacaagatatcattttctatactactgtaattttataccaataacattcatttagatttacccacacgtttaccctaccctccgggtcctgtttgaaaatcaagcccatgctcacaggccaattttttttcttttagagacagggtctcactttgtcacccaagctggagtgcagtggtgcgattatagctcaatgcagcctccaattcctggactcaagggaccctcctgcctcagcctgccaagtagcttggactatagctgtgtgttttcttattattttgtagacatggggtctggctatgttgtccaggctattctcaaaattcccggcctcgagcaatcctcctgcctcggcctctcaaaggttgggattacaggtgtgaggcaaggcacccagctcagccacagagccctgttgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcagaggctgagatcctgggatcttgtcccccagccgccctgcaagcttactccctttctgctggaagagatggggccggacctcgaccagcagccctggcctggacatgactgtgctcacccaggtattgaggccgagatgccccggcatcatatgtttttctctctttttttctttttttttgagacagtatctcactctgtcacccaagctggagtgcagtggcatgatattggctcactgcaacctctgcctcccgcttaaagtgattctcctgcctcagtcttccaagtagctgggcctacaggcttgtaccaccacacctgactaatttttgtatttttactagagacggggtttccccatgttggccaggctcgtgtcgaactcctgacctcaggtgatccacctgccttggcctcccaaagtgctaggattacaggcatgagccatggcgtcacttaaatgtagtgagaggccgggcaaggggctcatgcctgtaatcccagtgctttgagaggacgaggctgtcagatcacctaaggtcaggagttcgagaccagcctggccaacatggtgaaactgtgtctctacaaaaaaatagaaaaaaaaatccctgcgtggtggcaagtatctgtagtcccagttactcaggaggctgaggcatgagaattgcttaaacctcggaggcggaggctgcagtgagctgagatggcgccactgcactccagcctgggtgacagagcaagactttgtctctaaataattaaataaataaatatggccgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcgcttgaacctggaaggcagaggttgcaatgagccgagattgcaccgctgcactctagcctgggcgatggagcaagactccatctcaaataaataaattaataaatacagagcaagattccatctcaaataaataaataaatgtacacctgtaatcctagcactttgggaggctaagacaggtcgatcacctgaggtcaggagttcgagaccagcctgaccaatatggcaaaactccatctctactaaaaatacaaaaattagccgggcgttttgacgtgtgcctgtagtcccagctacttgggaggctgagacaagagaattgcttgaacccaagaggtggaggttgcagtgagccgagatctcggctgcacttcagcctgggtgacagagtgagactctgtctcaaaaggaataaataaaatacaaagtaaaaaaaaatgtagtaagattgcagagtcgtgccgcagaagcgtgctggtcctatccatgtagtgaaggctgatttcatacacaaatgtcagaagaacttttcttttctttttcttttcttttttttttttttgagacggagtctcgctctgtcacccaggctggagtgcagtggtgtgatctaggctcactgcaagctctgcctccctggtttatgccattctcctgcctcagcctcctcagtagctgggactacaggcgcctgccacctagcccagctaatttttttgtacttttagaggagatggggtttcaccgcgttagccaggatagtctcaatctcctgacctcgtgatccgcccgtctcggcctcccaaagtgctgggattacaggcatgagccaccacacccggccttcttatatgcttttattgcatttgagcgtacctcttttacagcgaagatcttttttttaaattttattttatttttagagatggagtcttgctttgttgcccaggctggagcactgtggtgtgatcatagctcactgcagccttgaactcccgggcacaggtgatcctcccacctcagcctcctgaatagctgggactacaggcatgcaccaccatgcctggcatattttaaagatgtttgtagagatgaggtctcgctatgttgccaggcttgtctcaaactactgggctcaagccatccatccatttcagcctcccaaagtgcttggattataggcatgagcactgcgcctggccatcacactgtttttttgtttgtttgtttgtttgttttgagatggagtcttgctctgtcgcccaggctggagtgcagtagtgggatctcacctcattgcaagctccgccttgtgggttcacgccattctcctgcctcagcctcctgagtagctgggattacaggcgcccgccaccacgcctggctaattttttgtatttttagtagagacgggatttcaccgtgttagccaggatggtctcgatctcctgaccgtgatctgcccgcctcggcctctcaaagtgctgggattacaggcatgagccaataaatatttttataatcattaactaccgaggagaagctggagagaaaaaaggtggatgaagttaaggcagagagactttgtaagtttcttagctgagcttttggagactgtatatcagagatcctatttgaggtgattttcggctacagagataggcctggtcatttgaaaaataacggattaggtgaagcttgcgtttgaaatcctccttctacttctcatctttctctcttgtttattctgaacatccatcttagacacccaatctttgtcactttgtggttgtcattgatttccctgttattgagattagaggttggcagactttctctgtaaagggctggagagaaagtacttcagactttgtggtctgtgcagtgtctgttgcaaccacttaactctgccctgtagagcaaaagcagccgtagacagtacatgggcagatgagcatggctggggtccagttacatttacttgcaaaaagagggttggagactgggtgcgatctcccacctttaatcccggcactttgggaggccgaggcaggaggatcacttcaagccaggagttcaagaccagcctgggcaacaaagcaagactccatctctacaaaaaaataaaaattattatagctaggcatggtggtacacacccgtagtcctagctactcaggaagctaaaactgaggcaggagggtcagttgagcccaggagcacgaggctgtggtgagctattattgtgccagtgcactccagcctggtgacagagcaagaaccgtctcatcaaaaaataaacaaaaggctgggcacggtggctcacgcctgtaatccctgcactttgggagactaaggtgggcagatcatgaggtcaggagattgagaccatcctggctaacacggtgaaaccctgtctctactaaaaatacaaaaagttagccgggcgtggtggtgggcgcctgtagtcccagccactcgggaggctgaggagggagaatcgtttgaacctgggaggcggaggttgcagtgagccaaggttgtgccactgcactctagcctgggctacagggcaagactccattaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccatgtgacaaacctgcacatgtgcccgctgaatctaaaataaaagttgaaagtagatttaaaaaaccccaagagggctgggtttggcttgtgtgtccatagcttgttaacctccgctttagatattaactaatagaaacatagtgcttatcttcccaggccacctattttgttcctctccaaggtgatggatagatgaaggcctaatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcactgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggattgtgctatagaaattcaaaggcaagggaagtcacttctgttgtggggccctgggaggagcctccaggctggaaagggttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggggcccttgaaggggcaaggaggcgaggagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctgggcgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaagttgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttgtgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatactgcaaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattctatcaaaacaccgctacatagaaaatccccatgcacatatttctcctaattgtggaaatattttacataaaagactctagacatgggatgaaattcccaggttattggaattttaaaatagataggtactcccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcataggaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgccatttttgtatttttctacaaggttaaagaaaactaagtcaacttatacaagtgaattttaaaagactttagggcaggcgtggtggctcacgcctgtaatcccagcactttaagaggccgaggggggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctctccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagcccactgggctccggctgtttccatcacatggagaatgactcagagcctggcctccagccaccctcctggcctttcttcttctcactctgccactggctcctcatggaccaccagcctgggtgtcctcagacataccacacacttcactgtgggagtcacgcagccctcaatgctccttctccagggagccacggggctttcctcctcaggaggactctgcaagcagctggatgaagggccctcccgtctctcatccttccttaatttttgtcacagttctccttccttccactcagtgcagtgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttatgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcatcaaaatcagcgtagaacggacataccttaaggtaataaaagctatctatgacaaacccacagccaacattttcctgaatgggggagagttgaaagcattccgcctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacatgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacccccgaatgcaccactcttccattatatccagtcaattgctggttaccttgggcctaccaactgggggagggcaggggctgctggccacctcctcatctacagtaagagtcaatgagcagttaaatggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtatgtaatgtcatccacggcccagtgcagaggaacacaggtgctgccgtcagactgccagggtccgatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttggaggaagtgcctgtgagagagttgtgtccctcagattctgttcaccacaggtgacactcaatgcaaccccaaacctcttctgcacaatcccaaggggtgctgactaatccaacccaaaggctgtgatgtttggcagaggcagaaaagaaaaggccaggtgttctgggaaagaccacctttaaataacacagcaccctcatagcccagagagacagttctaactattatgccaataaacccggaaaagaccaaatccgatatgacacatatttcctgtttcgttttgatttcatgccccctcccttaacctcccaagcagcatggataccccgaaggcccctgggaactctctccaattggatcttacgtggaaagcagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacatggttttatacttgcaaaatcatttgctctcaccagaccccaaatcctccttcccaaaaggagcccagaatcaggtttctgtaccctagagatggcgctttttcctcaggaagtgagttatttcagggtacgtatcattctccagtgtcaatggctcctgcaattatagaaaagaaaacattaggagggtgaaatgatgccatacacgtcacacagatctgatagtctctcgacaacttgagagagaaaataggaaggggtatagtgattgagtcaaaggtcgaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatcgataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattagctatgtcttgtaaagcatcctcattagcgatgtcatatacaacgtcctcattagcgatgtcgtatacagcgtcctcgttagcgatgtcttgtacggtgtccttataagcaatgtcgtctacagcgtcctcgttagcatgccttgtgggtgccattagcgatgtcatatacagcatcctcattggtgatgtcttatatggtgtcctcattagcgatgttgtgtacagcgtcctcgttagcaatggcttgtacagtgtcctcgttagcgatgccatatacagtgtcctcattagtgatggcttgtacactgtcctcattagtgatgtcgtgtacagcatcctcgttagcgtgccttgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttttatatatatactttaagttttagggtacatgtgcacattgtgcaggttagttacatatgtatacatgtgccgtgctggtgcgctgcacccactaactcatcatctagcattaggtatatctcccgatgctatccctccccccccaaccccacaacagtccccagagtgtgatattccccttcctgtgtccatgtgatctcattgttcaattcccatctatgagtgagaatatgcggtgtttggttttttgttcttgcgatagttactagcgatgtcttatacgctgtcctcattagcaatgtcgtgtacagcgtccacgttagcgtgccttgtcggtgccattagcaatgtcgtataaagcgccctcattggtgatgtcttgtacagtgccctcattagcgatgttgtgtacagtgtacttgttagcgacggcttgtagggtgtcctcgttagcgatgtcgtatacagctcgttggcgatgccgtgggcggcgtcctctttggcgatgccctgggcggcgtcctcgttggcgatgccctgggcggcgtcctcgttggcgatgccctgggcggcatcctccttgtcgatgccctggacggcgtcctcgctggcgatgccgtgggcggcgtcctcactggcgattccgtgggcggcgtcctcgttggcgatgccctgggcggcgtcctcgttggcgatgccgtgggcggcgtcctctttggcgatgccctgggcggcgccctcgttggcgatgccctgggcggcgtcctccttggcgatgccctgggcggcgtcctccttggcgatgccctgggcggcgtcctcgttggcgatgccctgggcggcgtcctcgttggcgatgccctgggcggcgtcctcgttggcgatgccgtggacggcgtactccttggcgatgccctggatggcgtcctcgttggcgatgccctgggcggcgtcctcgctggcgatgccgtgggcggcgtcctcgctggcgatgccgtgggcggcgtcctcgctggcgatgccgtgggcggcgtcctcgttggcgatgccgtgggcggcatcctcgttggcgatgcccttgtcggcggcctcgttagcgatgccctgggcggcgtcctctttggcgatgccctgggcggcgccctcgttggcgatgccctgggcggcgtcctccttggcgatgccctgggcggcgtcctcgttggcgatgccctgggcggcgtcctcgttggcgatgccctgggcggcgtcctcgttggcgatgccgtggacggcgtactccttggcgatgccctggatggtgtcctcgttggcgatgccctgggcggcgtcctcgctggcgatgccctgggcggcgtcctcgctggcgatgccgtgggcggcgtcctcgctggcgatgccgtgggcggcgtactcgttggcgatgccgtgggcggcatcctcgttggcgatgcccttgtcggcggcctcgttagcgatgtcgtgtacagtatcctcgttagcgatgtcgtgtgtggcgtcctcgttagtgatgtcgtgtacggtgtcctcatggggagctagaaaaacacagagttaaggtcagtgccctggtggtggagactgtgaatcacccaggggcttgcttggtgtgatgcatggaggtggctgatcacagcatgggtcaagctgatgctgggacatcctcccaggtggacctgcactagtgaagctaagggatgtggctcagaacactttctgcagtgggaatcagtttccaggttcaggtatgcattatctggtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgtgaaatctaacttagctgccagcataaagattctatctcatttacttggtctcgagaaaatctagcacatagtaagtagaccaaaatgtttattaaatgaaaacacagagcagagataggggggcggctaggcagactgggttgcacctgattacctggatgataataaactgcacaaaacctcggtcaaattaatattgaaactgccttttgcttgggctcgtttcccttgcggaagaaggatgaccaagaagatgaacaggaaagaaatgagaaacagaggcctttgcttagtagctaaaggccaccttctgtaacatgaaatagtctacaagtggccttgaactctgccgtgatttagtgacaggttccctcatgtcttctacccaggttgaagtccagcaaaattgcgactgtcctctttacaacttgcgagaccacactgcttctgcatttgcctgttgtatgtatgagatttacacttgttttaaagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaaaaaactctcataacacacatttatatatgtagcaaacctgcacatcctgcacatgtacccctgaactgaaaagttaaataaaaaaagggatctgtgagctgagccaaacacctggggatctttgtgcttttgacacactgatgactatgtcggtccgtggggagatgaggctataactgccctgggttgtgtgaccacggaggccactttatgatgatgggcagtgtctggggccttttgggctcgttgctttagggcttatacatgaatgctggactccgtgtgtggtggtgaacaccccatgactaagtgcatgtcagcgtcagcactggtccacactcctgggttcgtgttttcactgtttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggaggctcttcacattgaaaccaggcaaggatgccacacctttcttggcatccagattgttttcttggcaagtgattccagaatacttactagattcaagcctcagaggggccacctgcaccacctgcaatacagaaacaaagctttttcaggggtatctcatgttgtggattgtttgcacaaggctctgtttctctcaatgaatactgaaaacttgatcagaaagtgtagtcaacttcaaggcctccaaaacaagggtaggatacacactggaaaagacatcagcttctggatggtggatctctcaggtccacgtaggttggcaagtgcaaaatcctgaatccaaggagaagacattgcttccaaggacaaggaccccaaggatacagtccacaacctgaagccgtcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcgcgttgactggcctctctccatctcctctgtccttgtgaactagagactcctcagaggctaggaggacacagagcaacagttagtcatagatgcttttgttcatgagttattcagggagctctgcttaatgtggacaacaggacagtgtgtgtggatgtgtttcattaaaagcacagcttgagctcctgctagaaaatcttccctcgtggaaagacaggcaagaacgaggagctaaggagcaagaaatagagtccctggcattttgctgatggcaactgaagaaaatgggaatgagtcagtctacaaatggtactgaagcacatgctatagtttgatgagagtcccactgctcacactgtgaggtttgaaacccagctaaatggttttctaaacctgtaaaaacaatattagcttgcaggatttatgtcccaagactacttttacctctgaggatccacagtggctgtcactgcagttatgtgttttagcattttgcacttgaatacaagcaaagtttaatagatagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacacgggttgaatgctggtgtgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaacgaagtttgtgaatctaaagttctacacaaaggtggaaatatttgcaaatcatttctcttgtaagagactaaaatttagaatatattttaaatatatttaagatatattcaaaaatctacaacaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacggaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgaaagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatattgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtatttcctgtgaccacctcctttttcaactgaagactttgtacctgaaggggttcccaggtttttcacctcggcccttgtcaggactgatcctctcaactactgaccatttcacctccattcatgtccatgccacatcaggctgtgttgtctagatggaatgaatccaccccaaatgtccctttctggaggaagccaccattatgctgtacctccaagcataatggtacgtccacacacaccagggcacctcgctcatgcaaggtgcgtgtcctctaacaaagtttcacgctctaaacccagataacttttcaaacccaagttctgttgattcccctactttgagtgctccatagatgctcatttgtctactaaacactgccccaggcaattaaatattccaaagtgaccagcagaatttttatgttaattctgacattgcgttgttagtacaagtgttgttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttattttcatcatttcttacatattggggcctaccatacattgtacggtgaaattagtgctatgcatcatggtagaaatataaattggcaaaagtaatttagaaaatagttcccttgtttcttaaaaaaattaggctgggtgtggtggctcatgcctataatcccagcactttgggaggcagagataggtggatcacctgaggctgggagtttgagactagcctgaccaacacagcaaaatcctgtctctactgaaaatacaaaaattatccaggcatggtggcgtgtgccagttgtcccagctactcgggaggttgaggcatgagaattgcttaaacctgggaggtggaggttccagtgagccgagattgtgccactgcactccagcctgggtctcagaaaaaaaaaaatttttttgaccaaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaatttgggtgagggaaacatatttaaattagatcgtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagcattaattcaaatggttgtcacaggtcacttaaagttagatagctgtcctacaaatatagggtgaatgttattcatgaatttcctgaatctattgcaataatcacatttttttccattaaactcttgaggtagctaattttatttattgcattttcaatgttaatctactatttcatatattgagattaactcacattagtcagaatttacagtattttaaaatatcacagaatttaatttaccttatctggttttggtttcaagactatactagccatttcatttaattgtacatgtagggtattctaatttatggaaaactattacatcttccttgatttttttttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccgttgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctgatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacatacctgacaacaaaaattcaacaactgtaaaagagccacaaaatccccaaatatttgcaaattagcaatgcacttttaaataactcatgggttaaagaagaagtctcaatagaaaattaaaaatacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgaccgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcattgaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgtagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttattttgagatggagtttcactcttgtcacccaggctggagtgcaatggcatgatcttggctcactgcaacctctgcctcctgggttcaagcgattctcctgcctcagcctcctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacgcccggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagatgctggttaatgcattgacaatagatagggctgttgacatcttgctgacagaagaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggagaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaagccctacttcttagtatcacagtgcagggctaaaaaatcactaaatacaggaaaaccttagagaggactggtacttcagtaatgttctctaagtgtttactacatgccaggaggaataagctggacacttagcagtggcggaatatggagggggaacttgcatgactccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccagagacccaagagacccctcactgtctttctccagtcctcctagcccaaggtgtgtgggtggacaaaggtgatgctctggaggaaatgcctgagataaggacaggtccttaatgataaagaattctccttcctctttcagatccttgacctcccagtatgacagcttaaaggctgtcatctctgtggcctgcctcccctttcccttcaccctgccagctgcctctcagtgactgtctcctccagtgactacactgagggaccagggactgcttgcctcccgaggctgctcagaccttccgacaccacaaaatgattgtcaaaagatgggtctgcaaagagtaacttcccttccactgatcaaacctgaatatgcaagctactgtcaattaactggaaaagtggccgtttgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccaatctcattcactaacctcaccatagtcttatgggttcaatggacctgtccaatcctttgctctgttctctccatcaccttcctgtgtaattttcctccaccacgcacataatagaaacatggcacaggggagctaatcgcctcttttatcccccacttcaggctcacacgtaagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggatagcaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggtgtgggtaattccaggcatagagggtgctggaactcccttgcatggggaatagtgatctcttcactggctgataaatagaggttgtagttcaggccttcaacattagcaccgtatgagtaaacattttgactcttcactatgcagcaagtgaaccagggcacatttatttatgtggctgagtttctccatctggcatgtgggctcaataaacaagctcacaacatatgggcatgatgatgatgaggtgtgaactaatgtaagtaaagtatgtggtctgatttgttaaattaagaaaaatggcactgagagttgtgctgggtaaacacaacatttttttcctaggggaaacacacatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccagacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagactggaaataaggttcaagtcaaaagccccaactctagagtagagttcccttaggaaagcacaggagcttttcttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacatgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaatacatgctaggattcaaccacagcatcctgtcacttcttcagaccctttaaaagcccagcaggactgccactagcttcttgacatctaccaagtccctttcaacctccacagacccacatacactgctactgcatttatcatggagggtatagggttctgccttgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggacgatgggtcgggagaacaaagacacaatacatcaaaacagcattaacaagtaaacaggttttcaaagccctctacatgcaaatttacacaattatccttttaatttttatcttcatatatatgtacataatctacttgcttctgagtataaataaaactgtatgttcttagttaatagtctctataaattcactctatttatctttctgagttgaaatactgcatctcattggataacaaaaaaaaaatttgactaagattacactggaaaggtgagtaggttgggtgattgactgtgattgacaattccatgattctggataacttccaaagcataaaaataaatgtgtgttttctttcacacgtagacaatacacatacttattactttaaaaaattaatatgtgcatggaagtgacttactacaaatatattaaagtaaatacacatttcacaaaaaaagaagagaggaagggaaaaacatgttaaaaacaaagagaggtacattttattgtgtgaaaagcctccaacggatccatactactgtggctttgttccaaagttttggaaagtaatgatttcataggttcttaattgggttaaaaactgcattaaaatagactttgccatattctcccctggggaataacttaatctgtggggtgggggatgtaacgttgaaggatgcaggatgtaaaaggaaattatatatatatatataatttgggaatttgggaataaactgaataaactgaatcccaattcacactgggactacaccagctgccaccatgcctggctaaatttttgtatttgtagtagagacagggtttcactgtattggccaggatggtcttgatctcctcaccttgtgatcctcttgccttggcctcccaaagtgctgggattacaggcctgagtcaagatacatattttttaaatgaagaaaaatttcaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacttaggaccaagggcaggagatccctaatcccatcaccatggcgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcccacacattattatgctggcttcttaaaataagttatgagacgggaaatagggcacccacaaatatatatatatataattatatataatataatatatattatatatataatatatttaatatattatatatgtattttatatgtatatatatatataatttgggaatttgggaataaactgaatcccaattcacactgggactacaccagctgccaccatgcctggctaaatttttgtatttgtagtagagacagggtttcactgtattggccaggatggtcttgatctcctcaccttgtgatcctcttgccttggcctcccaaagtgctgggattacaggcctgagtcaagatacatattttttaaatgaagaaaaatttcaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacttaggaccaagggcaggagatccctaatcccatcaccatggtgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcctacacattattatgctggcttcttaaaataagttatgagatgggaaatagggaacccacaaatatatatatacataaaattatatataatataatatatattatatatataatatatttaatatattatagatatattttatatatatatatatatatatatatatatatatatatatatatatataatttgggaatttgggaataaactgaatcccaattcacactgggactacaacagctgccaccatgcctggctaattttttgtatttgtagtagagacagggtttcactgtattggccaggatggtcttcatctcctcaccttgtgatcctcttgccttggcctcccaaagtgctgggattacaggcctgagtcaagatacatattttttaaatgaagaaaaatttcaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaaaggttcaatctgctctgacctttgaaaaactcagcacagatagtggcacttaggaccaagggcagcagatccctaatcccatcaccatggtgatagggcataaacattccagggtgaaggcacaatccacactgtgaggtccaactgctgccatgcagacaggtgtgctttcagatgtacaggaaggtcatcgaaggctcagtgtttcgtttcaaaaactgaatcccaagtccacacattattatgctgtgcttcttaaaataagttatgagataggaaatagggcacccccaaatatatatatataattatatataatataatatatataatatataacatatatataatttccttttacatcctgcatcccttatatataatattatatttaatataatatacaatattatatttaatataatatataatattttatttaatataatatacaatattatatttaatataatatataatattttatttaatataatatataatattttatttaatataagatataatattatatttaatataatatataatattctgtataatatatattatacataatattatatataacataatatataatattatgtataatatatattattatacagaatattatatataatataatatatataattatatatgaaatataataatgtataattatatatgtaatataataaagtataatatataatatatattatatattatataaaatattgtataatgtaatatgtaatatatagtatatcataatataatatattttataataaaatatattatatattatatatgattatattatattatattatatattatataatatatgatatattatggtatattatatataatataatatataatataattatatataatataccataatatatatgaaatataatatataatatatatcataaattatatataatatataatatatatcataaattatatataatatataatatatatcataaattatatataatatattatatatatcataaattttatatataatataatataatataattatatataatataatatataatatatcagatatcagatataatatataatatatatcagattaaagatataatatataatatataatatatatcagatataatatataatacatatcatatattttacataatatatatcatttattatgtaatatatgtcttttattatagataatatttttcatttattatataatatatgatatatcatatatgatatatatcatctatatcatatatgatatatatcatctatatcatgtatgatttatcgtctatatcaggtatgatatatcatctatatcatatatacgatatatcatctatatcatatatacgatatatcatctatatcatatatacgatataccgtatatatcatatatagtatataatctatatcatttatattgtatgtaatctatatcatatatattgtgtataatctatatcatatattgtatataatctagcatatatattgtatctaatgtatcatatatattgtatataatctgtatcatatatattgtttataatctgtatcatatatattgtatataatctgtatcatatatattgtatataatctctatcatatatattgtatataatctctatcatatatattgtataaaatctatatcatatagtatataatatatatcatatattgtatataatatatatcatacatattgtatataatatacatcatacttattgtatataatatatatcatacatattgtgtataatatatatcatacatattgtgtataatatatatcatacatactgtgtataatatatatcatacatattgtgtataatatatatcatacatattgtgtataatatatatcatacatattatatatgatatatatcgtatatattatatacgatatatatcatatgtaatatatacgatatatatcatatatattatatatgatatatatcgtatattaagttaagtttggggatagcccagaattatatatggattttcaactgcataggagctggtcccctaacccttgcactgttcaaggatcaacagtatgtataatactatagattttattcatattttagagtgtagtactgctactcattaagaaaaattaactataaaacagcttcaggaaggtcttccacgagttcttccagaagaaagccttgttatcatagagaatgacagctgcatgtatgttattgccactgaagaccctgaagacctttcacttggacaagatttcgagatggaagacagtgatattgattatcctgacccttacagggctaagctagtgtgtgtgtttgtatcttagtttttaacaaaaatgtttaaaacataaaaaatcaaaataaatgaagcttatcaaataaggatataaagtatttctgtacagctgttcaatgtgtttttgttttaagatgtgttattatcaaagaatcaaaaaattaaaaaaattaaaagtttataaagttatgataagctaagatgaacttgttaaagaaagaaaaaatttaaatacatttagtgtagcctaagtgtacagtgcatataaagtctatagttatgtacagtaatatcctaggccttcgcattcactcaccaagtactcactgactcatcagagcatctgccagtcctgcaacctctgttcatgctaaatgtcctttactggtgtaccactctctttaaattttgtaatatatatatatatttttttctttgttttttttgagaaggagttttattttgttgcccaggctggagttcaatgatacgatcttggctcactgcaacctctgcctccggggttcaagtgattctcctgcctcagcctcacgagtagcagggattacagccccacgccagcacacccagctaattttgtatttttagtacagacggagtttctccatgttggtcaggctggtctcgaacttctgacctcaggtgatccgcccccctcggtctcccaatgtactgtgtttttactgtatcttttccatgtttagatattactactgtgatataactgcctacagcagtgggccccaaagttttgacaccagggactggttttgtgaaagataatttttccacggagtggggatggctttgggctgaaactcttccacctcagatcatcaggcattagttagattcttttttttcttttttttttcttttttagactgagtctcccactgttgccaggctggagtgcagtggcacaatctcggctcactgcaacctctgcctcccgggttcaagtgattctcctgtctcagtcccccgagtagctgggactacaggcatgcgccaccacacccagctaatttttgtatttttagtagagacggggtttccatgttggccaggattgtcttgaccttgtgatccacctgcctcgacctcccagagtgttgggattacaggcgtgagccacagcacccagcctagttagattctcataaggagaacataacctagatcccttgtatgggcagttcacaatagggtttgtgctcctgtgaaggtctaatgctgctgctgatctgacaggaggcggagctcaggcagtaatgctcggctggccagccactcatctcctgctttgtgcccagttcctaacaggacacgaaccggtgctggtccatggcttgggtgttgcggaccattggcctactgtattcagcacagtgacatgctgcacaggtgtgtagcccaggagcaataggctgtacgatatagcctaggtatgtagtaggctacgctgtctaggtttgtataaagtacactctttggtgtctgcacagccacaaaatcacctaatgatgcatttcttggaatatattaccattaaatgagatttacctgtattagtgtcatctcaggtttattgtctagtaattttaaaagtatttgtatattctttcccagacacatcatcatactctggtgcatatctctattttattccctagacccactcttaatttttctgcattctgctttgttccttaggaggctcacctgaattggatacttcagagatctcccttaccctcatgcttttattggggttcagctaatggagggggtggcagaagataggtgagagaagagtgtgtttatcccccacctctgcccctgcagggtcagcacaggcagactgtgtccctttgctgaagatcacagcttctgtctggtgccttcttggcaagctggcactgtctctagtcaggtgactgcttggccccttactacttacactcttctgtctggtttctttgtgactttcctgctgtgctgtaagtagtccctttattagaatccatccacattacccagttatataaagacaaatagttggtcactgatgtagttcactccctgagaatcagccttcatcaaagatccctaacagtcagatattctgttggccgctccattcctgctccccattattctagttgtgtcttccttgtctctagtgcagtcacaaagcataagcgcctccactgtcacttgttctttgcaactctaggatcacatcattccccttgaaatcagagaatctgcaatctccccaagcccacaaaattcagccgtcacagtacttttcaagcatgccagcagccctccccaacaaacgaatccttaatttcttacagaaacatcttctgggcttcctgtgggacacagcgcgggtcggcttggcatgtggatcacacctgatatttttacccccacctcctactattcctattcctttgtatgcacctctctttattatgctaggaaagctctggcaacacaacctcaaaataagcaggccagtgtggattcacagtttctgtcagacaaacaaacttgagcaccacttctaacttcttgggctaagactttaacttcagaatctctaggtatctatgttgataaacttagcctatgtcaagattatattctgcatgccttagtcaaacaccatgtaaatctatgcctcatatattctctaggctttagctgatagggattagcaaagtagtgtggttgttttggtctttaaacaatgtccattttctaccagctttccattgcactctttttttttttttttttttttgagatggagtcttgctctgtcgcccaggctggagtgcagtggcgcgatctcggctcactgcaagctctgcctcccgggttcacgccattctcctgcctcagcctcccgagtagctgggactacaggcgtgtgccgccacacatggctaattttttgtatttttagtagagatggggtctcactgtgttagccaagatggtctcgatctcctgacctcgtgatcggcccatcttggcctcccaaagtattgggattacaggcgtgagccaccacaccgggccgactccattgcactcttacagaccatgttgacaaaattataactgcaacagtcaactacaatagcaattttacctctcatgtaccactttaaaaaacacatcattcccaataaccacatttgatgatttaagtaatcatgataccaccgtacactacagatgatcaggtttctgtctcctcccgacaacaaggtcaggaattcattcagactgaaacaggtcagcaaaccacttccagattctcatctataaagatctatttctagaaccatttctagtacctatacaatattagaatcaagtcaggaagcagaaaacattctagatattttaaacagaaaacaattcatggagagatcaattacaagagtatgtgtagcaaaagatgaaagggtcaggttgtttaagtaacttgataaatctctgcttcttttgtgttgggtgataaaaatgttgaccagagatcagtggcagatgatccaaggcgtcagctgtccaagctcagcatctggagccggtgctgaggaaatgtgcatttctaggtctgggcgccattggaccatcactactgtccttgaagctgccaccgtgagaactcacatctcagctgctatagccacagctgatattgtcattgcttccagaattatttcccttgctccatcgtggggatcccgcaatactgctgctgctgaaatcactgttgttgctccttccagaactgtcggcactgcagcattattatcactgcagctaccactggagatggctacagacaccagaaacggaagagcacctctcccctcctccggcagtgtgactttcagtcggctcctctagtagccagatggtatagaaatgacacaccaatgtccttcagaacatacatgcaaaatattttaaatatattagaaattctattccccttagaaaactaagtccacctacatatttttcaaaaatccatcagcaatacagaataaaggcattggttctatacagcgttgcaagaatattttaacaatagaaggtattttaatgtcattcaccacattaggagattgaaaaggggaaaacacaggattaccttagcagatgtaggaaaaaaataagatgataaaatacaacattcatttatattaaaatctttataccaaactaggaaacgcagacaaatttcttaacctgataagcttatctataacaaaaccatcgacaccaccatatgtaatgttgaagcataatcgttatttttataaaagctaggaaagggaatgagatgtctgttgacactgctcgtatttatcattgtcctggggtttctggccagttcagttaagataggacaaagaaatattatagaaagaggaagaaaaaaagaaagcacatacgttgtcattgtgtggagtttctgtttgtttgtttatgtgtttttgtgagatggtgtctcactctgtcgcccaggctggagtacagtggtgtgatcttggctcactgcaacctcattgtgtggagatttgtaattacccatagaaaatccaagaaaatttgtggatgcactaatcaaatcagcaaggttttcagatatgaaggcaaagtaaacagaaaatgaaattcttataaacagtagcaaccaattaaaaatattatattataatatcacattcatggtaacataaaacattaatgtatctaagaattaattcagaaaacaaatacatgatctttcatttaatttcattaaagttatttcaataaatataccaccagtatttttttagaacttgattggaaaagtcatattaaaataatcaatggaaagaaagaaccaaagttattttgaacaataatagcctatcaatatttaaatgtgttttaattataataattaaaatggtttgctttggctcagtgatacaccgttaaacaatgggaaaaaatggaagcaccaagaaatagatccatagatatgctgaatacattggacttgtaataaaagatatgatactaaaagtcagtagaaaaattatactattcaataaatgatgtcagaaaaaacatataaatttttatccatatagaaataaaaatctgtatattacagcatatcacaaaatcctgtatctatttaggttaaagactcaaatcttaaactacttgtgaaattacttatgaatattacatgtttaagatatttaaaagtatatacagagaactaatgacgttgggcaacaaatggcttattaatcaaatgccagaatgcatgaagaagaaaagaaaagaaaaataaattagactgtattaaaatgaaaaatcctaggcatcctaaataaaggttaaatgcaagccagaaaattgggtaaaatatttacaaaatatataattgaaaagtataatatccattatataaagaggatttctacaaattaatgatataaaataaataatatagtagaaaaaatgattaagaactactacacaatattcacaacagatgataaatagtgaattattgtgaaaagacaattgaaaagagcaaggtacaattcaacagcaataagactttatgcccttttctataaaaacacaaaactatgccaagggctttaggaaccgtgaatttatatacggtgaaggggagtttaaatctgccactttgaagagttttttggaaatatatagtaaagttgaaaatatatacatatgtgtatatatatatacccacacacatacacatacacactagaagttccacaaggtaaaccttctccaagagaatacacacacatttgcagaagagatgtccaaaggtgtttgttgaaacattattggtaatagctaaaaattggaaataatcttaaagctcattactaggaaaatggaaaagtgaatcgtggtatgtgcatataatgtaaaactatacatcagttaaaattaattatctgaatttatatggatcaatttttatatattgaaacatcgttgcattccaggaataaatcccacttggtcatggtgtataatccttttaatatgatgctgaattcagtatgatagtttttttttagacaaagttttgctcttgttgcctaggctgaagtacaatggcatgatctcggctcaccacaacctccacctcccgggttcaagcgattctcttgtctcagcctcccgagtagctgaggttacaggcatgcaccaccacacatggctaattttgtatttttagtagagacagagtttctctatgttggtcaggctggtcttgaactcctgacctcaggtgatccacccacctcagcctcccaaagtgctgggattacaggcatgagccaccgtgccccacccagtatactagcatttttagagtttttgcatcaatgatcagaggcatattgatctgttgttttattttcttacagtgtttttggctttggtatcagggtaatgctggcctcatagaaagagttaagaggtattcactcctcttccactctttggaaatgcttgaaaagaatcagtgttagttcttctttaaacgtttggcagaactcaccagtaaagctatcaggtccaggacttttctttgtcatgagattgtcttattactgactcaattcccttactaggttaggtctattctgactttctgtttctttataattgagtcttggtaggttttgtgtgtctaggaattcatctatttcatctgggttatccaatttatgagcacacaattatttatagtaatcttttataatcctttctaggctgggaatggtgggtcatgcctgtaatccaacaatttgggaggccgaggtgggaaaattccttgaggccaggagttcaagatcagcctggataacatggcaagatcctgtctcttaaaaaaaaaaaaaaaaagagctggcatagtggcgagcccaggaattcaaggctgcagtgagccgattgtgccactgattgtggttgcatctgattgttgccagggcaatggagctagaccttgtctctaagacatagacagacacttgtttctaaaacatagacaggcagatagacagacagacagacagacagaaatatataaagatattctcaaatacatttctgttttaagtaatttagattgtttcccttttccttagtcttgtcagttttattaatctttttgaagaaccaacttttggttttgttttttattgtttttctattctcttttccatttatctctgccctgatctctattgtttccttccttctgctaactttgggtttagttttattcttctttttctagtttcttaatgtgtaaacttatgttgttgaattgaggtgtttctttttttaatgtgtttatagctataaatttcctccttagcactcctttcaccacaactcataagttgtgtttttttgttgtttctttgttttttgagacagagtctcattctgtcacccaggctggagtgcagtggtgttagctcagtggtgcaacctctgcctcctgggttcaagaaattctcatgcctcagcctcctgggtagctgggactacaggcacataccaccactcccagctaatttttgtgtttttggtagagacagggtttcaccatgttggcctggctgatcttgaactcctgacctctagctatccacctccctcagtctcccaaagtgctgggattacaggtgtgagccaccacaactggccacagcccataagtttggatatagtgtgctttcattttcatttgtctttaagaattttataatttctttgtgatttctttgatccattggttgtttgagagtgtgttgtttaaattctactaatttgtgaactttttaaaatcttctgttattgatttctaactttatcctgttgtggtcagagaagacactttgtatgatgtctatcgttttaaatctactgagcttttttccttttttgggacagggtctcgttctgtcagtggtacaatggtacattttctttgtcatgaagtacaggctggagtacagtggtacaatctctgctcactgcagcttcaacctcctgggctcctaagcaattctcacgcttcagcctcccaagaagctgggatcacaggcacgcaccaccatgcccagctaatttttgtatttttagtagagatggggtttcaccgtgttggccaggctgatgtcaagctcctggcttcaagcaatccacccgcctcagcctcccaaattactctgggattacagatgtgagccactgcacccagcccctattgagaattaatttgtgatgtgttatgtggtctatcctgaaaatgtcccatgtatacttgagaagtatgtgtattatgttgttgggtagaatatcctgtgtatgtctgttaggtctagttgttttttcaggtgttgttcaagtgctgtatttccttacttatgtctggtctggttgttttattcatttgtgaaatgaagacaagggacaaaatcctaagacatcccccttaaaagggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcagccattcatggacaaaactgcctttgcaagagttttaatatccaggcaggaggtggcaaaactctagcaaagcccaaaaccaaggagagctgctttgagaaggcaggtccacacaccagtgacaggttcccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcgtgcctgcccaggaattcagtgatgcctttacatgcccttggtaacaggcctgctgatctcagtctcagctatggacactaaagtagccctgtgactccattccagtcttgctttgccacagtctgggcacagtccagcccatcctgggacctggtgaaagacataccatccattctcctaataagaggaccaccaatcttgaacccaaatgtggtcaccaaagctgtcctgtgacttggctctagccctgctctactgtggtctggaggcagtcctgtcttcccatggacctacctagtaagccagcaggagctcaatctgggacccacagggagctataccagtccatgcccttggtaataggcctgatatctgaagacttgactgtagaactagaagtggccccatgacctggctccagtcctgttcaatcagggtatcagaggcagtccagttctcctgaggatccagcagaaactgcatcaccaacctatgccttgatagcggcctgccaatcagagattcagctgcagaccaggcagcagccatgtgatatggctccaggcccacttgactgtgatccagtcaagggatccagcaggaaaaggtttgtacctgctgaaaccaatctataaagacagaaagagattgggcatggtggctcacacctgtaatcccagcactttgggaggccaaggcgggcaaaccacttgaggccaggagtttgagaccagcctggacaacatggtgaaactctgtctctacaaaaaatacaaaaaaattagccaggcgtggtggcacatgcctgtgatcccagctgcttgggaggctgaggcaggagaatcatttgaacctgggaggtggaggttacagtgagctgagatcacgccactgcactccagctgggtgacagagcaagactctgtctcaaaaaaaaaaaaaaagaagaagaggtatttgcttcttcatagacattaatgaaagtctgtagatcatgaagaatcagcaaatatgacactaccaaaataaactcataaatctccagtaatcaaccccccaaaaatagagatctacaaattgcctgacaattcaaaataattaagatagctcagtgaaatttactagaatgtatatatcaactcaataatatcaagaaaatagtagatgaacaaaactaaaagttcaataaagatacagaaataataagaaccaaacagaaattctagaactgaagaatacaatgaataaaatgaaaatgcaagctgggtgccgtggcggatgcctgtaatcccagcactttgggaggccgaggcaggcggatcacttgaggtcaagagttcaagaccagcctggccaacatgccaaaaccccatctgtattaaaaatacaaaaattagccaggcatggtggcatatgcctgtaatcctagctactagggaggctgaggcaggagaatcgcttgaaccgggaggtggaagttggagtgagccaagatggcaccactgcattcaagcctgggtgacacagactctgtctcaaaaatatataaaaataaataaatgaatgaaatgaaaatgcaatagagaatttcaattgcagacttgatcaaacagaagaaagaatctgtgaaattaaagacaggacatttgaaatatcccgtcagaagaccagaaagaaaaaaaagtttataaagtaaaaacctttgggatttataggacaccaccatgaagtgggtcaaacatattatggacttcctagaagtaaaaaagatagaaaaggcctgaaagtatatttgaagacataatgggtaaaaactttccaaattcttagaggcaagtgggcttccagacacatgaagttcagaggccccaaaaaaggccagcccaaagaccataataccaagatgtattataattaaaatatcaaaagtcaaagacagagactttcaaaagcagcaagaagaaaggaattcatcacatacaaggaaacttcaataaggctatcagtggatttctcagcagaaaccttataagccaggagagaataggatgctatattcaatgtattggaagaaaaaaactgccaatcaggaaggccacaacttgtaaagctgtccttcagaaatgaaaaagagatgataaggtctttcccagactcccaccaaaaaaattctaagggagttcatcaccactgcacctgccttataaggcagtttttcaagttgaaataaaaggattctgattagcaacattaaaacattaagatattaagttcacaggtaggccgggcgcagtggctcacgcctgtaatcccagcactttgggaggccaaggcgggtggatcacaaggtcagaagagggggatcatgctggctaacacggtgaaaccccgtctctactaaaaatacaaaaaattagccaggcgtggtggcgggtgcctgtagtcccagctactcgggaggcggaggcaggagaatgacttgaacccgggaggcagagcttgcagtgagccgagatcatggacactgccctccagcctgggcgacagagcgagactctgtcccaaaaaaaaaagttcacagggaaaggtaagtatatagtcacattcataacactgtaatattgcagtggtggtgtgtaaatcacttttcactgtagtataaaagttaaaatgtaaaagtattaggcggcccgggcgcggggcagctgctgcggggaggcggggaggcggggggcctggccggacacccctgcgccccctccccgcacccgggcggagggcggcctcttccccctccccctcccccaccacccccggcagccgcctcccccaggacgcaggaggcgggcggaggccgggtccgcgcagcgggcgacttgcggcatgggccgggtcgaggtgggggggcggtttcgggggctgggaagctggggtgccggggacaggagggtgggggagctggggaaaggagggctggggggccggggacaggagggccatgcaggcagtggcaagcgggcggcgagggctccgtggggcaggtggacggggatcagctcctggggctgctccgttccccaggcgggtgtcgtggctctggcctccatgcaactccaggtctgcgcgccccgcgctgctggagccccagtcaaaagtctatttaaaaagcagagagaggatgcttccctctgagtggagcgatgaagacctgatccctgggccatttgggaacactagctgcctttcatcacagtcaacctggactcagagaatgtcaagagcttgttggttgggtcaagaatgaatctaggcatgacgtcatagtttatagtcatccttttaaacctgcaaagaagcatttgcaggtttaaagttatttaaagttattgcaggttcttccctcagacgcagcacggttcctgagatgacgtcagcgctgctcgctgaaagcaccaggcaaggaggcaaaacaaaggaaatcctaaagagcaggcgagagaacagtggaactggcagagagaggcactggtgcggatggagagggcagcaataaaaactgggggacacttagaggcaaaggtatggcaggtgacaaaaaagatgagctgaagctcaggagagacccaggcagcgatgcccaaatgaccggctgaggaatcacctcactgctgctgatgcccttgacagcgatgtctgaggctggcgtgagtgctccatgctcagagatacctagaacccagctacaatggccttatcagactgaaacaagaacaccaagatattccaagggaggtgacaatggggtccaaaggttgtgcatttatggatcacaactatgtgctgagtgtggcccaaatcccagctccatatggtcacaccatgtctacagccaatcagctgactggggtggcaacccctggctctgctcaacaataatgacaaccatcatttactgagcacttactatgtgccagaccgatgctaagtgctttcctcagatgtttccatttaactcttagaatcaccctaatgagtatctcctattattttacagatgaggaaatgagagtttagaaaagtaacttgcaaaatcatactgctggctccataacaaatgttgattgaatgttgtctgggtggacagaggcaaggatgaccggaacgagacaaacaaacaaaaggctgactgacagaccattcgggtagcacttttcctgggattaagcttagaccttgtaggcctatcagccagaagcagtgtgtaaaataagagtggctgactgggcacggtggctcaagcctgtaatccaagcactttgggaggccaaggcgggaggatcacctgaggtcaggagttcaagaccagcctggccaacatgatgaaaccccgtctctctactacaaatacaaaaattagccgggtgtgatggcacacgcctgtaatcctagttactcgggaggctgaggcaggagaatcgcttgaacccgggaggcagaggttgcgataagctgagattgggccactgcactccagcctgggcgacagagcaagactccctctgaaaaaaaaaaaaaaaaaaaaaaaaagagtggctacccaagaacgcaacagcagcagcaaacactgatctgatgacaccccagttttgcagaagaggaaggaaaaataagaatgtcaactctccattcaacagagaaacagtgccaccactgtctttaaattttcaaacttatcgagaaaagctccagagaggccagtgccagcaatgccggctgtctcccaagtctgaagggttttcctctgggtattaggagttgaggtgtttggttagagaagaaacaggatgcacgggagatcacacacagagtaagaggtgcctctcaaatgcctttcccacgtttctaactctgctttttttaaagcacgatcagacccgccatctgcacttttacctgctgcctgacgaaaaccagatgccaaaggcctcccagcactcacggggccctttacccttaggaaaacaccgtgattcagccaggcgagattgatgcaacatcgtaacaaagcgtatgcaaagtgcctagctccggactgcttgcagaaaaggcacattttgactcttctgagagtgggaaagatttgaaagatgggatttgcaccttattcttattcaagtctggagatctggaacttcttcctgaagctccatgtttagccagataattgagacgctccacctggtcaccactggacatcagccacccaaacattctcctctgcaaggcacttggcattctggtgcctgtggagagagcagccttctcactagcacagctcatgaacaaggatccccttccctggacagccaagatgtaaacctgcccccagaaacactgagagtcctagaggtagaatgagttggccagcaagctccagcccattgaatgcagacccctgagcaaatcaagtcaggagaaggtggacaactgtaccctgaagaccacataccacccagacccaacacaaatagctgtcagcactgccacccattacagcttcagatctcgcttctaccagcatttcccagctgagcaacaaccgtcaaagtctggtcctggaaggacagccctccccgtcttggcagccacactttctggccctagcccaaggctgctgtggcatgggaggaatcaatggaggaatacatggctcttccctggttccttcctctcccacttcattgactaacactagtcacatggccccaactgaactgtgagggaggctggaaaatctggagtatgtgcatgcctagtgagttgcctctaccacatcctcttaacccttggcctctcattcccaaagtctagccctattttcaaatgaattcaacgcctcattacttagatctttcctcattacctcaaagccatagtggcaaaaagcaaacagcatcttcctaaaatcttcctcttccatcttcctctcctagatatccatcttacccttctttgccagttaatttattacaatcttcctttgacagcttcactccctccccgcactgctatcaactcaaatgtgagttatttcagtagcttgagcttgtcactggccttttacttttttccccttccaaagaacctggtacccagctacttaatccttatccttcttcccaaggcccactttcattcctttctcccccattcatgagcctgcagtacttttcccgctgcataagtcacgtgtcaccatataaactcacaatttgaggtgctctagaatctgtccacggaattagtcaggacataatctccctgtttttcggcagtgccacatccatacctgtcttcacaggtttgctcatgccaccattcctttccccagaacgcccttctgctcctcccacacaaatcctaatcctccctcaggacccatttaaaatacaatctcctcactcaactctttcctaccaacttgctttcccctctcctttctgccttaccacaaagctaagctctgtctctgaataatgtgctttttgatgataatctgaatggtacaagaagaaatcctatttcatgctcctttgagggagtgtctaatataggttgccttcgactataagtagtagaaaattcccactcaactggcttcaacagtgaggacaaaatgtatggagattggacggttcagtcttcaggggcttggccctcagggtttttcccatctcttcccgtctgctggcctcaacaaacctgctttcctcattgcaacaagatggctgcttcacgtccgagaatctagtgaaagaagctgtcccttctgcatttccttttacaaggaaaaacatctttcccagcatctcccagcagacttctcatacctcagtggccaaaaccatgtctaaactacgggcctccaggatgggctcagctcaatcagcacataccctagagctggaggcagggtcacctttccttgagtggcgtgtgggagaggtgtggcatccaacccaactgggtcctgccagcaggaagagaaaagaagagccactgtaggtaaccaatcacgtctaccacaggcagggaccaataccacatatctgtgtttcccctcacttgccacccccatcctgtgctggcagatgaggatgctcaacaaatagctgtggaactacaaattatcctgtgggtgtgagaaaagagtgtgcattataatagggtggtataattggacatgtgtgcacggaaaatggaaaaacagccatgaaatccaaacagatgcaaaaacgttcttaacacagaaggtttgggaagctctgatctaagccctagcctgggccctactcccagttccacagatagggagcaggccccaggccagagtgctgggcttctcccagcaggatccagctggggctttctcctcagttcaacccttgcctctgaggaccagtggtctacagtccagcccacaacccttcagacagaagttccaggcacaaaaaggaagctcacaataaggaacgcccatgcctagccataactgagcgcatcacagactcacacaaatctgtggaatgagtgcatgatctcatgagctctggtctggaaaagtaagtctccctacactaggacttaaagggaaggcttctttggctatgccaatatctttcctgccactttcttcttcaggccaaacagctcctatccctgccttccatcttagctttccagcatactcttcccaggttctttgggctactgacaagcactccagacccaaatacacatgctcccacctgaggctgggaaatgtaccaagaactgcatagaaaatatactggacaaaaggcactccagtctcacagatctccagtcccacagtctatatcaccagttttagctgtttgaagttttagaattccttttcaaaaccatagctagcatttctttggctagagaaaactgtgtgaaatgcagcctaccataggatcactgattacaacatgcattcaacattcaatacatattgactgagcaactattaggttgaactatgtgacattattgacattcgactgcttctgacctatcaaaatggcaataaagctcaacttaatatttactctatgccaggcagtaggctaaggaaggatttgggacaccatgacaaacaacacagaagtaacccctatcttaatggaacttaaaatctagttgattaaaccattacttacaaaagtacaatctaacttcaggattgtaattaattataaatgcatttatttgtttactgcctgacttctttgctagcctataaactacacaaagatgagggttatgtctcctccatttcacacactggcaaagcatatagcagaatacatcatatatttgttaaatgtattgattagtgttacaacagacaattgcatgtgctatggaagcgtttggcagagagatctaatctaatcttggaaggtgaggatcctggccatcactaacttggaatttctgatactgatgatataaggttgagttatgtcttcatgaaacaggtctctatacagcatataaacaactaccagcatgcacaggggttccgtagggactatttaaaatacttaagggaacaaacggttttcaagctcagtctagtatttcagaaattccatttacataaacaattggtgcactaattgcaaatcattcttatttctctcctaaagcaggatcccctaaggatctttattaggcattctattagcctagtttgagttacagtatttacttaaaagtaataacagtgaagttcttgaaaaatatttggtaattcagacattttactaattcaaactaatcttcctcattagtctacgttgttagaggtttaaccattgtattaagagaaagtatcaaaggcttcacttagagtaatagtcaccaaatttttttgcaagacaccttggtagcaggaacctgagctaacatcaggaggtaggtagaaatagaaaataaaggaatgacaatttgaagagcaactgcaatccaatttagtccaacagatgacacacatatgaagtcacattcaaattataagcagagcacaaaaatattttagatccttatcttttgattaacctggtatcattcagggaaaaatgtcagggaacaccactgaccagcagtcctctcttatctattttgcagatcttatctatttttctccctgagaaccagccctggacacaaactgcataaacatcaatgagcctagacagggtcttcatgtgtgtttggcctgccattgttctctgtaccagtacggagatttagtaacacactggtcacattcatggggcatcttgaactctcttgacatggtaaatgaacagcaggtcctgttcccatgccaaaagcaaacaaaaacctgtcaccagcaaggaagacacccagtctctccaaaggatgccaaagtccacatccagcctcctttgcagagcctcacaaatctctcggatgcaggcaggatgatcacgggctagggaagattatgctctgaatgtcttaagagattagttacttaaaatcctccacatgacttcagtcatccccgttgcagatcacagagtaaaaagcctacctgattaaagctgaatgcctatacatttgcaaaagggaaaatatgcagaagaaaacaagagtcagatactgatgggcatagcaccagctctaggacatcagaggtgttgaataaatgatgacaaggagacacacatagttctgatatattcaccataaataccacagtcctcaaggctctctcaattacttacttccccccaaatcagagactgaatctggccttatcttcaaatgaggcccagctctccccaaattccaaatatgggaaattacagctcctctgtggtagggggaagagtgggaaggcgaatgtttgtattgcataacgttttaattaaaacaaagatgacgtgcaccagagtctctttctcatctcctgttaggggcgttttccagtactacttccaccctttacccacccaggtcaccatggtctttttcttccctctaggacaattcacctttaaaataagaggattgggcaagaaatctacaaagatttttccaaaatgaactcaggcctagaggcatattagttctctatcttgttgctcccttctagaagtgcacagttcagagggatgcccagccacagaggtgccaaaacgcagagctggaaccaatcacctgctccaacagagagaaggtgaaagcactgggcagggtgctcagaatgtgctcttgcttctttgtaatgaaatatcagaagacagattgtaacattgttcagcaagctattttttgtactgaaacatcagaaggcattatgaaactgttcagcaaatcatctctaaacaatgtcataaagggttacctagtttggggtaagcccggaatgaatatctgcaccatcattcctcccgctaacaaacatgtccatctatgtgaagcataattcccaacacaccaccatctccaaaccaacaccaaaccactgccaaacaaagctgaagaggaaaaccagaaaggtctccgagaagtgctgcttgcagggagaagaatggccctgcacagaggctcctgagggcagcaggtgcctgctttggagccttggcaatttccaccaggcagaatttacaaccgtctgggacctgcagtctcagagggctcacggagaagggggaagctcttggctacccgggaggtcaccagtgactctgagcaaagtgcagatcaatgcctgcttagggttaaccccaggctgggagagggcatctggcaaggaacagacctggaagagcctgcccctctttgagctgctacagcagcttctgggaatttgtaagagccatactgatgagggtcccacaccctcccttgccagggcgccctcagggaggccacactgcaggaggcagagtatgaggtggggaagatggatcggccttatcctcaccaccccccatacgagtctcctctggtatggatggtgtctcctctctggtgggaagtatgtgatttctctatttctatttctcttttgttcgggcttcctagaaattcagagctaggtgtgaaattcccaattcccacagacaagcaacatccccagcagtaataaggacgttccacacacccaggacttgggatatttgtgtattttcaagaataaaagtttgccctttagcctcctcagagccccctcccttctcctcgctctccccttaccactgctattcatcatcttactcctacagataccccctcttcgtggtggcaccgggcactagtaactcatggctgtaaaggagagctgagaacaaaacaggaagaaaagaggttaagtaatggcaagaaaaaagatgtaccttaggaataaaaaagagttcccgaatgtcacagtgtatttaattaatgcttctatttattaaagattaaaaatacatatcaggtgacgacttaaaatgttagtcatgattttaactgtgaattctgtggcaccggagataacagaacaatgagtgcttgtagaaggcactcggttatttgttgaatgaacttcttgggaaagccttcttaggaaagtattagaagtagattctgctaaaacaggggctaccctcagaggtctcaggacaagggatagaaagtcaaacactgatgtttaagaagggataactatgacacatgaatcccacagccatctctccagaagagcaactattttgactgcgcatgcgggaagatggcgggccgggcgacttgagatccgcgggtctccctgctccttttccgtctgcgtcgggagctcccgggcacgtgaggccgtgccgcgtttactggcgggagggacggcctagccgggcgacgcctcggaggaggccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggagattacccagtctcctcctgcacccgacggaggagaccccatcaacgtggagggcctgctgccatcaaaaataaggattaatttagaagataatgtacaatatgtgtccatgagaaatctgctcccgggggtattcttgacttaaacaaggttgcaacgaaactgggagtccgaaagcggagagtgtatgacatcaccgatgtcttagatggaatcgacctcgttgaaaagaaatccaagaaccatattagatggataggatctgatcttagcaattttggagcagttccccaacaaaagaagctacaggaggaacttgctgacttaccagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtggagcagggtcagaccagtaacaaaaggtctgaaggtgtcaggacctcttcatctgagagcactcatccagaaggccctgaggaagaagaaaatcctcagcaaagtgaagaattgcttgaagtaagcaactgatggcatttgagaatttatgtatcactgagttttttgggaatatcttcctggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaaaggacagttctttgtggactctacccttcccttcaaggagtatgtcatatgtcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcactctcgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagatcggtggcatgcccagtggctttgggggcaaggatagaaatgtcatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctatttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaaaaaaaaaacaaaaaaaagagcaactattttaaaaatcaggtctaaagatgagccatccaagaaactgctcttgctcccagaggttttaaagaaagtcattcccatgaacgtgagaagtaacccaacactttgaaatgataatctttttacagcaataactgttgctgcagggcttgagaaaaaaagttctcttcctttgggttaaagtcttaaatgctgagcccgtagccagcaaccttaaagactactcgggtccagttcattctatctggaggagtcacttgggaattgaaaacacaggaaaactttttttctggtccatgaacaaacaagaacgcttaactgaattagacacaaaactaagtatttatggttgtcatcttaacaggtttcaaacaggcttcattttaatttaacataatttcaaaattatagcaaaatagtcaataaaatacgaacgtgcttaatttgatgaatttatgtgttttttgaagaaaatatgcagaataaacaagtcaattattctcactaaatacattaagatttaagggtaatatttttattatgacttgctctcctgatatagcaaaatttattgttatatagttatggaaggaggctcactactccccaatgatttcacaaattacagcttcagccagctataaaataaccaaatcagttctgatatagccataaaattaagcctgaaaaaatagtgaagtaaatcatccctttaaaatcaagttgttgaacaatatgttctgcatgattccatttatgtcagaaaaaatatatttgtgtaagtatatacacagaaaagggtctggaagaatatataccaaactataaagaatctatatcaaagtcaataaggggcatagacaaggaggggaactttcacattttactttccacattcttttttttttttttttgacggagtctcactctcttgcccaggctggagtgcagtggcgcaatcttggctcactgcaagctccgcctcccgggttcacaccattctcctgcctcagcctcccgagtagctgggactacaggcacccgccaccacgcccagctaatttttttatatttggggtttcactgtgttagccaggatggtctcaatctcctgaccttgtgatctgcccacctcagcctcccaaagtgctgggattacaggcgtgactttctacattcttgtaacagaattatagtcaccgttacctccatcaaaaaattaaaattcaaaaattaggccaggcacggtggctcacgcctgtaatcccagcactttgggagtctggagcagcagatcacctgaggtcaggagttggagagcagcctgactggccaacatggtgaaaccccatctctactaaaaatacaaaaattagccgggcgtggtggagggcacctgtaatcccagctacttgggaggctaaggcaggagaatcacttaaacccgggaggcggaggttgcagtgagccaagattgtgccactgcactccagcctgggtaacagagcgagactccatctcaaaaatgaatgaatgaattaattaattaaagcaaacaaatataagctacctcctgaagtagaaaccagtatctcttcaccttacctttacataatactttaccctaatgcattttatctgctgttctaaatcatgacttacttcaaatcaaatcttaagtgaaaatcaagatttccttttgggggcattatacaaaaaagactgtaaaatttcattctccgaaagtctttttaaaaagggatagattgtatctggctgggatagggtaggtgtgatcggacccggaggaaatgacggctgctcaactgtgcatctcctttcctcaccctgctgaaaagtgccacctagcatggtcaatcaaggtcaccaatgcaaagcagtagtgggcaaacaccacccaggttatccaaagcagcacatggggttgggaaactgatgaccttggagatttcaaaatcacctaacaataaccccgccttccctaaccacagggctaagcaacctaatggatggaacatatgtgtgctttggtcatccgcaacccagaccactagactaattttgctttagaactggactatatcaagtgtgaacgatcatacttgttatcatgtgggaaaaaaggtttaattactccctaattgtctgggaaacaaaagatttcaaaatacggagctcctgggggaaggagagttaataaaatgggtccttgagaagtgaagtgggaagcctgcctcatgccatggcaccagcgatgccacaggtgtacccagtgccctgccgagagcagagacggtgttctcagagttgctatcaaaaaggaggcagcagactgcattctgaagcatcagacaatgggtcacatgcggaaacagaattaaatacacaaaaatagcaccaacttaaggcaagcctgggcaaactgcactacatcaaagaaagaacacacaactggtatcagatttttttttctgttttaataaagagaaggcctggacacctgaaagttgacgggaagcaggcatcactaatttctccgagttcacagttttgttagaatgtctttgctctgattatggttttatttatttatttttttgagatggagttttttttgttttgttttatttgcttttgttgccctggctggagtgcagtggtgcaatctcggctcaccgcaaactccgcctcccaggttcaagagattctcctgcctcagcctcccaagtagctaggattacaggcacccactaccacgtctggcttctttgtgtttttagtagagatggggtttcaccatgttggtcaggctggtcttgaactcttgacctcaagcgatccacccgcctcagccccccaaagtgctggaattacaggcatgagccaccacgcctggcctgattatgttttgatggatatacagaagctcttgctttggtacagaaacaggccccgctttgcttcgacctctgggccccccaccttcagaaatgtctggtgccattcctggctcctcctctcagtggtcttccaggatatccactcacagctttctgatgtcgcccacctgtctctagcccagatacccagtcctcatggcaagtgactgcagcaatttttacaaatctacgcccttagggttcccatcccaggacgttcaggtttctccacccctttagaagtgcccagaatatcccctaccccacaattccaacaggacgtcactctcctcttacttaagaaaaatgcctaaaattccagcccttccaaaaggcctttctagattgaccactcaggagttactctggcctccccttcactcctgctagactgaaaacaaggacagacttgcctggcctctctcccccagtagacacctacccccagtgaacacatcctgtcagtgtcctcccgtccatttgcaaattgattgactgtttcattgctggccttggatgacctctcctagagggcagggacggtggtgttcggcaaagccttggtcgtctggataatgggaaatggggtcttctggtgaatttaattacagggttaggtggaaactttgcttcaactctcattattagaaagtctattgtaaagctttttaaaatacaactgaccactttccagcgagggtagagttaatatgccttaatctttgatttaggatcttgcagtgccccaggctcaccattctcttctgctactataattatagatgcggaagacatacagactgggctgacgactgcttggaagctaatttctagaataaacccttgctaccacatcttgtgatttttgcccttctgaaggtggagttccaaaataaaaacaaaatcccgcttaactgagggttccagttgagggaggtctgctgccatggtctttgttaagtgcctgccaccatggcccacaattagtcagttaataaagggttcttgatgagagaatttggcaacatgtgattttccacaaatataagcttgattttgatgcaaccactcatttctttgaaaatcagggggcattcacacacaggtgttctagatttccttacagtaaaaccaaccctttacaaggaatagctgtgttcactttgaagcagtaaagaagcaggtgtccactcatggcaaatgaggaactcccctttttttttttttttttgagacggggtctcgctctttttgtgtgtgtgtgagatgggggccacccaggctagagtgcagtagtgcaattacagctcactgtagcctcaaccttctgggctcaaccagttcttcccacctcaacttctgaagcagctgagactacaggtgtgtaccaccatgcccaggtaatgcttttgatttttagtaagatgaggtctcgttatattgcccaggctggtctcaaactcctgagctcaagtgatcctcctgcctcagcctcccaaagtgctaggattatcggcatgagccactatgcccagccagaagctaaaaatattaatcaaggagtcataactaaggatgcactgcacacccgaagccagggaccacaagaggtcagcaactgggactgcttcctccagttcccaggctggggctcagcagcagtggcctgggctctggggacttactttaagccgaaatcccaaactcattatcattcaaaccaattttctgtgtccagcatcatcccacctaaactggtccttaaaaccactgacagtcatttctccaatctgtaaaaggcctgctgaggcctttgcattatcaggacttaactgggagtagaatgccctccccatccaaatcctgaccatttctgaacactcagcccatgtcctcttcctgagtgtcttccccaacaaccaccacctacactgaactttactttgatctctgcaggaaactgtagatagagatggggtctcactatgttgcctagctggtcttgaactgctgagctcaagtgatctccctgcttctgcctcccaaagtgctaggaggctagcagtgagccaccacacctggcctatgtatgcttttttttttcttttcttttttttttttttgagacagagtcttgctctgtggcccagtccgcagtgcagtggtgcaatctcggctcatggcaacctccaggttcaaggcattttcctgcctcagccttccaaggagctgggattacaggcacgcaccatcacgcccagctaattggccaggctggtctcaaactcctgacctcaggtgatccacccaccttggcctcccaaagtgctgggattacaggtgtaagccaccacacccggccacgtatgcattttaaaacgttatgctcagacggggtctataggtttcaccagactgccaaaaggatccatgacacaaaaaaagtactctcagttgcatccttcggaacctttcaacacatacacatatacctcactcatccttttgtgaagagtgtctattaatcactagattaagaggatttggataaaatttataaacgtacaaactttgctaccaaggactgacacatttacttttctagctcatcagtttatgtcctagaaaaattccagagccacattaaccagctgtttcctatttttcattttacgatggtgtttccactttcacctgcaaagtgactaatagtaatacctattacagtaatttaagtaacaccatttagagtaatttcatctttagtactgtatttatactactaagaaagccgccaacgattcaagctgcactcactggtgaaaccctatgctatatatgtaattaatttatttcctaaattcttacctccctccaccccctccattggaaaataaactctaagaatgcaaaagtttttgtgtgtttttcttcaacgcttagagcagtgcctggcacctaacagtcaatatctgctaactttgatgaatgaatggtatatttatattatgcaatattactatgcagccatgaaacacaatgagttagagtggtaccagctaatttaatggaatttccagaagtatgaaattaagaaaacaagaagaaaagtgtcaaaaatatcatcccacttttttttttcttccctgaaacggagtcgtgctctgacacccaggctacagtatagtgctgccatcatggctcactgcaacctcaaccttctgggctcagggaatccttctacctcagcctcccatgtagctgggactacaggtgtgtgccacaacgcccagctaatttattttaaattattttttgtagagacagggtctccctatgttgcccaggctggtctcaaactactaggctcaagtgatcctcccacctcagcttcccaaagtgttgggattacaggtgtgagccactgtgcccagcccaatcccactttttaaaaagtatacccccaaatccatacactggtgaggaagtggagaacgtggaatcctcacacacagaatgtaaaatggtacagctctggagaacattttagcagtttctcaaaatgtttaacgtagctactacacgacccagcaattcaactcccagatatacacctgagagaactgaaaggatatgtccacacaaaaatttgcagaggaacttgtacacacttgttcacagtagcattattcataatagcccaaagtggcaaaaacgcaaatgttcatcaactgatggacaaataaagcatgaacaactgatggacaaataaagtatatcattcagcatataagaaatgaagtgctaatacatgctacaacaggaatagaccttaataacattttgctaaatgaaaaaagccaaacaaaaggtcacatgttgtatgattccatttacataaaaatacctagactaggcaaatccatagagacacaaagatcagtgactgcccagagccagagggagtggtgaatgtgaaatggctactaatgagtacagacttctttttgaggtattgaacatgttatggaatcagatggtggtgatcaatgcataactttgtgaatataccaaaaaccacatgaaaggtacactttaaaagcctgaattttaaggtatgtgaattgtatctccataaacctgtgattttgttaatatacgcttatttgcaaatgaatacatggataatgaggaataatatgaaaggttaatgacaaccttggtgatagggtacaggagactgggagaggaagataagtgttgaggtagaagaagacaaaaaataaaaggctaaaacaataatccagggccagaggccatgagttgggagatggagcaagacgaagtgtacaaagaaatgagcataaatcataaaaatgagggaactagggttgaaaactccagcaagtagtttgtaatgggggagatgaagcaaacctaagtaactgcaatgattcaacggaatttgcagaaaatgcagaagggcgagaaaagcaatgaaaaaatggatcagaagatttaaaattggctctaccccaccaaagttttaaaaagcaagcaagaagaaaattcagttgctcctgggcaagaattcttgggcccagtggggtagaaccaaaccatgataaggagacaccagtgttttgtaagcaagagaatatattaaggagagaaaaggggcatttattgagagaaaaggtctcactgtgattgttctggaataaagtagccccatcggactgcctcaggaactcatggtggaagaggtgccactggaaaatggctaagtcgggatcttccccaagaacactagaagagacagaggaagaatagaagagacagaggaagaatagaagagctttaaattttagcagatatttctttttcttgtttaattaaaataaatcttattgacctaatatttttgagactgggctcttgcaatgctccccagactgaactcaaactcctaggctcaagagattcttccacttcagcctcctgaaaagctggcactacaggtgcacaccactgggcccagcataatggctatttcttgacaaatcttgacaatgccaccagtatgtttttctttagagacagagtctcgctttgtagcccaggctggagaacagtggtgtgatcctagctcactgcagcctcaaacacctggactcaggagatccccctgcctcagcctctcaggtagctgagactacaggtgcgcaccaccacacttggcgaattttattttatttttttttattatactttaagttctagggtacatacacctggctaattataaaatgtttatctgtacagacaggttctcgttatgttgcccaggctggtctcgaactctcggcctcaagcaatcctctcctcctcaccttccaaagccccgaaatatgcccacatccagcctgccaccagtttctttgcatacttctttcctaggcttgaccaagacctttactttcttctgtgtacagctcagcattgaaaaaaaacaaaaaagtttaggctgggcacaatgggtcacgcctgtaatcccaacacttagggtggccaaggtgggaggtttgcttgaacccaggagttccacaccagcctaggcaagatggcaagaccacatctctccaaaacaatttttgtaaaattagccaggtgtgctggtgcgggcctgcagtctcagctagtgagaagactaaggcaagaggaacccttgaacccaggagttcaaggctacggtgagctgtgatcacctctccagcctgggtgatagggtgagacccagtctctgaaaacaattaaaaataaaaaaagttgaataatgagtcttctttttagaggcaatgtatttttcctctttttgttttccttaggctatatgcacaatagacaaagttgaaatttaatcttaatctcgtaaacccttactgtccaaacacatcaaactcaaaaaaaaaaaagacaaaaacaaaaaaggtgaaaggtgtacaagagaaaaaagggaagtaatctgtgccaaatgtacattccttccacaatttgggacaaaaatgatgcctacctggtctctgggtgccaaaataagacattagagacactcccctccttcaagaaataaaattggaatcagacactaagatacaattaaacagactttgaaagttggtatgcactactgggaggtgtctcacagctggcagggtcaactgcaactagaagaaaagctcctaagggcagaaactaagtggctcacttcctctgtaacactgccgtgcccagcactgtaccagcaccccagcagagtcaacaactttccgtcaagccacacacttacggtctcatcgtccagtggaggccgcagatgagacatagtgtgccaaatcccaaatgcacagggtgccagacaagtctgcgggaggcaggaggactagggaagccttccaggcaaggtgatgcctgagctgagttgtttttcttttgagtttggaacattaatttaatcggaggaaaacaagggacatgaaaagggcaaggaaataagaaaatgagctgagttttgaaggcaatgatcagatgaagtgagagaagaatattccagcagagggagacaaggagactgcagagatttcaaggggccaagagctgttcggtgcagctcagtgaagcacctaaacagaggtgggggaaggagaacaggggtcaaagcccagtattgaagtgttctggataccaagctaaggagaccttattacgaaggtactggggctgctgaagggtttaaatgggagagtgattgtgaacagattaatagtttggaaagatacaggcagaagtaaacctctggatttaaccaaaaaataaaggacagaaccacaatgaagatgttggaaaagatcaggaaaaacactgttaaaagatattcactctcggggccgggcgctgtggctcacgccttaaatcccggcactttggtaggccgaggcgggctgatcacgaggtcaggagatcgagaccatcctggctaacacggtcaaaccccgtctctactaaaaatacaaaaaattagccgggtgtggtggcgggcgcctgtagtcccaactactccagaggctgaggcaggagaatggcgtgaacccggtaggcggagcttgcggtgagccgagatcaggccactggaatccagcctgggcgacagagggagactccatctcaaaaaaaaaaaaaaaaaaaaagagagagagagtctgactctgttgccaagactggagtgcagtggcgcgatctaggcacatcacaatcccttccccgcccccgggttcaagtgattctcctgtctcagccgccggagtagctgggactacaggcgcgtgccaccatgtctgattaaatctgtatttttactagagacggggtttcactctgttggccaggctggtctccaactcctgatctcgtgatccgcccgccccgacctcccaaagtgctgggatgcgtgagcctccacgcctggccactaatttttctttctttctttcgtgtgtgtgtgtgtgtgtgtgtgtgtgtgtgtgtgtgtgtgtgagacgaagtttcgctcttgttgcccaggttggagtgcaatggtgtgatctcagctcactgcaatccccgcctcaacaggagagcaggaatcttcagtgatccactggcggatctgcagccattgtgcgcgccaggtcttcccaagtcttttgtgcgcgcgcctctccttccagtacctatgccgccagcgtcccctagcctcccgccattgccagcaggtgctgagatcgcgccattgcactccagcctgggggacaagagcgaaactccatgtcaaaaaaaaaaaaaaaggatgaaaattttgggaaaatatggaagaaaccaaatggatttctagctcaactaaatcgtaattattcagtgtctagttttggcaagaaaccacatatttcatgtccacaatcagggacacagtcccagctctcaagtgtgggtctttcctaagcaaattgaagaacacaggcataaaagtacattaaatcaataaacctttttctctctgtctctctctctctctctctcttttttttttttgaggtggaggttcgcactgtcacccaggctggagtgcagtgctgagatctcgggtgactgcaagctccgcctcccgagttcacgccattctcctgcctcagcctccggagtagctgggactacaggcgcccgccaccacgcccggctaattttttgtagttttagtagagacggggtttcgctatgttggccaggctggtctccaactcgtgacatcgtgatccgcccgcctccgactcccaaagtgccacagcccaggccttttttttttaagacagagtctcggcccggcgcggtggctcacgcctttaatcccagcactttgggaggccgaggcgggctgatcacgaggtcaggaggtcgagaccatcctggctaacacggtcaaaccccgtctctactaaaaatgcaaaaaattagccgggtgtggtggcgggcgcctgtagtccgagctactcccgaggctgaggcaggagaatggcgtgaacccggtaggcggagcttgcggtgagccgagatcaggccactggaatccagcctgggcgacagagggagactccgtctcaaaaaaaaaaaaaaaaaaaaaaagagtctggctctgttgcccagggctggagtgcagtggcgcgatctcggcgcatcgcaatcccttcccagcccccgggttcaagtgattctcctgtctcagccgccggagtagctgggactacaggggcgtgccaccatgtctgactaaatttgtatttttactagagacggggtttcactatgttggccaggctggtctccaactcctgatctcgtgatccgtccgccccgacctcccaaagtgctaggattataggcataagccaccacgcccggcctcttttttttctttttcttttctttatctggagactgagttttgcacttgttgcccaggctggagtgcaatggtgcgatctcagctcactgcaatctccacctcagcaggagagcaggaatcttcagtgatccacgggcagatctgccaccattgtgggcacctgttcctcccgcgacctttgtgctcgcctctctccttccagtacctattgcatgaccccccacgtccgcctcccgccattgccagcaagtgcctcgcgcgggtacctggctgcgcttattaatccgttaagctcgctctgtcacgggcgccctgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagaccttgaccgggagaaggaggcggcattccagcgcatcaacagtgcactgcaagttgaggacaaggccatctcggactgcagaccctcacggccttcccacactttgtcctcacttgcaacaggggcttctggtctgcctcccgtttctaaagcacccagtatggatgcacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaccctcagttcctgaaacacagtgagtgaggacggacctcaggctgtctcttcaggtcacacccagtgtgaaaagatggcagatacagcaccagggcagacactcgcccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaggagtgcactgcaggttgaggacaaggccatttagtactgcagaccctcacggccttcccacactttgtcctcacttgcaacaggggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaacggcataaacccgggaggcagagcttgcagtgagctgagatcgcgccactgcactccagcctgggtgacagagcgagactccgtctcaaaaaaaaagaaaaagaaaaaaaagttattgtgacatttctgtatgaaatcagccttcactacatggataggaccagcacgcttccgtggcacgactctgcaatcatactacattttttttttgtattttttttattccttttgagacagagtctcactctgtcacccaggctgaagtacagccgagatcttggctcactgcaacctccacctcctgggttcaagcaattctcctgtctcagcctcccaagtagctgggactacaggcacacgtcaaaaggcctggctaatttttgtatttttagtagagatggagttttgccatattggtcaggctggtctcgaactcctgacctcaggtgatctacctgtcttagcctcccgaagtgctaggattacaggtgtatgtttatttatttatttaagatggaatcttgctctgtatttattaatttatttagttgagatggagtcttgctccatcacccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccgtcttggccaggctggtctcgggctcctgacctcatgaaccacctgcctcagcctcccaaagtgttgggattacaggcctaaggcaccatgctcagccatatttatttaattatttagagacaaagtcttgctctgtcacccaggctggagtgcagtggcgccatctcagcttactgcagcctccgtctctgaggtttaagcgattctcatgcctcagcctcctgagtaactgggactacaggtactcaccaccatgcagggatatttttttctattgttttatagagacacggtttcaccatattggccaggctggtctcgaactcctgaccttaggtgatctgacagcctcgtcctctcaaggcactgggattacaggcatgagccgccaagcccggcctctcactacatttaagtgacgccatggctcatgcctgtaatcctagcactttgggaggccaaggcaggtggatcacctgatgtcaggagttcgaaacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatctcaaaaaagaaagaaaaaaaaaaagaaaaacatatgatgctggagcatctcggcctcaatacctgcatgagcacagtcatgtccaggccagggctgctggtcgaggtccggccccatctcttccagcagaaagggagtaagcttgcagggaggctgggggacaagatcccaggatctcagcctccgctcatggatcagctctgagaccccgagtgagctgggggtgctctgtgtgcactggtttccccagctgtcaagtaaagggattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccaaggcaggaggattgctcgaggccgggaattttgagaatagcctggacaacatagccagaccccatgtctacaaaataataagaaaacacacagctatagtccaagctacttggcaggctgaggcaggaaggtcccttgtgtccaggaattggaggctgcattgagctataatcgcaccactgcactccagcttgggtgacaaagtgagaccctgtctctaaaagaaaaaaaaatcggcctgtgagcatgggcttgattttcaaacaggacccggagggtagggacagacagtgctgtcacccttaggtgctgaacactcagaaacgggccagcggcagcccttccctcacctgcagacaccagattgggcagaacagcacgtggcacttgcagctcttgcagtgagggcagaacccagtgtcaacccttctgcctgtggaaggggctgctgaggcctgcggagaggccagggtggaggctcgtccccttgtccagcccttggcgtggtctccaccaggtccccagcccaccagtgcagggcgcccctgagcctgctgctgccacgggccctgtctctacccaggacgtccccacaccctcgcagtgtcagggaaatgatcatggtggcggtgacactccgcaggcagggctgctgagagaagctgagaagggtcacaccgcaggcaggggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgaaggtaacctgtggcccagtgtatatggccgggtctcctcaagctgcattcattcaagtaggacccagggtgcatgcccatctccagcccagggcagctcccctgtaagctgggtgagctactgaagccaaggcgggaggcagctgacaacacccacagcccatgcggaggtggtggaaaggctggactcagcagcaacaccaaatcctggaccaggcagaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaaataacagcggtccctgccccaaccagactaccccactcagtggggttacggatgctgctccagcatcctaacactgcccagctggtgcctgcctgtgctcacccacaccccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaagtgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaaggctggatttggcttttctaagcaacacgtgttcctgcgcagggctgaatggttgctgagacagagatggaagccaggacaagggagcccaccgggcccagataggtacagagagcagaggctcctgttctgtcctcgccacccacgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgcgggctcagcaggagctgcccactgacacacaggggacacccactcctgccaccttgggagcggttgccagacagagccgtactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccacgttcatgggattatttcttgaaaatacttggcggcctccatgcttctgttttctttgagtcaggtagtcaggagggtttacaaacaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttggggaaaaaattagaaactatgtataaaacttacaaatattcaagtatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaagtgcgtagcctgggattccctccctgggggtcctgtcccccgacgtttcacgggccttctgagctgccttccaaggaggactaacacggcaacaaaagacccatttctgcacaaaaatccctctgggaagaaaaagaagaaagccaagaatggagtcaaaacgctacccagtgctgaccaagcctctcaaaccctgttctaagtggactgtggtttctaagtcagggaaatggaagaggccccacccacacagggacagggccatggcccccacaggatgaagcagcagcgtttattcaagatacaacagtgagggaatccagtcacgttcccttctccccagagagggcgcttcttgacaagtgattcagtagaaatcttttggactctataagttaagttcataaaaaccactgctttcaccctgtctcccagggccaggcctggactccgagatgaactggtttggggcgccctcgggtggccacataaaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcggaagggggcgcacagctgctggtgggaggtctttggggcccaagatcccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatatgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctaggcaccccctatcactcccatccatgcaaacctaggcaagtccctgtctctgaatctcagccaccaccacatacaatgcaagtcggaagatgggcaggactgggggtggggcaggcagaggccacctctgtcaggctggggttgcatgggctggaggctgtcttcccatacctgggacatgacctccaaggaccagctgtcagtcatggtgatgggctggctggggttggcagggagcttgctctccttctcggagggccggagcagcgtggggccaaacaccgtgccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttggtacttctgggtctcagtggcccaggacaaggggccagctctgggctgatggggaggtcttcctgatgtgcttgggagggaagggggggcggtccaaatgcactgctggccacggccaaagctctgagctctttgttaaggccacagtgcagagggaggagggtggcaaagaggagaggcaggggcgggggtggcagtggtgctagtccttagaagcagtgagttactgcagacaggggtcgggggaaaaggtccttggtgctgggggtctggtgggagcagaggggcaccccacggcctggagacctggagtcctgggcagccacaagagagctgggctacctttccaggtggtctagaaggaaaaggaaggtgagcaggttggcctccggcagggacgacagcaggttgagcatgcagctcttctttgcaactgggtctgaaagagctgcaggaggcagtgggtcactcccctgggttacgacaagccggagacctctcccgaggtggtcacatggagcgccagggacacgagtccttgcgcagtttaggcttgtcatcatcgtcacacccacagcgctggccgccagtgaggaccctgtgaggggcacctgtgtggggtgtgaaccacctgaacgccttttctctacctcgcaggggtcagcagcacccggcaaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgacatcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggagccctctggggatgggcaaggccttccaggataggctcagttttggtcccctgctttttgaggttgggttaaaattccgaccatggcagaggaagcacagctcgggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaagtacagcttcagcatgcctgcgatggcgttcacgtccatctcgctcatcatcactgacacgtccttgttatctggaaagagcacggaaatgcagcggcctccttgaagatcctgagtgagtcacccaccatccctgccttggctaaagcaccgtccctgccatgctgaccactgtgtgggtccctcctgggctttgagcagctcatctgactcctcccaagagctgtgcatggttctgtgtctgcagagttgataggggtgcgtgggcattcccattcctctcccctgcttggcctgatgtgatggccaggaggaggccagcatggcaggacacagcgcctgcgtggggattgggtggctctgccctgtacatagcaaccacccctgcaccagtgtcttctgatagcaggaaggccgtgggagaatctgattggtttcagtgtttgaaccggtgtcttcctttggacccaattggccattggtgcttacatcctcaccacaggccaggttcattctgggccctcagagggagctgaaactaccacagggccctcccagggatgctgggcattctaggggtcctggtcagggtgggtggtgtgtgctgcaaagaaggatctgcaggcacaaaatcctgttgctttgaagatgctgggaaggaccctctggggtctcagtgccctcccctggcatttgaggcaggtccgggtccttcaaagcctgtgagggttggtgagatggaggcggagaggctgcagccccggcctgcgctgaatttcatcagtgccctctgcccaccacatcctcatacagggcagtggacagaccgcactgagtcctgggcttccacctcctgtccaaccccaaggcaggaaggccaaggccccgcagaagcccctggtccactgcaccaagtggcacgagtgggtacgatggtgtaaaaactggcttctatagaagctgtttgtacaactcttgttttctcttttttaaaaataataaaacagtaaatgaagaaaagacacagagaaggatgtgacatgcctgggccatggagcactctgagatctcatcgtggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccacgcactgacgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgtgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgtatgaactgctctcaaaccaacaaataggcttctcttggcaactgactcgtgacaaagggttcaagattgtttgaaaaaaaaaaaaaagggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaaggaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcacgtggacagaaagagaaggaaagagggccctatatctggataacttggaaatgtgctccccctagcaagatatctaccaaaattaaaaccatatttgaggatgctggcactgcgagcaatatataaatgatgcatgtaacatcatttaatatgatcttatttttaaaaatgagtagagtggtgttttctagctgttagtgtttccaaatatcaatgtagaaattagccttctgcagctgcagaggcaattcagtttgcagcttgcttgcatgtggcctagagccacccagcctgatatgtactaattttttgtttaacttgccagagtagaaactcagtttctgggccaggcatagtggctcatgcctgtaatcccagaactttgggaggccaaggcaagcagatcacaaggtcgggagttcaagaccagcctggctgacatagtgaaaccctatctttgctaaaaatacaaaaattagcccggcatgctggcaggcacctgtagtcccagctacttgggaggctgaggcaggagaatcacttgaacctgggaggcagaggttgtggtgaactgagatcatgcccctgcactccagcctgggcaacagagtgagactccatctcaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctccttggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaacaaaaaacatgtaatttagaaagtaactgccaggaaaaaaaaaaaagagactgggccagtggcttactacacctgtaatcccagcacttggggaggctgaggcgggtgaatcacaaggtcaggagatcgagaccatcctggctaacacggtgaaaccccgtctctactaaaaatacaaaaaaaaaaaaaaaaattagccgggcgtggtggtgggcgcctgtggtcccagctactggggaggttgagacaggagaatggcgtgaaccccgggacgtggagcttgcagtgagccgagatcatgccactgcactccagcctgggcaacagagcgagactccatctcaaaataaataaataaataaaatataaggtctcaggaacgtaaagattgacatttactcccaaactattaatatatgtccacccacctttcttgtagcaaaatcttaacttgacgtttgtttcaatagttattaaatttaattataatgtcctagcccaaaatacagtagaggtaaacatccaaggtactggcttgaggccactggccctgtatctataaaggagagggagaccatcaggggagggagggtaagaaagggaggaagagggcagacaagttatcaaaaaacaacagtaggcagggcactatggctcatgcttgtaatcctagcattttgggaagccaaggtgggcaaattgcttgcactcaggagttcaagaccagcctggacaacatggcaaaaccccatctctacaaaaaatcggccaggcctggtggtgtatgcttgtaattccagctacttgggaggctgaggtaggaggatcacttgagcctggaaggcagaggttgcagtgagccgacatcatgccactgcacttcagcctgagtgacagagtaagaccctgtctcaaaaacaaacacatcagttattcatatttcagagtaaggacaaaacatttttaagtagctggcaaaggacatccctatatttcagagtaaaacaaataggcaatgcttatcatttgacatatttttaaacattgtatctgaaaagtgaacaaagaaatgaatgtgcttatgattaaattgactttgttactttgtaaacttgtagctttagacctgtctcttagcatcaccaagccttgatcttttcatctataaaatgggcatggtaatgccagccttgctatgtttataggtcacttaggaatgaggtatgtatggtgttgaccatggtttctggcaagtggcatatattcattataccatagctcttttcagaaagctaagtcaccacgtacatgtcaatgcaacctgctgaaaataggcatggaaaaactagaaaatctagaaaaattagaaaatcactgaagaggattttctttaaaaaaatacatactttagtgtttgagtcatgaagtccttgcccgtgcctatgtcctaagtggtattgcctgggttttcttctagggtttttatggttttaggtctaacatttaagtctttaatccatcttgaattaatttttgtataaggtgtaaggaagggatccagtttcagctttctaaatatggctagccagtttagttcatgtcctttgtagcgacagggatgaagctggaaaccatcattctgagcaaactatcgcaaggacagaaaaccaaacagcgcatgttctcactcataggtgggaattaaacaataagaacacgtggacacagggtggggaacatcacacaccggggcctgtcgtggggtggggggataggggagggatagcattagaataaatacctaatgtaaatgatgagttaatgggtgcagcaaaccaacacagcacatgtatacatatgtaacaaatctgcacgttgtgcacatgtaccctaggacttaaaaggataataatatatatatacatacacacatacactttatccatgcatctgttgatagacacttaggttgttccctatcttggctgttgtgaataatgtgccataaatatgggggtgcaggtacctctctgacatactgatttcaatttccttggatatagccagaagtaggattgctgggtcatgtggtaatttttttttttttttttttgagacaaagtcttgctctgttgcccaggctggagtgcagtggcatgatctcggctcactgcagcctccacctcacgggctcaagcagtcctcccacctcagcctcccgaagtgctgggattacagtgtgagccactgcacctgacctcatgtggtaattgtatttttagttatttgattaatttttgtgccgtttttcataatgcctgtactgatttacattcactccaacatgtactagggttccattttctccacatcctcttcaacacttgttacctttctttttttaatattaatcattctaacagatataaagtgatattgttgtggttttaatttgcatttccctaatgattagtgctgctgggcatttttttaaaagaaggaaattatgtcatttgcaacaaaatgaataaacctggagaacattacactaagtgaaagaagccagacaggatagataagtacatgatctcatgtatatgtggaatctaaaaaagccaaatttatagaaataacaggtagaaaaggggttatgagaggctggggtgtgttggggggtacagcagacagggagatgctgttcaaagggtacaaagttttcattaggaggaataaagttttgagatctattgcacagtatggtggctatagtaaataataatctatcatatatttcaaaattgctaagagtaaatttcaaatgtcccaccacaaaggtgagctggatgatggatatgttaattagctttatttaatcattccacattgtgtacacatatcaaaacatcacattgtactcaagacatctatacaattgacttgtcaaccaaaataataaaaataaactctataaaatgtaaaatagttttgttacacagtttagtgttctttaaaccatattggctgagcttcctctttgccttgcccctttctcaagtctgggtgctgaatggtaaatatagaatcagttaatgtttactgaggatctagtatgtgcctcacactgacctaaacattttataactaattttttcaataccctggtgaggtggtttttatgattatcccatttggcttgagctagatgatctcagagaggttaagaaatcttcaaatcttcacaaggctgcagaactactaaaaggcaaggcctgtataattacttgttgaaggaatgaatgatatgagactgtttattgttttaaattatggaacaatttatactttgtaaaatgcagaagttttaaatgttcacttctgtgagctttgacagttatagaccctcatgttactatcccagtcaaaatatagaacatttccagaaaatcctctcacatctctttccagtcagtaccttcatgggtcaaaaacaactaccttctgagctctgtcaccaaagataaatttttcttatggctgcatttcaaataaatggaatcacacatccacacttttcaatgtctggcttccttctctaaatacatttttctgttttgagattcacccatgctgttgtgcgattctatagttctcttttaatcactgaatatatactgttgtgtgatacaccatggtttatttatttattcactgtcaaaggacattggctcatttccaagtttgggttaacgtaaataagactgctatgttagattctagtacaagtctacgtaggtgtacgtgtgtatacatacacatacatacacatacatacacacatagacttgtactagaaaaaatgtactaaatgtactaaaaaatgtactaaaatgtacatttttatttttcttggatcaacagcttggagtaaaagtgctgagtcataggttaagtgtatatttaatattacaagaaattgctacaccatttccaaagtagttgttttacaattccaccagttttatgagagtgttggttaattcttattttcatcaacatttagtattatcagtcgttttgattttgccattacagtggctaaaatgtgaaatcaaatgaaattgtatcttgagattttaacttgcatcttcctgactgttagtgatgttgaccattgtttaatatacccactggctatttgtatgtcttgctttgcaaactgtctgttcaagtttttctactttttaattggcctgtttgcctctgtattgttaacttgtaaaagttctttatatgagatgaattatttgacaaatgcatgtattacatatatttccccaagtctgtggcttgcatattcatgtttatagtgtcttttgataacctttaattttcactgaagtttaacctataaatgtctttatgtagggttagagctttctgtgtccttacaagaaacttctacctgttccaaggttagaaagaagtacccatttgttttccgtatggagtgagaatgggatgcaaatatttatattttgttattcaagcagcatttggtacaaaaattcttcttccctctttgaattcccttgtcaacttctgagttcactttttcctcatgcacattattggtaagcattttgtgtaaaataaactgcctttatcagaagtgtacaattttttcagatatctttccataatcctctagatttgaaaggtgatttttggttttcttgctgacatgttataattatagctcccttctgctgccatgtgatttgcaatcctttttaatctttccatttaagacctttcttactcctatataaaaactataattgtggccaggcatggtggctcacacctgtaatcccagcactttgggaggccgaggtgggtggatcatctgaggtcaggagttcgagaccagcctgggcaacatggtgaaaccctgtctctactaaaaataccaaaataagctgggtgtggtgtgtgtgcctgtagtcccagctactcgggaggctgaggcaggagaatcgcttaaagccaggaggtggaggttgcagtgagtcaagatcgcgcccctgcactcaggcctgggtgacagagcaagattctgtctcaaaaaaaaaaaaaaaaaaaaatcctataattgctttagtcatgcatatattgaaacactgtgtacaataattaggcaattgaatttttgtatttttctaaaattcaaaaggagaaaagctaatctagtttgtaatgatatagattcactaagacacttgtttctgtctttaggatagagcattcatactaacagtgtgagtagtatggataaaccagcatatatattttttattatgttgaatttcaatatccagccgaattctgtctagttgcattacttacaacattgtgttacagtttgaaatcaagaagaaacttgtgaatgacttttctacaatttctctgtaaaacatagatttgtcagataacatagtaccttatgtggtaattaaagaaattgttacaatgagaacacatggacacagagaggggaacatcacacaccatggcatgtcagggggttgggggcaaggggagggagagcattagggcacatacctaatgcataccaggcttgaaacctagatgacgggttgatagatgcagcaaaccaccatggcacatgtatacctatgtaacaaacctgcacattctgcacatgtatcccaggacttaaagtaaaatttaaaaagaaattgttacataaatgttttagtggctttaatttttaattaaattgtgttaactttttaggacacgaaaaattaaaatatgaaaagtaaaattttactatatgcacagaaaaatctcatttacttctgtgaggcaggaagtcttatactctgagtggggaaatataaatggcacctaattcctgcatttgattattaccgttcttggctgttgccacaataggtttatctttttacacatcaaaaaaaggaaattatgaggaatcatatatctgaaagggagtgttatctgacaacagcagaaactaacgctacagagggacaaaacatacaagacccaatacccccaaaaaaactgggcaaaaaaacctgaataacagacatttctgaaaagaaggtatgatattgattaaaaggtaaaaaaggtgtttctcaacatcactggtcatcacaaaactgtaaataaagaccacactcagatactatctaacgctaagtaaaatgaataataccaaaacagaaataatttaaaaataaaagttcagggtgctgttagatatagagatcctcttatacactattgggagaaatttcaatgatgaaacgcactgagaaaaccacttggagcaccctcagaaattaaaaatgcaagaactgtttcatctagtaattctaaccgtggttgtgagcttaaagaaaatgagatcggtctgttgaagcaacagctgccttctgaggtttagtgacctactactcactaacaatgagtaaccaaggtatgaaatcaacctacctgtccaccaaccaatgaaaggatgaagggacttcagcatacagacatgatgaaatatgcctcatgcataaaaattcatgacaacatgtcatttgcaaaaacacagacgaacctggaagacattacattaaatgaaatcgactaggtagagaaaggcaaacactatgtgatctcacttatatggaatccaaaaaactttaccttcaagcagaaggtacagtagcggtttcctgaggagaggggaaggagggggataggagggggatgggagggatcggttatggaaacaaagttacagtgagtttggcgaaacacattttggttttctatgccacagctgggtaactctggttaacaaaatattgtatttttcaaaaaactagaagggagcaatttgaatgtactcacaacaaagaaataatacctcaatgagggaatagttatgataagtaccctgatttgatcattactcaaagtatacatgtatcaaaatgtccccaaagaaaaaaacatgtcccagcataacttctaattgtgtatgttattatacatggcaaaaatttaagaaatatgaatataaaatgctaatattcacatagaaccactaatggccctgaacctctaaggaatcctgagaaatacaaactaagttgggagactcacaattcctgatagcaaattacattgcaaagctgtaggtagccaatatatatggtcatgtgatgtgctactgtgctctccagcctgggtgagagaatgagactctgtctcaaaaaaaaaaaaagaaagggaatcatgtaagcgataactcaatcactggttgttatcaaacatatacacagaaaaaaaatacaatgtagcaaaatacatatccaaaccaatacaaagaacttgagtagacatctctgcaaagatgacacaaaattgaccaacatgtaagagaaacggtcctcaacgtctctcatcagaaaaaaaatgtacctcaaaaccacattcagatgccgtttcacttttattgaaataaatgttactaaaaagtttttttttaattttttgagacagggactcagactttgtcacccaggctgaagtgcagtgtcgtgatcccagctcactgcagctttgacctccctagctcaggtgatcatcccacttcagcctctcaagtatctgggactacaggtgcacaccaccatgcctcatcctcccaaagtgctgggattacaggcatgagccactgttcctggccacaaaattttaaaaagaatgctggtatggatttggagaaaagggaactcttataccctgttgatgggaagataaattagtacatattctatggtaaaaagttggaagttgccattttcaaaaaactgaaaatacaattaccagaaggtcaatgtgggcagattacttgagctcaggagttcgagaccagcctgggcaacatggcaaaaccctgtctctacaaaaaatttaaaaacttagccaggcatggtggtgtgtgcctgtggtctcagctaccatagactgaggtgggagggctgcttgggctgtggaggtagaggccacagtgagctgtgattgcaccactgcactccagcctgggtgacagaagaaaccccgtctcaaagaaaatgacagaaaatgcaaatactgtaagatctagcaatcccactactgggtataactccagagcaaatgaaatcggcaccagagatcagaaagacacaatggggacaggagagtttcttcatgaaatcattttgaggaaactgatatccatatgcaaaaaagaaaagaaaagaaataggacccttctgttacacgatacacaaaaatcaactcaaaatggattaaagatttcaacacaaaacctgaaaccacaaaacattattaaattcctgtaagaaaagatagggggagcttactttcaggacaacttgaatccatgctcatcagttggaaagagtttcaaaaagaaaaagaggaatacataaggggtaaaaacctcatggagaatggaatggtttgtgaatgatttttttaaattggggaccaaaatcacaagcaaggaaagcaagaacaaccatgtgaggctacaagaaactgaaaagcttctgtgccacaacggaaaaaatgagcccgaagtttggacgaaagttttgaggaatcatataactgctaaggggttcttaccgaaaatatacaacacattaacagtactaaatagcaatttaaaacaacaacaaaaaataatccaccccaaactgggcagaggcccagaacagacatttctgcaaagaggacaaaaaacccacaccgaggagtccctcgcccctggtcaggcggccacggtgggagggacacgagaggacacgcgctgcccaaaagtgaagaagagtgacccctgggtcctgatggcaggaacgaagatttaaaaatgcagcaaggcccaatgcaaatcctccctctgaggcttggacacgaggcagccagccagaactgggcctggccctgactccaacctgagcggggcttccctctctctccctctacacaggggaggttccctcagaaaaagtctttttctgttgttggtttggttttttttttttttttcagaactagaaatgtatttatttatttatttatttttaataaaaaccaagatttttttattattattatactttaaagttttagggtacatgtgcacaacatgcaggtttgttacatatgtatacatgtgccatgttggtgtgctgcacccatcaactcgtcatttagcatcaggtatatctcctaatgctatccctcccccctcccccccacccagaaaaagtcttaaacccctaaaaataccacagtctgctacacttgacaccctcaaaagccttcagagaatgaataccactgtaaaataaatactaaaacactacaagagaaagaggaaaaccagggagaacaggagaggaatgaacagaacataccagaaaactaaagcttctgtactcaccatgcaggaaaaatgccagggaaaagtgcatggcagcttcctcctcagcactcagggcccagacaggagcggttttctccccaggacacagctccaagtcgtccagaagcctccgtgatgcccctcctggcgggtcctgagggtatcagagctcctctcctcctcacggtggatgccgccactcactccatgcagcacctgcggggagaacactgcaagagcacgatgtggggcagaaaaggtggttggggcgccccctgatggtcacggtgcagagtgaagaatgatctcatcccatggtcagcatcggcccaggctgcggccccatcgcccaggaactcctcccgctcctgctcggcgtggggtgccacagccacctcctactcttctgctactgtcagtgctgcctgtcttcttggtgctccaacgctgacaatttggggagacataaacacttaggctatagcaaggaaaatccagaatggtggtggaagagaaggacttagcatcagtcacagtgtgagaccagcagcagcaacaggacctaggattcattccaatgagaatcacctggaaatctcccccaggaaaagagatcaaacagattcctggaggaaatgctcttggggtttctttaaagaagctagtgggactaagtaacacaagactggggcttttgtggaaagagtgatgtccactaataatgtcctcttaaggactgaacatctcttcccaaatagctgaatgtgatcggcagtaggcatcagctgagaccttttatgacggcccttgggtaaggaatcactcaagctccctcactcttccagggacacagttagcacggtgatgaagctccagcgctctcaccacctctagactctgaggggccatcccagctccagagctccccacagaagtggctctgtttgttgtaggtgcatcacaccgaggctggttctttaaattaaccctgggagtgtgatgaaaccagcagtaagtagaaaggacagaaacagggagttgctgctacaagacccgaaagtgcaggaggatgagggtgcactccttcacccccacagacacacactagaggacctcagtccccagcttcaagtgtctgtgagtgcctaggagagagtcatgcccacagacatcctgcattgtaggtcaacatcaagcccacccaatagctctggtgctcaattctcaagagataacaaacagccaaacaaaacttaaggctttgatgtttggtggtgacagaggcaggaaagagcaggtcacatggaaaagataatctttgagtagtaaagcaaggaaagatgagcacacacatgacacttaaaggccatagatgatggctcttttaattatgtcacttttttttttttttttttgagacagagtctcactctgtcgcccagtctggagtgtagtggcatgatctcagcaccgcaacctccgccctcccaggttcaagtgattctggtgcctcagcctcccaagtagctgggattacaggcgcccaccactacgcctggctaagttttgtatttttagtagagatggggtttcaccatgttggccaggctgagctcaaattcttgacctcaagtgattcacctgccttggcctcccaaagtgctgggattacaggcatgagtcaccacgcccagccaagatacccgatgtaaatcaaaattaaaagaatgcaaaaccataaagcacaaaatatatgcacatgttgaggttaaaggaactctcttctagatttcctgattctggttgctgaagtgcaacctttctcatccctttcctgtcctgacttttctggggctctaagcccatccttatctggccccctgggggagctaggtctgcatatgggatcttgagtaaagaaggaaatgagaaaaagcctcaggcaaaggaagagcatggacatgcaaaggccctggggagaaataagtatgacagagaaagggactggaagaagagtcttgaacatctgcaaagtgcagacacacattgggctagaaactgtgcttttactgagcaatttcacctaattttcacaaaacccaataacatgactacagatatgtttttttcttgaaacaggatctcactctgtcacccaggctggagtacagtggtgtgatcacagctcactgcagcctcaacttccctaggcccagatgatcctcccgcctcagccccctgagtagctggaactacagtcgtgcaccaccatgcctggctaatttttttttttttttgtagggatgggtttttgccatgcgactacaactattaatccacttctatggatgagcaaactaacatgtcgaaaggtgagatgccttgctgtggtcagcttaggctacactatgctatgataacagatgacctcaaaagtccatgtcttagagtaacaaccattccttcctctggaatgtgacacacacttgcagctcagctctggctctgaccctcatcacttcattccaggattaaggctaaagaagcaacccccttgtggaaacctgatggtcttggggcagcagtaaaaagggaaggtgaggcacaacccttggagaataataaataaagactatccatagtatcacaaaaagggagaccaaagggtgaccacagaagggcccttaatgggtctgcccagaattagcacataccacctccactcatatcccattggctgaaagtcacccagccaacctgacaccagtgggtaaagatacgaaatctcttatagacatgaccacatagggaagggccctcataaggtcatatataacatctcaaaaatagccagacaggaattcaaatcaaagtagtttttctcccccacacatacatcgtgagctccattccagcccctgggctatgcactttagaggactctgtttgctcaataacagcaaaactcagtccttccaaattaacccctgaaggaaggaaggaagctcgagcaaaggagaggcagctggactacaaagatatgatgcccttccaagatgcactgtccccttaaaatcttatgcatccttcaaaacccacctcaaaaggatgctgtctttccccagctgagcagacctctcactcctatatgcccacaagtgggcaccatacgttcctctctcaaagttcctgtccccgaccactgcacaataacctgtatacaggtctgtttctcctaccagactgtgaatatcatggagacataagaatggtgtctcattcagctctaaacacagtgcatagcttacttgagacatgcagtaaaagtctgatgaatgaataggttggtcagtggatatatatgggtggttggtggtggagagggtagaaatcaagtttggaattaaataagaattctagctttgccactccctggctgtgtgactctggattatttacttaacctctctgggcctttataaaataggaatataagtatgtctctcactgggttgttaggttagcagaatgcctgccacacagtaggcactcaggaaatggaagaatggatggatggatagatggatggatgcatggatggatgcatggaaggatgcatagatggtataatttgactttaaacagacttgaatttgaatctgaggtctatcattacaagatgtgtgactctaagaagtacttttgccaaatatcatctccttacctctcctgatccacactccatattcccccaacctggatctccctgggaagctggcttctactgactgcatcaataagctggctcccttactcagcttcatgttaagatcagccaaaggagagcaacaacagaagatgaaagtgagaaagtggccgggaacggtggctcacacctgtaatctttgggatctttgccatctctttgagaggctgaggcatacggatcatgaggtcaggagttcgagagcagcttggccaacatagtgaaacccctgtctctactaaaactacaaaaattagctgggtgtggtggcacacacctgtagtcccagctactcaggatgctgaggcaggagaatcgcttgaacccaggtggaggttacagtgagccgagacctcgccattgcactcaagcctgggtggcagagtgagactccatctcaaaaaagaaagtgagaaggccgggcgcagtggctcatgcctgtaatcccagcactttgggaggccgaggcgggtagattacctgaggtcaggagttcaagataagcttggccaacatggcaaaaccgtctctaccaaaaatacaaaacattagccaggcatggcggtgggcacctgtaatcccagcaacttgggaggctgaggcaggagaatcccttttaccaggaggtggaggttgcagtgagccaagatcacgccgttgcactccagcctgggcaacaagagcaaaactctgtctcaaaaaaaaaaaaagaaaaaaagaaagaaggagggaaagaaagaaaaaagaaaggaaactgaggtcaggctatttatttttctagctccctccttgccaagtaactatggactagctgtgtccttcaaccaaaggacccagcatcttcctggtggccctctccccacagccttctgtgtctctcagctcctcatctattcatgactagggcttgtaatcaagtcccgccactgctcttcccagggagctgcagtattcctggtggtttcctgcttcctgtctctgcattgcagaatactaaactggctgccaagattgttgctcccctggtgaacaccccctgcataatgccctccccttgaggatgggctggacttgcaaatatgatggcatttcacactgttattaggttgactttgagttaatcaaaaggaagattatcctgggtgggcctggcctaatcaggtgacccttagaagtcaaagagagttgaagagtgagagacagccacctgctggccttgaaggagcaaacatccatgctgtgaattgcctgtggactttgagtgtggtctctaaaagataaaagtggttcctggacaacaaccagcaaggaagtgggggcttcagtcctacaaccacaactaactgaattctgccaacaactggaaaaagtctgaaagagaaccctgagcctcagatgagatcacagcctcagcaacaccttgactttaaacttgtgacacactgaggagacaatcaggccatacctggcctgttaacttacagaactatgacctaatggaggggtgttgtttaaagtcactaagtttgtagttatttattatggagaaatagaaaaccaatatactgtcgggcgcagtggctcatgcctataatcccagcactttgggaggccgaggcaggcggatcacctgaggccaggagttcgagaccagcctggccaacatggtgaaaccccatctttactaaatcagccaggtgtggtggcaggcacctgtaatcccagctactcaggaggctgaggcaggaggatcgcttgaacctgggagctggagattgcagtgagccgagatcgagccacagcactccagcctgggcgacagggtgagactccgtctcaaaaaaaaaaaaaaaaaaagaaaagaaaaaaaaatcaatacactgtctgcacctctgtaaatggtacctgtattaaacttttcttaaatcagactaatacaactttgccatctaactgcttggctctgatgggtgcttcatttaacctctgcatgcctcagtttcctcaactgtaacgggagataatggtagcaaaactcttgttaggatgccttgtggccagcacggtggctcaccccgtaatcccaacactttgggaagccgaggtgggcggatcaccagtggtcaggagttcaagaccagcctggccgacatggtgaaacctcgtctctactaaaaacacaaaattagccagacgtggtggcgaacgcctgtaatctcagctgctcaggagactgaggcaggagaatcgcttgaaccagggaggcagtcgttgcagtgagccgagatcataccattgcactccagcctgggcaacaagagcgaaactctgtcacaaaaaaaaaaaaaaaaaaaaaagccttgcacttttaatttattatttattttatttatttatttatttatttatttatttatttattttgagactgagtcttgggctggagtgcaatggcacgatctcagctcactggaatctctgcctcccaagttcatgccattctactgcctcagcctcccaagtagctgggattacaggcgtgtgccaccacacccggctaatttttgtgtttttagtagagatggggtttcaccatgttggccaggatggtctcgatcttctgatctcatgagccgcctgcctcagcctcccaccttgcactttttaagggtccaccacataaagaatgagaaggatggagtcctcctgggggtcttgtggtcttgtcattctggctggaaaatcaaagccctgaatgtgggtggtcccacccctccctaactttcagatgcccagtgcctttgggatgaataccccacccttcatgctctgttttgactgaagattagggggatcttagtgcttctggggtgtaaaaagccattgtgaatggtttgtgcataacccagtttccaacagaagggcccattctatggagaagcccatttaaatggcctcagcactgctcccttcaatgcctggtggctgaaaggagaaggggagaaatgggaaactcctcttcttaaccaaatgtctcaggagggcttttacctggggaccaagtttgttaagaggttgatctcagagcagtggagaaacagctcagaggagaaggagctggactgctggcactcatcatccatgactgtcaaccaaaagtggctctgcagcctttcctactatgacatgctgctttaaatctctcttccaccctggtatcaaagtacttcattgaaccggggaggcagagggccacatcccctgttcagagattatcttaaaagactcatttactcagactctgcataagggatattgcaaataaaacagacactattcctgccttcaaggagagaacagccagtggatactacaaaatggtaggaaagacataaaaaaacctggatttatgatattagtatagaattattaagaggaaatcttggcaagctccctgagcagtagaccttgtaaaaacaggtgtacaaaatatatagagggagagatctgtgttcaagtaactttgataaactggttcagtgaaatgatgtgggtgtcattattacaggacttttcagtgcctttaatgtgacaatgtgccttgtgaatctctctaagtttggccagttgtcagaatccccctggaggcttctcaaaatgacaaatacaccacaggcctatggaatcagaatcctcagaagtcaggctcaggaaactgcagtgttaaaagacctgccaggatgatttctgatggtcagctaacttgacccggagattacaatttatgactatgggaatttcccaagcttctctgactcctgaatatatctgttggtacctgctgaaactcttcagcatgcgtcagtctggatactgttcctaattatatttatttatctgttgtcctccactcaccattaggaaatctgctgtgggaatctcagttcaatccagatgtgtacattaaaagagcccggtgcacccttcaccacaaccagcccagtgtgaggagacagatatccctgagtgctccaaagcagatcatgcacctcagtcccctgggatttttccattgcagagcctctgttggaagatctggttttgttctgggttttcccaaggatggaagggcatgcagagaacccactaaggagatgtctccagaggctggagctggggctgtctgggtgggtactgggagtcctaaagcaaccagaaggcagtgagtgagttctagaaagagaatggtcttaaaatgtgggggagacatggctgtctcaactcttggttctgtctgtactctacaagatttcaagaggctgactgccaacgtactagtcaccttcctcctagggtgctcactggctaccttattatctttcaacagcctcatgctgatagcacaccttttaagaggcaatatggggccgggtgcagtggctcatgcctgtaatcccagcactttgggggccaaggtgggtggatcacctgaggtcaggagtttgagaccagcctgaccaacatggtgaaaccccatctctatttaaaatagaaaattagcagagtgtggtggcccatgcctgtaatcccagctactcaggaggctgggtcaggagaatcacttgaacccgggaggcagaggttgcagtgagccaagattgtgccactccactccagcccgggcaacagtgcgagactctgtctcaaaaaaaaaagcaacaggaggtaactgacaatcatggaatttgttaaaataattaaatataatccccatttcttctctagacaagttattcaacatatctgagcctcagtttccttatctgtaagctaatagaataaaatctaccttctgccatggtaaacattaaataaatgacattccaaaatacctagcacatagtaagtcttcaacagatgtgagtgatttttttcttccttgtttctttcttgccccaaagaactttgcgtttgagagtcagcagaaagaggatagttcttcattggcctgcagtgtgacattggacttctctcaggctctaaattccttgggatacttttggctgaaagtaacagactcactcaaattgactcaagcagtgaaggggtggggggagatctgatgcagccaggttttgggaggggcctgtgaagagggccagcccctccacacctgtgggtatttctcgtcaggtgggacgagagactgagaaaagaaataagacagagagacaaagtatagagaaagaacagtgagcccaggggaccggtgctcagcatatggaggacccgcaccggccccggtctctgagttccctcagtatttattgattactgttttcactatctccgcaaggggaatgcggcaggtgaacagggtgatagtggggagaaggtcagcaggaaaacatgtgagcaaaggaatctgtgtcataaataagttcaagggaaggtattgtgcccggatgtgcacgtaggccagatttatgcttctctccacccaaacatctcagtgtagcaaagagtaacagagcagcattgccaccagcatatctcaactccaggcacagggtggttttctcctatcagaatagaacaaatgtactagtgggttttacaccgagacattccattcccagggatatgcaagagacagaggccttcctcttatctcaactgcaagaggccttcctcttttactaatcctcctcagcacagaccctttatggatgtagggctaggggacggtcaggtctttcccttcccacgaggccatatctcaggctgtctcagtggggggaaaccttggacaatacccaggctctcttgggcagaggtccctgtggctttccacagtgcattgtgcccctggttaatcgagaatggcgatgacttttaccaagcatactgcctgcaaacatattgttaaccaggcacatcctgcacagccctagatcccttaaagcttgattccatacagcacatatttgtgtgagcacagggttggggctaaagttacagattaacagtatctcaaggcaaaacaatttttcttagtacagatcaaaatggagtatcttatgtcttccttttctacatagacacagtaacagtctgatctctctttcttttccctacaggcctggaaacaggaactgagagatgccaggaaatctaagatgtattttttctgtgtccctcattcttttttctcctctatgagcaccacttctcttcgttaactagttccctgttcacaggaaaaataatggtgtcaacagctcctctaaatactcaagctgggtcagtaagatcccttctcttaaacttaattccaaaatcttgaggaagagctccattggtccagcttgggttggaccctacccacagtccaatcaacaacatccatgagtggggccatgaggctttcagtggcttggcttaagatgggctctatctccagtccagtcaacagcagccattggtagggccatgttgcgcaaatatggtggctcctactatagctatgtggatgcagaaagtaaaggacagtctccagaggacagctgggtatgccaaacaacaggtgacttgctaagagcaatgagaaataatacctgccctcaaggagcttatagtttcacgagggattcagacccagagacacacaaataccattcctactcagaagaggctactacattgatatgactcagagacatccacataaccagagtttgatgacagaagttaccagaagttgcaccaactgctgccccaaagccatcctaggacctgatgagctaattagtcacaattattattgatgacagcaccaatccacctgtttgtgtcacaagacagttattgctgggtgaggtggctcacacctgtaatcccagcattttggaaggccaaggtgggaggatcacttgagcccaggagttcaagaccagcctgggcaacataatgagagcccatttctactaaaaatagaaactaaaaaattaaccaggcatggctgtggtgtgcctgtgttcccagcccacgaggtcaaggctgcggtgagccacgttcatgccactgcactccagcctgggtgacagagcaagaccttgtctcaaaaaaaaaaaaaaaggatgctcaaaactaataaattgaaacattacaggagggtatgccatgaaaagtgaaagcctccttcctcgtagttactataaatattttacttgttttttattttaaggtatattctagactttttccattaaaattgaatgttaatttgaaagttttttttttttttttttttgagatagagtttcactcttgtcgcccaggctggagtgcaatggcgcgatctcggctcaccacaactcacgtctcctgggttcaagctattctcctgcctcagcctcctgagtaactgggattacaggcatgcgccaccacgcccagctaaattttgtatttttagtagaggtggggtttctccatgctggtcaggctggtctcgaactcccgacctcacgtgatccacccgccttggcctcccaaagtactgggattacaggcgtgagccaccgcgcccagtcagatttttttaaacattaaaaaaactcttattagtctaaaagtctaagacttttaatgagaaattaatattgaaatatggctattcaagaccatcgtgattttcgtctttgactatttttcttgtttagattaatatgcctaatactatggaatcattcaagcagtcccagaataaaacacttagccatggcattttattctctacctgcacagttgagccttttgtattcatgttttattatttttttaaacgatattcccaaatgaggagtagtctgtagtctgtggtcttaacttttgtatattacccttggaatactgtagtatcagagttatgatcaagttttaggaaaaactataaagcgtccagtcttgtgttcaagaatatgttacagggccaggcacggtggctcacacctgtaatcccagcacattgggaggctgaggcgggtggatcacgaggtcaggggatcgagaccaacctggctaacacagtgaaaccccatctctgctaaaaaatacaaaaaaattagctgggcgtggtggcgtgcacctgaagtcccagctactctggaggctgaggcaggagaatggcgtgagcccaggaggcggagcttgcagtgagccaagatcacgccactgcacccagcctgggcgacagagcgaaactccatctcaaaaaaaaaaagaagaaaacaaaaaaagaatatttcagagaatgaagtttcaaagtattcatttacaaaactatgcaaatacagtgcttttcagtgggagatattgttagacttctttccaaatattttccaaaattagtattctatttagattttcttttgctgattttgtcattatagtctcttagaaataccatcaattttatcaatactttctagcttattaacatggaatcgtattttaattaatttcctttatatctgtggctgccaccttaaaatttattttcatttgagaattaggagtatatcagttttgtgttgtcaaaatgtataatgtttatgttctgtgactataatgaagttttctttgttttgtctaagttggtcataagaattgaaaaccagtaaatagcatttataataattatggtaatgcacattttattccctgcaaagccaagtcgtggtgtgactggacccagagagaaggcagatagatgccccgctgcttttgcagagagctgtgcaggcttgggtactgaagagctcctcctactttttttttttttgagacggagtcttgctctgtcgcccaggctggagtgcaatggcacgatcttggctcactgcaacctccacctcccaggttcaagcgattctcctgcctcagcctcctgagtagctgggattacaggcggccgccaccacacccagctaatttttgtatttttggtagagatggggtttcaccatgttggccaggctggtctcaaactcctgacctcaggggatccacccaccttggcctcccaaagtgctgggactactacaggcgtgagccactgcgcctagccctcctcctattttcttcctaactttctttgctgcttctagatcatagtcagctgccactgttttatgttcacggcaggttttttggattactcttctgatgatttgctagtcttttcgtgggcagcaggaatatctatatgtatgtagatgtattatacatacatacatattatgtatacacatacatgcttgattgtgtaacatttcttttttcccccatagggattgaggatggtaatgttttcaagttattgaatgtctcgcaatgtctcattgtgccctcagtgttctggtagttgatttgactgagtatggaattcttgggttgaaatatttccctcatgaaggctacactgctttatgattgtgtagctggtgaggtgaggaaacacccctttccctctttctgaccacactcactggaattttttaaagttttcttatgctctctgatgtatctgtttcctctgcatcagttcttcattcaccttggaactttgcctttttaattatttttcttcaaagactgttaatcctcaattgttcactttgcaatggattatttagaaaacttccctaaatataatatagaattgctagttgtcctgattgaatggtgatattttttagtactgctagatcctcagttgatcagattttacagtttctttctccaatagcattttcgtaataattggtttgtttgtatttttttgttttttgttttctttgagacagagtttcgctcttgttgcccaggctggagtgcaatggcacgatctcggctcaccgcaacctccgcctcccggggtcaagcgattctcctgcctcagcctccctagtagctgggattacaggcatgtgccaccacgctcagctaattttgtattttaagtagagacggggtttctccaaataattggtttgtaatataaataatacttcatttaatattaaggaaaaggccaggcgcagtggctcacgcctataatcccagcactttgggaggccaagggcagatgatcactgagcccaggagtttgagaccagcctgggcaacatagcaaaaccccatctctacaaaaaacacacacacacacaaaatgattttgacatggtggcacgcacctgtggtcccagttactcaaggggttgaggtgggagaatcacttgagcccaggaggttgaggctgcagtaagccatgatcgtgccactgcactccagcctgggtgacagagcaagagcctgtcacaaaaaaaaaaaaaaaaaaaaggaaaaaactttaaaaatccatgctgttatgaattaatatccatttaatagtccccctacatcactcatggtttatttttctcctgctacagtaattcttttttattgtattgtaactttaacttactgaagcttaaaatattacatttataatttgagagaaatattctaaagaaatgaactttaaatgattttaatttttattttttaattttttatttttttgagacagagtctcattctgttgcccaggctggagttcagtggtgtaatctcagctcactgcatcctccacctcctggttcaagcaattctcctgcctcagcctcccgagtagctgtgaatacagactcatgccaccacacccagctaatttttgtacttttagtagacactgggtttcgccatattgtacaggctgatctcaaacgcttgacctcaggtgttccgcccacctcggcctcccaaagtgctgagattataggtgtgagccaccgcacccagcctattttaatatttttaatatatatatattttaattgggatggggtctcactatgttaccccagctggtctcgaactcctggtctcaaactattctcctgccttggcctctcaaggtgctgggattacaggggtaagccaacatgcccagccttaaatgtttttaaaaataaagtttggcagccaggcacgatggctcacgcctgtaatcccagcactttgggaggctgagtcggctgatcacctgaggtcaggagttcgagacaagcctggccaacatggcgaaacccgtgtctattaaaaatacaaaaaaaaaaaaaaaaagactaggtgcggtggctcacacctctaatcccagcattgtaggaggtggaggggggaggatcaattgacattgggagttcacgaccagcctgaccaacatggagaaaccccgtctctactaaaagtacaaaattagccaggcctggcggtgcatgcctggccaacatggtgaaaccccgtcactactaaaaatacaaaaattagctgggagtggtggtgtatgcctgtaatcccagctactcaggaggctgaggcaggagaatcgctggaacccgggaggcggaggttgcagtgagccaatatcacaccactgcactccagcttggcgacagagcgagactccgtctcaaaaaaaaaagaattggctgggtgtggtggcgggtgcctgtaatcccagctactcgggaggctgaggtaggagaatcgcttgaacctgggaggcggaggttgcagtgagccgagatctcgccgttgcactccagccttgggaacaggagagaaactccttccaaataaataaataaagaagtttggcctggagaattttaattgtttctcatttttcctgaagtgttctcgagcatcccatttgaacgaaagacttaggtaaacatttcaacagtaagacaacgacaagaatcacaatggactttttttggggcacgggacagagtctcgctctgtcacccaggctggagtgcagtggcacaatctcggcttactgcagcctctgcctcccaggctcaagcaatcttcatgcctcagcctccgaagtagctgggactacaggtatgtgccaccatgcctgacttattttttttatttttagtagagacgagattttgccatgttggccaggctggtcttgaactcctggccccaagtaatttgcctgtctcagcctcttgagcccgggaggcggagcttgcagtaagccaagatcacaccactgcactccagcctggccaacagagcaagactccgtttcaaaaaaaaattctaccccagtattccatgtcacatcctcaactgtcctctatttagatattattgaaatagtagatgatatcatgtatgaaaatgtcattgttcctttttgggggtgtcttgaatttttcatttgttgattttttatttctgtaatcagtattaatgaaagtgatagcaattagtaataaagttccaaatacattaaaaagtagagtctagaaaaatgaaccccaagttccaacaattaccaactcataatcagtcatatttcactcttatcccttttcccaaaaaggattattttggaaatgccagtcatctgttatctcatttttaaatatttcagtatacctcaagaagataagggctttctttaaaaacatagccatagtaatatgacattgaaaaaataaataacagtaatttttcaaaatcatcaaatattcagtgtttgtttaaatttcttcatttaaaaagttgacttgttttgggtgggtgcagtggctcatgcctgtagtcccagcactttgggaggccgaggcgggtggatcacgaggtcgggagctcgagaccagcctggccaacgtggtaaaaccccatctctactaaaaatacaaaaattacccaggcgtggtggtgggtgcctataattccagctgcccaggaggatgaaggaggagaatcgcttgagcccaggaggcagaggttgcagtgagccgaggtcacactattgcactccagcctgggcaacagagcaagacttcgtctcaaaaaaaaaaaaaaaaaaaaagttgacttgtttcatagaagccaaaacaaagtctgcacctggcatttggatagcacacttcataaatctcttttaatctataggctctttctccctccttttttcctatttgcaatttgtttgtggaagaaacagagcatttgtcctgtcttgctcaaacattttaactggcttctagtgtttttctagctggacaaagttggaagttgacaaatcatttctgtactattggtccagtatgctttgtgggaaagaactatttggggattgatgtaaaacataggtatgtgaggactaaactcttattttttattttttatttttattttttgagatggagtcttgctctgttgcacaggctggagggcagtggcgcgatctcagctcactgcaagctccacctctcgggttcacgccattctcctgcctcagcctcctgagtaactgggactacaggcgcccgctgccacgccaggctaattttttttgtatttttagtagagacggggtttcaccgtgttagccaggatggtctcaatctcctgacctcgtgatccgcccacctcggcctcccaaagttctgggattacaggcgtgagccaccacaatatatacatatatatgttgggattacaggcgtgagccactacacccagcctgttttccttcttatattcatgtctggccactggggctgcaatctagcatttctttagcctcagttgtctggtattagattaggttctagaaggttcatataactattaatagcaatagtttttttccttccagagacatatttattcctcatgcaaaaatacagaactagtcactaaataaggtaaaatcttgaaagaattttggataagagatttcccataaaaatgtttacttttaaccttttttcttttgttgttgttgttcaatgaatgagttatttttaaaccactatcagtttgttagcatgttacaattaatgaaagaagttccaatgcaaaatattttaataggttgtcaaatatacagttattcgaattatctatcacttataaaaatcggtacatcacattattctataaaataaaaacacaaatcacacattgacaacaacccctgcagcccaagaataccctgccgagagtacaaattacaaacacattttttaaaaccctgatatgggcccagcactttgggaggccaaggcgggccgatcacaaggtcaggagatcgggaccatcctggctaacacggtgaaaccccgtctccactaaaaatataaaaaattagccagtggtggtggcgggtgcctgtagtcccagctacttgggaggctgaggcaggagaatggtgtgaacccaggaggcggagcttgcagtgagccgagattgcaccactgtactccagcgagactctgtctcaaaaaataaaataaaataaaatactaaaaaaaataaaaacctgatatggtttggctctgtcctcacccaaatctcatctccagttgtaatccatataatccccatgtgttgagagcgggacctggtgggaggtgattagattatgggggtgtttcccccatactgttctcataatagtgagtgagtgctcacaagatctgatgattttataaggggctcttctcccttagctcattcattctgtctcgtctgccaccatgtaagatgtgcctcttcttccaccatgactgtaagtttcctaaggcctccccagccttgtggaactgtgagtcaattaaattgcttttctttataaattacccagtctggggtctttatagcaatgtgaaaactaatacaaaccctaaagacaaatgcatttaaaccaaagtaactgtgactagactaaatgcattcattcatcaagtacaatagaaaaatttagcactgctgcttatagtcactaataacacaactttaggtgcaatgtcacatgctttcataaatcttccagtacagttcccacagtaaagagacatggtgcacgccattttcgtttatttgtaggtgcatcacacatcatacttaagactatttcacttcacaaactgtttatatatatcataactgaacaccaggttaaaacattaacctcaatgatgacaaaacttaaaaatgaaagaaaattcctgaaaacatatgccgatttaattgcctaaatactattttcacttagaagctgttagaataagtaatgagaattgaaatactaactcaaaaaaagatagaggctccaaactgtcctaaaatattaacacatttttaaagtaataatataatcactccataaatcaaaagtaacttcctattctttgccaaatgtaaaacaccagtgatttgaagagaagactggggcctaaaatcatgctaaattgtaaaatacaggaaagagtgtgcagctaattagcttgtggatatgtaatagaatcgctttcacaggattgttgtgttaaatgctactttttttatttatgtatgtatgtatttattatttatttgagacagagtctcactctgttgcccaggctagagtgcagtggcacgatctcggctcactgcaacctctgcctcctgagttcaagtgattctcctacctcagcctcctgagtagctgggactacaggtgcctgccaccacacccagctaacttttgtatttttggcagagactgagtttcaccatgttggccaggctggtctcgaactcctgacctcaagtgatctgcccacctcagtctcctgggattacagggagccaccacacccagccatgttaaacactactttaaatgggtagtctaggccaggcgcggtggctcaagcctgtaatcccagcactttgggaggctgaggcgggtggatcacgaggtcaggagatggagaccatcctggctaacacgttgaaaccccctctctactaaaaatacaaaacaaacaaacaaaaaaaaattgcccgggcgtggtggcgggagcctgtggtcccagctactcaggaggctaaggcaggagaatgtcgtgaacccaggaggtggagcttgcagtgagccgagattgcagcactgcactccagcctgggtgacagagtgagaaataaataaatgaacagtctaaataaacatacctttaccagcaaggaaagtgaaaattaaggcttttttacactatcttcaactattaacactacccaaacttaaaagtcaaatagaggttacaaacctgcaaaatattacttctaacatctctaacatactgttagttgcttcctctcaactccatacttatgttatatagatgcgcatttttctatatctctatcttaattaagcccccatcccaccccaactagacagaatgccaaaaatggttagggccttatctgattggttcacaactgtatactgtgaagctaaaaaatgcttggcacatgctataaattaaataaatatttttgaatgaactaaaaaccctggccttcaaaggcaacccaaattgttttcccaaagcattaatagatcattgttacctctttaaccagattgactattattattattattattattttgaaacagagtctcactctgttgcccaggctggagtgcagtggcacgatctcagctcactgcaatctctgactcctgggttcaagtgattctcctgcctcagcctcccaagtagcatgtaatcacaggcacacgccaccacacctggctaatttttgtatttttagcagagagggggttttgccacgttggccaggctggtctcaaacccctgaccttaggtgatgtgcctgccctggcctcccaaagtgctgggatcacaggcatgagccactgcgcctggccagactgacaattattaagaagaaattgatgccttgtaggctatgaaaacatcataggatgtaatagaaaggataactgaggccaggtgcagtgactcatgcctgtaatcccagcactttgggaggctgacgcaggctggttgcttgagcacagagcctgggtaacaatggtgaaaccctatctctacaaaaaaattacaaaaattatcccagcatggtaacccacgcgcctgtggtcccagctagttgggagtctgaggtgggaggactgcttgaaaccaggagggagaggttgcagtaagccaagatcgcatgccattgaaatccagcctgggtgacagagcggaactctgtcttaaaaaaaaaaaaatcaatgaatgtaaacactttattaaactattatacaatttaaatttttattagagaaatgtattattcacatccacaacttcttttttttattttttgagatggagtcttgctctgtcacccaggctagagtgcagtggcacgatctcagttcactgcaacctccgcctcctgggttcaaccgattctcctgcctcagcctccagagtagctaggattacaggtgcccgccactgcgcctggctaatttttgtattttttgtagaaatggggtttcaccatcttggccaggctagtctcgaactcctgaccttgtgatccacctgcctctgcctcccaaagcacaacttcttaaagtcctttttaaatgagtataatccataataaatatgctaaaattattacttatgtttcataggggaaaaaaactatgagaatcctattaacccaagctatatccttattatgcttatttcttaaacatttgcatgttcagatatgcttggtgaatactgatcattcataccaatagtggtaaatttcagcataatcttttttttttgagacggagtcttgctctgtcgcccaggctagagtgcaatggcatgatctcggctcactgcaacctccgcctcctgggttcaagcgattctcttgcctcagcctcttgagtaactgggactacaggcgcccgccaccacaccaggttaattttttaaatacttttagtagagatggggtttcaccatgttggtcaggctggtctcgaactcctgaccttgtgatccgcccacctcagcctcccaaagtgctgggattagaggcacagctcactgcaacctcaaactcctgggctcacatgatcttcctgcctcagcctcccaagtagctgcaatgcaatggcatgatcatggctcactgcagcctcaatctgggctgaagtgatcctcccacctcagcctccttagtagctgagactacaagtgcatgccatcatgcccagctaattgtgtgtgtgtgtgtgtgtgtgtgtgtgtgtgtgtgtagagatgaggtgttgctgtgttccctaggctggtctcaaactcctaggctcaagcgatcctcccgcctcagcctcccaaaatggtaggattgcgggcatgagtcactgtgtctgaccagcaattcccatgttttatagaaacaccattctcatgcagcccacagcggccagcttcagagccaggtgaagttgaacgtggcccccgtggccgtcttccagatgctcaagtcgatgtgtgccgggcagaggatggcgagcgagccccaggactctgcggccgtgtctctgcacacgacgagcgtgcccgaagtcagagccgggcccattgtccctgccccagtggtcgggaggtggggtggagaggggcaggggcagcacagcgccagcatggcccggagtgaccacgcctgtctgtcggtctcagcccagcagctgcagggcccatccgtgggctctgctccctggcttcgctgttatccttaggaggcatgtccaggccaggtggacgcagagtgcgtgccccacggtgctccaggtgggctagggctcctcctcctcagcctctccccacctcttcactcatgcctccattccacaaagtcaggaatcaagacgactttgggctaggcgcaggggctcatgcctccaatccaagcactttgggaggccaaggggggaaggtcgtttgaggccatgagtttgagaccagtctggatgacagagtgagaccctgtctgtaaaaaaaaaaaaaaaaaaaaaaaaaagattttttttttttttgaaacggagtctcgctttgtcgccaggctggagcgcagtggtgctatctcggctcactgcaacctccgcctcccaagttcaagtgattctcctgcctcagcctcccaagtagctgggactacaggcatgcgccaccaatcccagctaatttttttgtacttttagcagcgacggggtttcatcatgttggccaggatggtctcgatatcttgatctcatgatctgctcacctcggcctcccaaagtgctgggattacaggtgtgagccaccacacccagcacccccaaaaatatttttaaaagacagttttgggccaggagcagtggctcacacctgtaatcccagtactttgggaggctgaggcaggcgtatcatttcaggtcaagagtttgagactggcctggccaaaatggtaaaaccctatctttactaaaaatacaaaaattagctgggtgtggtggcacacgcctgtaatcccagctactctggaggctgaggcaagagaatcagttgaatccaggaggcggaggttgcagtgagctaagatcacaccattacactccagcctgggtgacagtgagactcctctcgaaaaaaaaacaacagcacagttttgatcctgtcttgtggcattacagcctccaggaaagtgccgagggagcagggcaggcagaagtcttcctgccaccccctgcctgtaccccacttgggcccaggtcctatgcaggggcttgaccagccctggccagcttccctctgaggattgcaggacaagagtcagaggcagaactcccagggtacagaggcctgcggggcctgaagggcctcctctctccagcatggtgactggggctgagcagatgctgaggctgagagtgtgtcatggtggagcctccgtctctgctttcctccccacatgttgcttctgctcctgacggctccctctgaaatgcagcaaaacctccccggccactggaaggaggcccagagctggctccccacctggaagcatgaggacacccacacaggcatcctgagaaggggcggagagccggctgcccccatgggggcagggcctgggcacccagtccccctgccctgagaggccccaggcacctgcgcagaggcctcactgaccccgcgctctgtctgctctctttgcgtctctctctgacctccagaggcctcctttttctctgccaggaacaataaccccactgcgaacccctcttttccttgggcccttggcctgcgggctctccggttctgccccacagcctggctgccacacactcacctttctctccagcccctaccccaccccattccctccgcctctcttgctgcctgttctttctcaggtcgtggttattggcttatctctggtggttggtgctctcccttgtttccatggaaagtgcccggccccaggaggcaggaaaacctgtaagctgcaagggcaagaccatgtaggccaacgctgccctgtggcttagcgacagggcacgatttctggctctgtttattagagacatggtatggcccacagttgggctggcatctggggacaggatcaacatcccacaccccagaggcgaactgtggtgagtgagacttgtgccctgtaaagaattccacccaccccaagggaggacagcaggctgaggggtggtgtgctgtgctggagagcacagccccaggcgtgacaaacaccttgcctcttagaagctgtcccctaccccgacaggaagtctggaggctgaaacagaggctcccgccttctccgagcctcctgggcagcaccacacagatgccgtgtgctggtcccgtggccacactccagcactcagcccctttgcccgcctcactcctgagttggggccaccttccaggtgtcaccaggtgtgatgaaaccaggggcccagagccaggggcctgtgagagcccaaggggctctggtcgcacctcctgtacgctcctccccacagcgcccacctcactgccaaccagagctcaggcccaagggagggtgaggaggggctgagggacaggctggggtaggggtgcacggactgcaggctgagatgagcaattgaagggcaggtttccacggggaggaagaaactgggaacagagtccttgtcattctaagggatgttgccattcacccagggattctgggtgccgggcccggctgtctgtcagtgcagagggtgtggcagtgaagtgagatggtcccactcgttccaatgagaggtggcgagaaaaaccgccaatgatggaggtaggaggaggcttctgagcaggagagcagtaagggttacacagggcgggacaggaggggtcagcagagccccgaaggtgtgagctggggtggtgggagggggtgggcgaggcagagtgctgtccaggcgctggtgggcccagggcaggaggagggaggtggcaggacatagtcaagatgtattcgggggccagacgcagtggctcatgcctgtaatcccagcaatttgggagaccaaggcgagcggatggcctgagatccagaattagagaccagcctggccaacatggcaaaaccccatttctacaaaaaaaaaaaaaaaaaaaaaaaaaaattagccaggtgttgtggcatatgcctataatcccagccactcgggaggctgaggcatgagaatcacttgaacctgggaggcagaggttgcagtgaggtgagatcacgccactgcactccagcctgggagacagagtgagactccatctcaaaaaaaaaaaaaaaaaaaaaagatgtatgcgggggtcgtggtgctgggaacacgggcataaaggggccaggaggatcaggggtgccgtgtgggtgaacgggggctccgagagaagtgagaggatacccaaaacacgaggactggagcggcctggcatgctgggcccctcagggtctttgctcttcaagggctctgtcctgcaggctgggtggcagaaggccaggatatgagggcacagaggccctggggggatgccccgtggggatagagggaaacctggggagaaggtggaggggagtggggcagaggtggggccacaccaggagtgtgctgcggagtgagaggcagagcccgcagatgggataccgagagctctctgagacccgcgtgttgcagcatccaaacacacggagctccagctgccccagtaatggcagaatctggggtggagaacataagagggggttgtcagagtgatccagctggagggcatggaggccatagatttcacacaggacttgggtgtggagttctccaggccgcgggccaggcccactcaagcctgcctctgtgaactgcagcaggcgccccagcctctctggatgcctgtcccccagccatccagacagcctgcggggaccaccgccaccaggctcactcatacccacagggaggggaaacagaagacaccagaacagacgggcaatgcttgtggtgagggtctggagtcattgagggaaaactaaatgcagtcaagcggtctctaagtttagggaaactacacattttttaaagttgtccagagcatgtaagatgacgtttggtatgtggaagccatgagtctcacatgagctgtgctgcctgatacgggaaccacgagctatatatggctggcatggtcactgcactgcgtgtgttatgcacagcaggtgccaaaggactggcacaaaagtgaatgcagggcgtggtagctcacggctataatcccaacactgggaggcagggcaggaggatcacttgaggcaaggagttcgagaccagcctgggcaacatagcgagatccagtgtctacaaacaaaagaacagaagtgaatgcagggccaggcacagtggctcatacctgtaatttcagcactttgggaggctaaggtgggtggatcacttgagtccaggagtttgagactggcctaggcaatatggtgagattcccatctctatttaaataaaaaggaaaaaaaaagtgattgcaacatttcatgaaaaacttatgtactgattacatgttgaaatgataatatgttggatattttgggttaattaaaatatattatttgaattctaattccacattttcttttattttagtggttaccagaaaatttaaaattgtggctgggtgtggtggctcattcctgtaatcccagcactttgggaggctgaggcgggtggatcacctgagatgggaagttcgagactagccttactaacatggcgaaaccccatctctactaaaaatacaaaattagccgggcatggtggcacatgcctgtagtcccagctacttgggaaggtgaagtaggagaatcgcttgagcccgggaggtggaggttgcagtgagcagagattgcaccattgcactccagcctggacaacaaaagcgaaactccatctcaaaaaaaaaattgcatgtgtggctcatgcccctgacttgggtttgctgaaggcatgtcatgaatgtgttggagcagcactgtccgacaggagtattaggcgagccacagactaaagggcctgctgtgctgcccctgcccctgccagtgagacaccactgctgatgccacctgccctggctgcggctgcttctcaagcagggccagtggtggtttccttccctctcagttctctcacgtcacctctgcccgttttccttcctaacacaaatgttggtcagcccatgttgccgcaagttcgcgctgccactacgaaacaagaaaggccacccttggggaccagcagaagggacacatcttcattccccaaccagctctgcccagatgggaaatggtggggagttgggctcacataggccacaccaaaggtaaatggcagagggcgtcccagcttggtctggcccactccgcagcttcagggattccccagatcatgagaggctgacaggctgctgcattttgagatttgcttcgttaggggctcacaaaatgccgagtggtcaccagctggtttcagagtagcaggagcactgaccttgaagagaatgagccaggctgtttttggttttgttgttgttttatttttgtatttttaagttttgttaatctaatttttttttttagaggtagcctccctctgccacccaagctggagtgcagtggtgcaatcatggctcactgcagcctcagactcctgggctcaagtgatcctcccacctcagcctcctgagtagctgggactacaggtgcaggccaccacacccagcttttgtttgttttttgggtttgtttttttttagagatagggtctcacgtttttgcccagactggtctcgaactcttggcctcaagggatcctcctgcctcagcctcccaaagcctggggttatagcatgaagtctgttttaacatgcattggtcattgactgtttttggtgcatagaaggaccctccagggaccaggcctggggacatcagtcaccccaccctcccccccaacttgcagtaacacttggttcaaccccactgtccaacccatctgactcagtagcccctcccaagggagcagagctaaaaaaaaaagctggttttcccactgcaagatgctgcaggtcgttctcttctgggcctcctcgtccttcataaagtgaggaggcctgaacagggctcctcactaaccccaagagcacatgattcctgaagggttccagaattgttttcttaatatccattatggctcaaagttatgttaagggtttgtcagccctgtcagatttaaaggtaagcattattagtcaggtgtggccacatgcttgtagtcccactactctggaggctgaggcaggaggattgcttgaggccatgagttcaaggctgcactgagctgtgattgcatcactgcactccagctcaggtgacagagcaagactcagtctctaaaaaccaaaaaaattttaaaaaaaatttcaaaacccttacttcctcctttctgcttccctctcatccttgtttccagaagggaccgagtcattactgaggggaagagaggaagctcagatggtgccaagctgaagggaagccagctctgagtcaggcccaggtctgcagactgccctgccgtgtgctgtggggagctggacattagtcaccctgagagcacggggacacctaaacaccgcggctacagacgctctgactctgtctggcctggcccgcagagggactgtggcctcagaggaggatgctggcccattgtgggagctgctgcagggtggtggggctcatctgctcatgggagatggggtccttcccccgaccagtcagtggagactaaaataatggcagtttgtaccaaaggaaatgcgaggtggccattctctgctttgtgccttttccacgagtcactggtagactgaggtggccaaacttcacccaccacatgcttctggctgcacccctccttggttctgggcaaccctgactccgtctttcttgagttgagtgtgccaagctgacagagttccaagcgtgacaccaccataaccttcaccacccaccgagcagcaaagatctcattctctgaggaagaactccccagaaactctcacaaggagggccatcctatccctgcagggatttggggagaattttcttttcagtattggcatggaaagggagctggagtggcctctggagtagccaagatccatggcgtctcagacacaggagcctccacttgttcaagatgacaaatggtgaaacggaaatgtcctcatggatccctaaaacacctggttgcatctttttttcaagagcgcagtttccaattgcaggtgatttgactaaacttggtaagaggccagggaagaaccaggattgaggctgagtgttctgttggctgaaccgtcatctggtctcaccccaaaagtggtggcaggagagctcccgcaagggactgccccagaccttccacttgggtgactgagagccagttgggatgagagccagttggaattccaaaggaagaagcacttaatgtgagggtggtcagtccaaagcatgtgttaggggaacttccatacacacaaggctgcagtatggcctcacgagggacggcaaggatggaggttctgcctaggcatgctgcagtgagggggtggagtgtggagtttatataagggtgcaaggaatttggctggggcggggccagtttccacatgcttagcaacatgtcagatcttttactgtttcaggcaacaaacaacatgtttatcagtgtctggtaagaagcaaggccccagctagggtttgagcctgcagggggaacatacagctgaccaggtcacagagcagtcaaggcacactcttggtcaggacaaagctggggggacaaaatgggagacccaacactgtgagtcaagcaggggacacatgccctggttagagcccatggggcagactctaccaggccagagcaaaggagagccctggccaaggtactccacatggggggctgtgaccccatgggcaagccttctacccaagcacatttgtcctctagagggtcctctcggtcttgctgatgctgacaacaccaagtccagggaaatccatcccgttaaaataaagctctggcccaagtgtggttgcagatctttctatcttcacaaaaaggagtaagcaaattacaaatcgagggaaatctgaaccagtggtcttcatctgggattctctggtggtcagaaggaaagtctcaagcattcagaccacgggaggaacccagtcatggaatccagtagctaaactccagagtgagaggctttattgagggatctggccagcagcccgcaatgcaatggggctctctctttgctcctaggtggattggcaggttgagaaataatagacacacacaagatagtgaaagctgggtccagggggtcactgccttctggtcccatggtgccaacaatgcactggatataccagcatttactattaagtttagtgagggcgggggtaggttagtgagggatttagggtcatttgattatgaggtgagatggtcacatggggatgaagtaattctttaacatagcatttgtatgtagaagtacagtacatttgtatgtagaagtacggtatacaaagataagaatttacaatatagtgtgtgcatcagtaatttctaacagagtcttagaacagaaacacagtctttccataacctatgattagcaagatattaatcagcagtaacaattgcaacaaaagctggttacaaacaatccatggaaacaggacgtgaagctagacaactggttagaccagaaattctcagaagggagtatgccttcaccctaaagaggcctagaagagctgtggcaagatgagggcgtttatagccgtatcttatccatatggacaggcgccccccatgcatccgtttataggctctccacaagggttgcattccattcccagagctatgaatatctgcttttctgggataggaatcttggtgatgtgaaacctccctgactgcacgtccattcataggctctctgcaggtggaaggacatcacgtgctgttggctcgttctggcagtccaagctggcattgtctttacacaatcctgcatgcaattttgtatttacaataatcaggagcatttcatcttttattccatagcaatagtttcagggtgtctccctacaaggcttgaccactgtttgcagaatactcgggtaggtaggaaacaatgtgagagcttccaaaatcaaaatcagaaacccaattccagtacttggtgactggagtgtttcctgcctgtcaccatctaaggcagctcagatgtacagttcagcgtgaacacacctggaggatgaagtggcaagtccctgctgctgctgctgcttggcgccatcagggcagaccaggttccttgtccaggccaagtatggaccagccacccttacccttccctaaatggacccgtggccaagggcttctggggcatgacctgcctttggcagttctgagcctcaggactcaggactgatacagggctttcagcttgaagtggctttgagggaaatgtgcagacacaaatgttgctcaaggagcacacttcagtaggtgctgcagttacggggctcgtccgttcctattggctgcgctttgtgtctcctcagggagaaacaaagacagcacctccctcgggagagtgccggccctgttggaatgcagcggccgcaaaggatccagccagaggacaccccgccagcccagcgctaccaggctgcccaagtggggtgggcctggaagaaggcagcaggtgcggggcagcacctaggatgggccagagacttgtcacaccactgtccccagcaaaggctacgtgttgtctccttcagttgataataagtctttctgagatgcagagggtccgggtcatatgttctctactgttttttgatgatattatggcacaaacatagaatgaggtttttatgcaggtcctggttgtgccacagctgaactaaccaggtcacttcaccttgagtcaacttcctggagctgactttggttctgagaaaagatatctggattcccaggtcttttacaaacagatgttaacacacttcacttgaagtgaaaggtgcaaggttttctaccaagacagttgacaatgctgaggggcaaggtgaccgtgtgtgtgcgtggagggtaaatgctgccttccaggttaccatggagcagtggggggtcaggatgggtgtgttgtgaccttctgtgggtcacaaatactgtggagaactcagtaacactttcccccttctaaaatgtcctgaccttacacatttgacctacagctttagggatttcatggacacgccccattcatagacctcagatttaaacactctgcttctaggctcttctttttagccagtacatcccatcaatagaaaagccccaaaaattgcaaattcagttgaaaccctgacttagctttcctagaatttaggaaacctatccactcaacgcttggcttgtttctcctgggtcaagtcacttccatggcagctccttaagtacatacactcctgctgcaccccaaccgcatgccagcagggcaggctgggaccccactgactgtccatgcaggctctggggtcccacctgctcctgtaggcagagccaagcagcatgacacacagaggtcttggttttatagagaaactttaattgcaaacaacctgaaagcagccatgctgggggcggcaggagagcccaccacaccctcccctcagtattctttgccttcttcagcctccgcttccacagaatccatgcccacctcttcataatccttctccagagctgccaggtccttgcgagcctcagaggactccccctcctccatgccttcccccatgtaccattgcacaaaggcctgcttggcatacatgagatcaaacttatggtccaggcaggcccaggccttggtgatggctgtgatgttgcttagcatccacatggcccattgcaacttggtcaggtttcccccagggaccaccgtcaggggctggtagttaatgcccacctgccagagaagggcaagaaagcggtccgtgaagcttgtatcaaacctagaaatggtggctacctttcctcaaacagaagaccccctgtaggtgacgaggagaatgctcagttcacccccacaaacctcactaagcccttctctgtgccaggcagggtgacggttccagccaaggaataaagagaaaagagccttggaggtggccaccctggcaggatcccaagctgcccgaagggctgtgtcctagcaactgtgacatgtgataggtgcccaggtaaagactgtcttccctctgaaaatgtacactacttgtcttctttatagattatttactccaaagggttttacaagatagtaatgaaattctgtagctcaactttttccacccagatagattgtgagtacacaactgtgataccacggggaaggtcataccccctgctgtcccaccaaacaagccactgtgaaatatgcaaaggtgacaggtcaaagatcacttgaatggagctaccacagcagcaagagtagtccatgtgcttgcttgagtaggaagtgacattccaaggtgggaaccaaaagggaagcattccaagtttcagaacttgagaataacacatcctgagtagtgcatggggtcaactagagcaggggtcagcaagcctgttctataagtgacaagatcatacaaattctaggccttacaggcacatggactctgtcacacctaccccactctgaggctggacagcaaaattgatctgcgatgaaggggtgtggtggctgtgttcagacaaaaccttatttacaaaattgggcggctagtccagcagccatgctcacccctgaaggagagaaggagaagcccagagtaggaattcccacttagagctgactgcagtggtctccccagaggcagtggatgtctgagccagaggagggagggaaagcaaagcagaggacgcagaggtccagcagagggagaagcgacaggatttagtcaccaactcctggaaaagctgaaaggggacagcaaggtttctttcatgtgtcagtggaaggtggggacagattttctgtctgaggcaaacacaggccaacattactaggcttcccaaaagagaaataaagatggtgctgttttcgtcacaaaaagattcttgatagtctttctttaaatcaaacactccaaaagacatttaaattgggtataatttctacagatgaacattctgactgtgccttcatgggtgataacgaagccacctatgacacatgtcggcacaacctggacatacttagatgaagcaagacttagtgagagcagtttataataatgcccaagttaaaatatatacaccacccacatgattccccaaaatgcccataaaatttctactaagttcaacctatcttttccacacaaattctgctgtccaagcaaggggcaccaaaatcctccaaaaaatacctttttcttaaaaaaacacaaaaacctcaccacagatacatagtgtgatgactcacaaaggaagttcaaaagacaccactgaattaattatcactctggttcattgatttatgcccatgagcctagcccatggaacaggggcagggtgacggttccagacaagcaaccgcaaaggatgcgggcctttgggggcagcattattctgcagatctgctgcttcctgatggcacaaggactccacatcacccagtcctcccttcaatccagtcgggcaccaacctgcaaactagatggtgcgcttgctcttgatggtggcgatggccccactgacatctttcgggaccacatcccctcggtacaacatgcagcaggctatgtacttgccatggtgagggtcacacttgaccatctgattggctggctcgaagtgggcactggcgatctcggccacggacagctgctcgtggtaggccttctcggctgagatgatcaaggcataggtggccagggggaggtggatgtgggtgtacggcaccaggttggtttggaattctgtcaagtacacattcagggccccaacgaatcacagggaggccgtgatggaggacacgatctgcccaatcagacgactgaggttggtgtacatgggacactcgatgtccaggttgcactgacatgtcgaccatgaaggcacagtcagaatgttccagggtcgtgtaggtggtcaggatggagttgcagggctccatcacagccatggagacatggggggctgggcaaatggcaaactccagcttggacttcttcccgtagtccaccgagagccgctccatgagcagagacatgaacccagagacggtgccgcccccaaagctgtggaagatggggaagccctgcagtcccatgcacagatcagcctgagagaaaccagacaatgtgagccaatgcccgtgggagccacaccaccaacctccaccaagccggggccacttctctttgcctctgagagttgctacggattcagactatccataatgaacacgcatcacactttgaagcagagaaaagcagacaatacagatctatgcacaaatcaccacgcatacttcatagtaagacgttgcagacttagtcggactcaagatgctgctctaagtgctgcgaaaatgaccttcctttcaccatccaaggcctattctcctgtgcaggacaacgtccacatgaagccttctcttcttaccagtttgtggatccggtccaggacaaggtctccttgccgatggtataatggcctctggagtaattattggctgcatcttccttcccactgatcagctgctctgggtggaagagctgcctgtaggtccctgtgtgcacttcacctacaaagagaccacatgtgctgtgagtctttaaggcctactgtacaccaaggtgaacacgttccaggactgttcacttctacaaagtacatgctgttcaaagtacatgagctacatgttgtaggtcaacagtggcggtgtctggtagaaaatgtctctgtgataaccaatcacaaatgcaatttaaggccctaggaagttaaagtcagttcttgtataaatgtcagcacaggccgggcgcggtggctcacgcctgtaatcccagcactttgggaggccaaggcgggcggatcatgacgtcaggagatcgagaccatcctggctaacacggtgaaaacccatctctactaaaaatacaaaaacaaaattagctggacgtggtggcgggcgcctgtagtcccagctacttgggaggctgaggcaggaggacggcgtgaacccaggaggcggaggttgcagtgagccgagatcgtgccactgcactccagcctgggcaacagagcaagaatctttctctaaataaataaataaataaataaataaataaataaataaatacataaataaatgtcagcataaacagttcccagtgaagggaaataagctctcgcatcgtcccccagcactggtaattctacaggtacatacatctttcctacccttagctactacatcaaaggctgtaagttaaaaatctcttacaaactggacagtcaccaggtcagtgtgacttctgaagggcagtcccatcaacctgtgtggcctgggtcccacgtgctttcaggtgacattgtcacctcctgggggacactgaaaggtactatctctttgcagctctctttggaaactatctgggacttctaatctggatgaaggaaatggatgttctgtacttaccttctacgcctaagatgcacatcaagactcttcatgcaccagcatgagacagtgcacagcattcaggagggaatcaatgccccacaccctgcaggcagggccacctgtgcagggctgaggcagccacaggggaatctctccacagcccatcttactgctggcaaagcagcttttcccatacatcctaaattaggagctgagtctcacatacactaaacatgaaactttcagtttccgccctaacaatgccatgggcatttgcttgtctatcccatccattctgcagggggattcacaggagcgcacgtggggttttaccaatgctctcccactctcccaggaaagctgccatccagtgcccgaggacctatcaaccacagtgggctccaggtccacaaacactgctctgggcacgtgcttgccagccccaatctcactgaagaacatgttgaaggagtcatccccaccaccgatggttttgtcacttggcatttgaccgtcaggctgaattgcaagttcaaggcagtacagttcccagcgggcgttgcctatctggacacctgcctgccccacgtggatagagatactcactctgtgaaccagaacataaatgtgaacccgttcatttcaagacagtttgaaactctatggcatgcaaaatattctgtggtgacagaaaaaaaaaaagagaatgagaacaaagtgtgtctgcctatcagggttaaacctataaggaagaagctcttaaaaggggagaataacaaactaaaatagaagggagaaggtaaatagaagggagaaggctgagtgaggtggctgacacctgtaatcccttttcctttggaaagccaaggtgggaggattgctggagcccaggagttcaaagctacagtgagctgtgattgtgccactgcattccagcctgagtgacagagctcttaaaaaaaaaaaaagtttattattgccacatttaagaccttcagccctggagcggagattcaagttgctttgaatatacactcttaattagcagcagttacaaaatgctgtttttattttattttattttatttattttgtttttcattttgtttttcttttgtttttttatttttgttttttttttttgagacggagtctcgctctgtagctcaggctggagtgcagtggcaggatctcgactgactgcaacctccgcctcccaggttcaagcgattctcctgcctcaggctcctgagtagctgggaaaggcacgtgccaccatgcctggctaatttttatatttttagtagagacggcatttcaccatgttggtcaggctggtctcgagctcctgacctcgtgatccaccgcctcggcctcccaaagtgttgggattacaggcgtgagccgtcgtgcccagcctattttattttttgagacaacgtctcattctgttgcccaggctggagtgcagtggtgagatcatggctcactgcagccttgaacctcctcaggctcaggtgatcctcccacctcagcctcccgaatagctgggactacaggcatgtgccaccttgcccagctaattttttgtattttttgtagatacagggtttcaccatgttctcagggttggtctcaaacccctgggctcaggcgacctgcctgcttcagcctcccaaagtgctgggattacaggtgtgaacccctgcacctggccagagatgctgtttttaagagaaaagaagaggcagttcctaagtggtttaccaagaattgctcttttttaaaaaattgagatgggtctcactgaggctggtcttcaactcttggcctcaaacaatcctatcacttcagcttccctggccacaagaatttatattaaaacgacataagctattggttgtctatacattattctttgtatcataaattccagaaacaggaagataatgggttaagctagtcaggaacaaaatgcctttaaacaattgcccccgggcatggataagaaatatgttactgaagtcccatattcatttctttttcttttcattattataattattatttttttgttttgttttgttttgttttgagacagagtcttgctctgtcatccaggctggagtgcagtggcatgatctcggctcactgcaacctccacctctcgggctccagcgattctcctgcctcagcctcccaagtagctgggattacaggcatgcaccaccatacctggctaatttttgtatttttagaaaagatagggttttaccatgttggccaggctagtctcgaactcctgacctcaagtgattcacccacttcagcctcccaaagagctgggattacaggaatgagcctctgcacccagcatattattgttattattattttgagacagggtctcgctgtgtacccaggctggaatgcactggtatggtcatagctcactgcagcctcaacctcctgactcaggaccacaggtgtgtgccaccatgcccagctttttttttttttaagtttttgaggagacaaggatctcctgatgttgcccaggctggtctcaaaactcctggactaaagtgatcctcccaccttgggctcaccttggcctcctgagtctacaggcgtgagccatcatgccctgcctgaagtcccatattcatgtctccggacctgataaattctgcgtgcctcacatagctcaaagttctctgagctatttttatttttctcacttttttagtgagaaggggtgagtttctggctccttagtgagaaggagaggagacatatccctgctcaggaaagtgccgagttgggactcaatactccttttgaaagactttggaacaattatttgattcttcctttttttcttttttagacaggatttcactatgttgctcaagctgggctcaaattcccaggctcaaatgatcctcctgcctcagcgtcccttgtaggctgggcctacaggcaagcatgcatcaccatgcccagtttgatccttccattctttttttttttttttcgagacaggttcccactctctcaaccagactggagtgcagtggtgcaatcatggctcactgcagcttcaaactcccaggtttgagtgatcctcccacctcagcatcccaggtagctggaacgacaggcacatgccaccatgcccagctaatttttaaatgttttttgtagaaacgggggtctcacgatgctgcccaggctggtctggaactcctggcttcaagtgatcctcccatcttggcctcccaaatttctgggattataagcatgtgccagtgcgctgagcctgattcttcctttttttttttttttttttttttgagaccgagtcttgctctgtcacccagactggagtgcagtgaagtgagcttggctcactgcaacctccaccttctgtgttcaagtaactctcttgcctcagcctcccgagtggctgggattatagccgcccaccaccacacccggctaatttttgtatttttggtagagacggggtttcaccatgttagccaggatggtctcgatctcctgacctcgtgatccgcccgcctcggcctcccaaagtgctgggattatgggcgtgagccaccgcgcctggccatatttatacttttttaataccactaggctcaacccgtatgatattttttgcagcagctttcttgagatgtatttcacataccgcataaatcacccatttaaaatgtacaatcgagcggtttttagcgtattcatagagtcgcacatcaccacaatcaattttagaacacttttatcaccccccaaagaaatccacatcctttagccgtcaacctccaatacttccatttctctgcacctaggcaatgtataatctactttctgtctgtatagatttgcatactccggatgtttcacataaatgcggtcatgcgacacgtgatcttgtggctggcttctttcacttagcgccatgttttctagtttcacccgttttcagcatgtgtccgtccttttccttcttttcgaaacagttttattgagatgccgttcacataccatacggttcattcatgtaaagcatctgtaattcaattgcctttagaatatgcacagttacgtagccatcaccacaatacattttagaacattggtatcacctcaaattcctttttattgccaaataatattccactgtatggatataccacattgcatttatccactggtgggcattttcactcttagaatattataaataatgttgctatggatattcatgcacgagttcttgtggggacatatgtcttcatttctttcaagtatatacctaggaatggaaataatgggttatacggtaattctatgattaagcttttgaggaactgtcagacaagccatgtgattgactgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttaacatatccaaattttaattggccaatcccgttattggggacacttccaattttcattatgataaacagcatttccatgggcatcttttttttttttgagacagagttttgctcttgttgcccaggctagagtgcaatggtgagaactgcagcctccacctccaggattcaagcaattctcctgcctcagcctcctgagtagcggggattacaggtgtgcgccatcatgcctggctaattttgtatttttagtacagctggggtttcaccatgtttgtcaagctggtctcaaactcctgacctcaagggatccacccacctaggcctccaaaagggctgggattacaagtgtgagccaccgcgtccggccccatgagcatctttaggcatcaatcttttatacatctctggttatttctctagagcacattagtcaaatgattgtatcaaagggcacaggcagttttgaggctctcagtgcatgatgataaactgccttccaaaaaggctgtgcccgtttgcattctcaaaagtagagtgtgcacccctccttacattttaatagtttcctgaggtcaccagaacatgaacatggggagggcagggacttgcttgggcatcttggataccatgcccagttcaatgtgcagtacttagtaggggtttgtgtgacaggaatgagtgagagcacatgaaggcccagatgagtgcagggtccgtggggcacagaggagggtacaggtgtgtgagcaccgtgtggacttagcacacggctgacgtgaggactcagtgcagacacaagtggtaacaaggcctcgtgagtcaaagagctcctcaccctggaggtcaaagcagctgattggagatgaggaagccacactccaaggtcacttagggacagacgctggcagggctgatctgaagactggcagcaactcctttttatactccactctgcaagcgccagtctttatgcagagttctggaagaattcccctcactgagctagcaaggccatcaaactctgcgttcacctggatatcctaaggagacacccattacaaggatgaactttgttactatctgagaacttcaccatttttcactcacacacgcaaggtctcagagaagctccttcgggcagcttctcccctgtggatgacagtctcatacccgcaaactagtaagatccaggagagaaggggacaatgggggatgtttagaggcctgctgtatttatttatttagaaatgggatcgtactgtgtcaccaggctggagtgcagtggctcaatcatagctcacttcatccctgagctcctggactcaagctatctatcctcttgcttaagcctccagaatagcagggactacaggtgcccaccaccatgcccggctatgctgtatttccagatctgggggctggttacatagacacctatgctgtttgtgaaaattctccaagctctatgcttaatctttgtgcatttttcagcatagatgttgttcctcaattaaaaacaaaaaaccaaggggttgtgaagaacagaactggcactgatggagtccttctctgtgcaaggcctttcccttaggtctgtcatctcagcttatgttcatgatggccttgcggggtagacgttagccccatttcacaaaaacacaagtctgagcctagggaaagattttccttgaactataagtcttcaaaactatttccctcaaagctcagaataaaatctgggctagtcagattatactagtgataacagataacaacagttaaggaatagaagatagaatattcaattcaggctaattgtttttctttgtttttttgttttttgggtttttttgaggtagagtctcgctctgtcacccaggctggaatgcattggcatggtctcggctcactgaaacctccgctttctggttcaagcgattctcctgcctcagcctcccgagtagctgaggttacaggtgagcaccaccacatccagctaatttttcttctatcttttacaacacagagtttcactcttgttgctcaggctggagtgcaatggcacgatctcggctcactgcaacctctgcctctgggttctcctggaggtgattctcctgcctcagcctcctgagtagctgggattacaagtgcataccactatgcccggctaatttttgtatttttagtagagacagggtttcaccatgttggccagactgatctcgaactcctgacctcaggtgatctgcctgcctcggcctcccaaagttctgggattacaggcatgagctaccaactccggccaaatttttgtattattagtaaagacaggttttgccatgttggccagggtggtctcgaactcctgacctcaggtgatccacctgccttggcctcccgaggtcctggggttataggcgtgaaccatcatgcccatcccaggcttgttattgattgatcgtttatgattctttgactcagaatcttgtccaggatctcacattgatagacacaggatttggtcccaaccctgaactgattccaaagcccatggcattcccacaagactaggggcttctgataatgaccatacattgtgacaagtaagtgtatattcaggcaggataatgccatatgacattctatttcttttagaatgacagatccagtgctgacaggaattctcagagcagcaggcacatggttaaggcaagaacaggccattagaaggaaatggtaaggacgtttgacatcggttgtcccaaacctgaagaattgaaactacacagacacatttctggaaaggctttgactcaagtctgggttgaaaaaaatcagggttagaatcagcactgatttgtaactcaattttttttgtttccttccctttttttttgagacagaatctggccctgttccccaggttggagtgcagtggcacaatcatagctcactgaagccacaaactcctgggatcaggtgatcctcctgcttcagtcttctgagtacccgaaactacgggtatgtgccacatgcctggctaattttttaaaaagctttttgtagagatggggacctttctgtgttgcccaggatggtcttgaactctaggcttcaagggatcctcccacctcagcctcccaacatgctaagattataggtgtgagccatctcacctggcactttttctacattaaaaaaatcaaaattcgccaggcgcaatggatcatgcctgtaatcccagcacttggaaggccgaggtgggtggatcacctgaggtcaggagttcgagaccagcctggccaacctggtgaaaccccatctctactaaaaaaaataccaaaaaaaaaaaaaaaatcagccgggcgtggtggcacacatctgtaatcctggctactcaggaggctgaggtagaagaattgcctgaatctgggagccggaagttgcagagagccaatatagcaccactgcactccagcctgggcgacagagtgagactctgtctcaaaaaaaaaaaaaaaatcaaaattgacccaagacatgagagaccatggcacaggatcacttgaggtcagaagtttgcaaccagcctgggcaacatagcaagcccccatctctaaaaactttagccaggtatggtgacctgtacctgtacttccagctgcttggggagcttagacaggagaaccacttgagccaaggaatttgagactgcagtgagctacgatcacaccactgcactgcaactgggtgacagagtgagaccctgactcaaaaaaaaagtggcaaaattgaatgaaaagggatcctaatctctctcacagccactcaagtgaagcttccagcaccacagtccacctgcagacagtcaggggaggggcagagggcagccttgcaggtgctgcgcctgcagatcgaaacctcagtggatagggagcatcatgcccagacctccacttatcctctctcagccaatgaagaacccaggcaggtgccccaggtgagatcccgtggaaccagcagtctggagcgggcagagctgagtggccccatgcctgcattcaagtcccgttgcaactctgcttctgccacgctgtgtaactgggcagggctcttgatttctgtaaccctcactttcttcttctaaaattatgatacctcacagggctgctgggaggatcagaaacgaggtttataaaatgctcttactgagaaatccagcagttccagggcagaggctggattgtcctggacagacttgaggagaccaaagcagccttcacttcgcatgggattcctggacacctgagaaacacgcacacaaagctgcgagaagccaggtccgggaaggccagagagcaatgtgaaagggaaggaggggctcctcatctctgaggacacagccactatggccacactgtttcggctcagaaggtgtctccatcagatagtcagacagaatgctctggtgaggctgctgggtcagggaagaaaggaagggagaggcctccgattgatatagacacacaagacacacccttgcctttaagaacttgcctgctggggagaggggagggaaaggaagcatcatgaaatgtggtgtgatcagcgcagtgagtgagtgtgcaccagctcccctgggagggaaaggctgggaggggaggtgtatctgggcagggctcagcggagcttcccaggtgaggtggccggagctggacacttcagcaagaacagcagaggaacaaaggcaggggtgaaaaatagtaccgtgtgtgtgtgtgtgtgtgtgtgtgtgtgtgtgtgtgtgtgtgtgctccaagcttggggtgagagcactgaacttggaagagaggggctggcagagcccagatcccccatgacatgctatgttactttttttttttttttgagacagagtcttgctctgtcatccagactggagtgcagtggtgagatctcagctcactgcaaccttcacctcctgggttcaaaggatcctcctgcctcagcctccagagtagctgggattataggtgtgcatcaccacatctggctcatctttttgttttcagtagagacagggtttcaccatgttggtcagtctgggctcaaactcctgacctcaagcgatctgcctgcctcagcctcccgaagtgctgggattattggcgtgagccaccacacctagctccgcatgacatgatgcactcaaagcttgggtttatccagaggggataaaactccaacagttttaaagcagggcatgtttctggtcctgggtagcagctgggaagaaagaaccgcagccaggaatcccgcaagttcacagaagctaagagaggaagtcagaagagggaggagtcagcagggtgagcccctgcagaaggtgggagggagggtgtggaaaagggaggggcaggcaggctctgggccccagctggtgacttgggaagaaggaagaaggagccccccaccaggaggtggcccttagaggggggtatgcgttcaggttggactctcacattcccacgtgtctttgggacatttagaggactgtctacgaggtgactcgaaacgcaggtctatgcttcagagaggtccaggttcctgtgaggcaggaagcaggggaggagagctatgggagaagcccagtaaggctagggtggggagctgagggccgacagagctggatgtccatacccagctggcaatactgtcccccagcacgtacctgctgtgggcacagtggtcccctggggacctgctcccggcttgcctccctcctgtgtctgtcttctgctccctgtcctgctcagcactccctccccacctgcaaacccaggggaaggaaccccagctgggaacaccaggcctcaggtgggcctgagcagtggccaacagaacacctgggtggggcctgggtctcagcaaggccagaggaaaggcaggggagaagatgagggagacacaaggggtgcccagccaccttcagcagagcagcaccccagcccacagaggaggaagggcagcaagaagatgtgggagagaggctgggagggatgaaggggagaagaggagggccaggccccagattcagggtgagtggcaagggagtgagccagcctgtgtgcacctgcctgctgcccctgggtgggggctgtgggggagggatctgtgtggactgttacagggcaggtctgtgctggtgtctcagtcatcaggctagcactcactacaagaatcctcagcgtctggttgacccggaggcccaggcccaggctcagggctcccatcgcagagatgcggttgttactgcaacaaaaacaacaggcacatgcattgtgcaaccttccaagcagcggtgcagagcccactgccccagggtgcccactggagctgccattgcagccaccaggttgggtctcttgttccctccactcacaccccaggaaccctggacagatcaacaggtaaaaggtggagatgacaccgttcagaggaatcacacggcaaacacacctaaagcgtccctgtcctggtggacaccagctgccgctcctctgagctctgcaagtgctcccacatattctgccccagctgacacctcatgcctatcaccattacaacgcctgttccagaaaatcacctagcttatgttcaaggcctctcctcctcctgccgttcccaaactccagtcctcagcaccgccctggaccactttgtctccggagtcagtcccgcttctctctgacttctcagaccccagctctggctgcacctccgtattcagcctccgcggctgcctccagtcttagctcctcccatggggaggaaagctgggcaggattgagtggggccttcttgcccacagggagctgcccctggggagggtctcagccacagcagcccatgacctccctggcctctggcccgtgacctccctggcatccgcctcttttcttccctctgggcttgtgcctcctggctaggctgggacgctgcctggcctggaggagcccctcacacagggcatgctccagtagccacatgctgagcaaaacaggcactggggcccacttgtcagggtcctgccttgccccacccagactaggctcgttttactcgctctgttgcaatgcagcctgaaatcctgaatcctcggctcaagcaatcttcctgcctcagcctcccaagtaccaggaatgataggtgtatgccaccggaaatggacaatttttagatttcgcatagagatggagtcatgctatattgcctagcctggtctcaaaatcctgtccttaatggatcctcccgcctcagccttcctaggtgctaagattacagttgtgagccacagaacctggccctggctcgtcttctgcaagggaggaaagcttgcatggagcacccaccatgcaccaggctctgccggagatgctttatacaccgtgtgcaattcgcagccatccgcctgtgctataggaatcacaggtctctatgtaacaacgatgaactccccatgactgtaattccagcactttgggaggctgaggcaggaagactgcttcagcccaagagttcaaggccagcaggagactgtctctacaaaaaagaaaaaattagccaggcttggtgacatactcctgtagtcccagctacttgggaggctgaggtggtgggattgcttgagctgggaaggccaaggctgcagtgggccatgatcacagcactgcactctaccctgggcaataaagcaagatgctgttttaaataaataaataaaattataaactccagtgataaggatgacagagctgctctgggattgtggctcaagccccatcacgggaatccccatcacgggtagactgtgtgcttcagcagcaagatcatggagcccatgattcctggggtgtccccccggggatcctcacctcatgttgagttcctccaacacgttgttggccttcagagcctcacccaccgcagaggctccaggatccccaaagccattgtatgagatgtctagaactttaaggaagatgtttgcctagaataccaaagagtgaagtcatgggaccccatctgacagtggagcaagccagggtgccacagcctcagagaccaggagccctgaggtgcaaagataagagataaagggcagaaggggagaggctccaaggaagggtcaggaaagtgccatgcagaccccctggtggctgcagcttggatgatggtggtcaacagagcccagtggcccagagcacaacaggaaaggaccggtgtagacgtgaatggccctcagagagactgggaggggcgtgtgcagagcagcagcaggccccagaaacattgatcggactccacacccacttaatggctctagagggcagggatcccaagatccagtgaacagctgttggatgaaacctgtccagcgtactgtgatggggagaagggtaggtgctctggcaagacagagtgtgacatgccatcttgtggggcaggaccccaaggtcagcccctgcatcagggcaagacagcagctgccatggcctgaggagggccccacagggtatctggcactggggacattgcagacaccttgtaccaccctagcaccagcttgagccacccattcccgagccctatgaaccacaacatggaagggaacaggtgggtgtttgagaggctgtgctggcatccaagggtgcaaggtgtcatctcaggaaaccacctgcgtatgcccaacagtgagcatgtgtcaccagactgcacagatgtcccttcccagctgggtgtctatggtgtctggggaaggtgcaagatattcaacagtgacccttcaggaaagtatgtgacggtgagcacagtgtattgtggtcactaagtgaagccaggaaaattaaaatcacctaaagaaacagtctttaagctgtgcttaaaagatccaaggttcatttccgaggagctgcagagacagggaggtggcccctgggagacaggccccagcagacaggctgtagggccgactaggtgggggcttcatacctccagtcccctggcaaatgccacagctcctgggccccggaggtgattccagctcacgttaagctcggtgagtcctgtgttttctgccagggctggtccaagtgtctccccttcagaaacaccaagagagaccttctgactcactctcttcactccttcaaaagatcacactgatgcccactgcgtgccgagcctctgctgggcaggagggtcacagacatgaaactaatgtgggcctgcggtgcccttaaggaactcacatttcatgggggagatacaaatgcaaatgtatgggatgtgagctattcatttagactaaaagggggaggcgtgagaacagagtggtggccagcctgtcttgggggaagtcaggaaagaggacagaggagataactcaggactgaggaattccccaggggtgtgtgcatgcacagtggggaggagacacaggaaactgcaaatggcaggggcacctgtggaaatgcacacaggcttatgcacagtggggaggagacacaggaaactgcaaatggcagaggcacctgtggaaatgcacgcaggcttggagctgggcctggggagggggaagccagtgaggtgaggaaggagtaatgggcacttgagagatgctgaggggccttgtgtgccaagccaaggggcttaggcagcacatacaagtggcaaggagtcagggagggccttaggaagtgatgaggctggattagcatttcagcaagtggcaggtgtccaggatagactgggctgggtgggggcagaggcaagaggctgggggaccagatggaaggctggtgccataggctaggcaagaggcaacagggctggcacagctgtggtagagaggagatgggggtggtagagaaaggaaggtgaaagccaggcagtggtgtgagcctgtggtcccagcgactcaggaggctgaggcagaaggatttcttggcgccaggagttcaagaccagcctgggcaaaatagcgagacctagagatgaaggcggagcaacatggccgaacagaaccctccagcggtcatcctacaaccctcacaggaacaccaaagcgaacatttatacacacaagaaagcgcctgcagaagagccagaaaccagctgcacatcacagtacctgcttttaacatcataacagggaaacaggcactaaagaggaaagaaagtattttttgttgttgttaagacacggtctcaccctgttgcccaacccggagtgcagtgggacaatcacggctcactgcagccttgacatcttgggctcaagcaattctcccacctcagcctcctgactgagactacaggcacatgtcaccacttggggctaattttttttttttttttttttttttttgagacggagtctcgctctgttgcccggggctaatttttttaatcatttgttgtcaccactggggctccctatgttgcccagtttggtttctaactcctggcctcaagcaatcttcgcccctcagcctcccgaagtggtgttggcattacagataggcacagtgccttgccaagtctcacttttttttttttttttttttttttgagacagagtctcgctctttcgcccaggccggactgcagtggtgctatctcggctcactgcaagctccgcctcctgggttcatgccattctcctgcctcagcctcccatgtagctgggactacaggcgcctgccaccacactcggctaattttttgtatttttagtagagacggcatttcaccgtgttatccaggatggtctcgatctcctgacctcatgatccacctgccttggcctcccaaagtgctgggattacaggcgtgagccaccgggcccggccacctcacttaatttcactgacttcttgcaataattttcttagaaggcaaactggttctctggcagttatatgccagaggcaattctcacaggccaaggctgatgtcaccccacttgctctaagcagctggagacagaggagtgcttctgaaaaacaattctcggccaggcgcggtggcccacacctgtaatcgcagcactttgggaggccaaggcgggcggatcacaaggtcaggagttcgagaccagcctgaccaacacggtgaaaccccatctctactaaaaatagaaaaattagccaggccttgtcgcacgcacctgtaatcccagctactcaggaggctgaggcaggagaattgcttggacctgggaggcagaggctgcagtgagcagagatcacaccattgcactccagcctgggtgacagagcgagactctgtctcaaaaaataaaaaataaaaagacgattctcctggggcaaccattaaaatacagattcaccagcattcccctaagagtttggttcagcaggtccagggtcagcatctgcatgcctaacccagggtctcaggtgatccttaccattattggaccatttgaggagaggcaggtagaagtgcaaattcctggcaaagcagacagctcctgaatatgctcaggggcatgacagtgatgagatcaaggaatcccaatcacatccgctacctcacttgaaacaaaatcttcaccgtttttgccacggcctacagccctgcagccccctctgccctctccaccccacagcctggccacgcttccctggctccctagcctaggcacactgctgtccgccagtctgggaaacaggcccgcatgctcactattcctctgcttgcaatgctctccctctgatcttgccatggctgactccttcccaccctgcacatttcagcttaaatgtcacctcacagaggcctccccagccacctctttaaagtagggggtccctgttcttctctagaatcataaactatttgtttcttttgtagcaccaataattactcagaatgatgttgttaacattgtcccttgaggtcaggaacttggttttgttcaaggtggatccctggtggctaagtcagtgcccagcacatacagcagcgcgcaatgagatatttgtggaaggaatgaagagttccgtgtggctggagtggaagaggagtggggcaaggtggggtgtggggagcaggaaccagagcacatgctccctggcgatgtgcagcgcggtcctgccaacccccacccatccctgccccaggaagctgagctttcatggccatggtgccctgcgcaggcgttacctgcttggtcattcagctggttgtagctcaggtccagggacttcaggtctgtgtgggccagcaggagttcggcaaggtgctgggccgcctgctcctccaggccattccctgacagctgcatcttccgcatggcctggttcactgtgagggcggcacagagggcctgggctcctgccactcccagctggttctccgacaggtccacatctgggggacagaaccactcctcggccagtgggatgcaaagccaggcactcccctacttctgccatcccccaaacctccaggtctgaggctgaggaaggggacttacaggttaactgtcctggggttgcatggtggctctggctcccaatggctgggtcccctctgcccctgacctccccctccctgtgtgcccaccagcttctgtgtcaagtggttaaaaccgcctacctcctggtactgtagagactgctgtggtggggggcagctataccgtcgatggctgcatctggcagtgatatcaccacccacttcagaagccctcacagccccgttgccaggattggcaataatagcccaagtggccatgcatggagcacgtacatgggtcacacactcttctgaccacttcaggagtgcatttcacttcatgctcaccacagccccaagcccataaggtattttgggggccatttcacagatcagaaactgaagctcagagaggttaagctgcttgcccaggtatccagctcttcagtggcagaactggcatttggatccagccccatcaaactcccacattgcctacctgcttcttacaatgcccaactcccacctctctgtgtggaaggactctcccatcctgcattcaggtactgggagtctcccatgtgctaggtgaagagggggatgctggccagcaagggaggggagtgatggtgtggggtgggtgaggaaaggacttctatcaggcatcggctgcacagcagagggtctaactccaccccacatgccccctcctgtgatgaggcccctcttctatccaccagcaacaccagcaggccccaggtgacacggcccagctttcaacgatggaggcacatccctgaggaaaaggaggacacgcctgcccacctgccccagacccagcacctaccatggatgctgctgcttttgctcagggcacctgccagggcctctgcacctgccccacagagcccattgtctcgaaggtccagccgcttgacatatggattggagctcaatgaggaagccagagcccgggcgccctgggacagacagagcaaacacactggccactatcctggctcatgctccagggctcagcccactccacatcctccagctggaaagccctccccttcccacctgttttaagtgacacctgcttctccttttaggctctgtgaaggtctccccccacccccagctctccctgaccccccagcgggttaggagcctgcaggatccacaacccttaacgccacctgtcacagcctcaatcccatctgtctcccagatgtggagggtagggcatgactgacacaggcagaagctggggagtgtaggggacagacacaggggcactcccatggctgctgtctcccgaggcctctccccgtaagcctggatacagtgtccctccagtggtacctggggccccaggccacggtgccggaggttcagctcttgggcgctcccttggcgcagaaagcaggagatgggcacaacactatgggcccggcaagacctcaggtacagtgtgtccctgaccagttctccaagcccatcggtgcctggcaggagacagggggacgaatgtggaccctgcacagctacagccacctgtgtcctcccctgccctgtgtcactacctggcctatgttttgcctctagaagcactgcttcctgtgcttcttgggaccactgctcccatatgacagatgaggacatcaagcctcaggcaacgcaaatcttttccttaaagtcatacggctatcaaaagaaagctggacaacctgggcaacatagctagacaaattttctttttttttttttcgagacagactcttgctctgtcacccaggctggaatgcagtggcacgatctcggctcactgaaacctctgcctcccaggttcaagcaattctcctgcctcagcctcccgagtagctgggattacaggcgcccaccaccacactgggctagttttttgtattttcagtagagacggggtttcaccatgttggccaggctggtctcgaactcctgacctcaggtgatctgcctgcctgggcctcccaaagtgctgtgattacaggcgtgagccaccccacccagccaaaaaatttttatattagccagacgtggtggtctcctgtagtcccagctactcaggaggctgaggcagaaggctcactagagtgcagagttcaaggctgcagtgagctattatcctgccactgcactgacgcccgggtgacagagcaagaccctggctctaataaataaataatttatttatatatttatttattaataaatatgagcccaagcaacccaatgttgtttgtagtagaagtcatggctggcctgcgctgagcatcccacagctagtggtggtagctaatcctgccagagtcaggcctctgcctgtctgatgccaaattgcatgctgtgtcttttaacctggattgcaggccacaaatgttttgtaaacattttacgggagaaaaaaccgagatagttctaaattccatacatccattagcttagtttttcctgtggattgggaaaacccggctctgatttcatttcagggtgggacagcccttggtgcactgtctggcgggattttgcattttatcctgatgcttccaggagcaatgaagggaaggcagggggctggaggcgccccgcaggcgggtacgttccctgctggccttagccccagcccgcctcccccaacccctgcgggagaagacccccaaaggggaggagtcgggcctgccccctcccccgagcaccttccgtctccaggtcggagtcccaattggcctcgggaccctgctcggcctcggggacccctgaaagacgcccacaggccaccatagcctcttctttctgctcttcatcctccccagacctctcacaggaacccctcatggttacgaccctctcgcagtctcagacactgagtcggagacagcttgaccccgcgcccagagcgcggcccgggattgtgggcggagtctgcggctgcgctgaccaaccgaatgtgccgtccagcaacaggcaccccccacagccaatagcgacgcgctctcccgcggcggtcgccccggcaacccggtgttgtcggttgccgtagaaactgtggccggcttgtgctgaggctcctcgcccgggctgatacactgcatgcgccacagaccatgcaccggattgggcgccttgctgcgtttatccccctgcctcccctaggcggttccagcatcgcccccctttcatggaatgggaaacatgcctgactccagagcttgtgttttcttcactgcacttgggaatggcttttcaggagggcctggggaacttcgcagagccaggtcaccctctcactctgtggctctcagttctcttgcatgcgctggcctttgcatacgctgttcgctcccctgggaacctccatccccatctttgtctgcttgttgaacttcagaatctgcaagcgtcagctcagaagtcacttattcctgaagctttactcagagcccccccggggctgttgctgccctcaggccgtcttctcacagcactgataacagctgtccttccccatcctctcaccacgtccactcccaccggaggaagtgaggccagagggcagggacagagctgctgttttctgtgtgccaccagggcccagcaaagagaatgtagggagggtgggaggtgcagggcagctggggttaggggctgaaggctgggtgttggaggctggatcctgctttagtggaagtgtccctttaacagcggctggcgtggcctggctcgggccctgctttgcctcctgttcagctgcggctgcagctgccatgctgactcatgtgcccgcagctagcaggagctggcagcatgggctccccaggggccacagcagactaggggcttctggattataaaacggagaagtatgtgatgaccaggaactggtgggggggcgccctgcagaggctgctgcagtttgggatcgtcgtctatgtggtagggtaagagagaagagcttttggccaggctggaggggcaagggaagaggtcgggggtggggcttggtcctgctgggttgaagttgagggttgggctgtttaggggctggaggggaaggggccataatgggacggggtgggaggtaggcaatacaagacaggagagcaagaacaagctgtgtgtttgtcctgtgtgtccacctgcctgcttcccagtccctccccacggccccacccagggggcacaagacattgtccttaacatctgtgagagctggagcactaggcccccagagagaccaccagctatatctccggtcaggggagtctataagctcggagctgggtctactgaggctgggggtgggtgctggctagtgaaggtgattgtctgagggcactggctctctgatgcatggctggagcttctgtctcgttcagggagtctacagtgggaagtggggccagagaggatgctggactgggagcctgtagggtgtggggagagaactgagcatgtagggcccagctctgccccgtcactacacgctggggggacaccacactgcccatcttctccttcccaggtgggcgctcctcgccaaaaaaggctaccaggagcgggacctggaaccccagatttccatcacaaccaaactcaaaggggtttccgtgactcagatcaaggagcttggaaaccggctgtgggatgtggccgacttcgtgaagccacctcaggtgggggccctgatgttgctgacgggggcgcaagtcctttccccactgacagcttgaacacccgccatgcagccagtgtgtgcgagagagaagcatgtgatgccaaaggtggctgcaggttctcaggaagggcttcacagaggagtggcacctgaacaggactttcagggatgtgtaggaggtttctggtagaaaaagggatgggttgagaaaccaggccagagaaactgcatttccgaaggctgccaacagaaaagaagggagtgtttgagactaatggcttgagcttgagagtggtgtgggaggggtgtggtggggccagggcgtggaacttcctgtagccctgctccctgacctggggcacctcggtcaggtgctcctcctccacccttctcagctgcattttcctcttccctccacccagcttatccacagccttaacttccacccacctctgctcctctgattcccagggtgtatgtagccccagtgaacacctgcccagagcacagctgtcttccaggtgcacactcatatgtccaaagatcaattatttccctctcctggcatggcctctgtgacatccactagtcatgatggctgtgacatccactagtgcctcagccagacccatgactcagcctcaaccccttcctgtcccttccaacatttttcactactgcccatgccatgcctgcatgagactatggcctcctagaaggcccttagatgcccctctcgcctcctccctactgcttggtgcacaccacacagcagccaagctgaactttcacaccaggcatcatgagagcctgcagcccctgtttctaccctcaggaggccccccgccaatgatagtggccacccatccctcctaatcccaatggctgccactctcagcaccctctgcacagccctcaccttccgttcctgggcatgcattccccaaattcagtgttctcatgggcagcactggagggtcagcctccccttccaacatccttggccaccctttgaccacaggcagagctttctgtcttctcacctgtgccctgccatgccagtgctgctgtgtgtgggatgggagactcacctccactccatcctggcaggtgcagggcccagctctcccctggatcttcagtactagaagcagcaggctgtcgtaatattctggttgacgccaggcatggtagttacagcctatagtcccagctacttgggaggctgaggcaggaagatctcttgagcccaggagttacaggatgcagtaagggttgatgacaccactgcactccagcctggacgagtaaagtgaaactctgtgcgcctgtaatcccagctactcaggaggctgaggcaggagaatcctttgaacccaggaggcagaggttgcagtgaaccgagttcatgccactgcactccagtctgggtgacagtgagactctgtctcaaaaaaaaaaataaagaagaaagaaaataaaagatattttggttgaacaaatgagaaagaaacttgtctcaagagatggacatgggcatgaggcttcatggtctcagaaatggccagaactgctgccagcctcccatctctgcttcaatctgccttacgtggggacagggttaatgatttcatggggccaacatcccttccctcataaaccaggctgccggcttctggcctttccagtcaatgcaagcccagccaggccaactttgagacttgcctcctagggagagaacgtgttcttcttggtgaccaacttccttgtgacgccagcccaagatcagggcagatgcccagaggtgagtttgcccaggatactcccagcgggcccctcattcctccatcagccccaggtggccacccgtgtttccctttatccttcccaggtggctgaaggctcagcatgtgcttagtgtcccccaggcactgggctacatctttgtgtgaatcatttcgttcagtcttcacatatcccctgcctggcaggaattcctgtgatccccatttcagaggcaaagagtgaggctcagtgaggttgaatcacttacttaaggcctcccaggctgtgggtgacagaaacccgagctctggctagcaatgagtcagtcaaaaataaaaattaaaacagtaaaaaattatttatagctgggcacagtggctcccacctgtaatcccagcactttgggaggccaggacaggaggttgcttgaggcccagaatttgagaccagcctgggcaacatagcaagactccactctacaagaaaatttttctaaaaatttgccaggcattgccccagctactcaggatactggggcaagaggagttcaaggctgcagtgagctacagtcccactactatactttagcctgggcaatggagcaacacccagtctcaaaaaataataataataacttatttacaaattttttcccacttgcatttatataagtttagtttatttaacaattatatctgaattgtgaaaacttcatgaaacattagacaaagctagttattatcttaagttttattttgctggcaatttttatgacatatatattaggcaaatatcaaacattattgaagtaaagcacctaaaatgttaaacattcaacactttttttaatctcagactagcatactgggggttgttctagttaattcctcagattcttttattttattttattttatttttttgagatggagcctggctctgttgtacaggccggagtgcaatggcatgatctcagctcactgcaacctccgcctcccgagtggttccagtaattctctcctgcctcagcctcccaagtagctgggattacaggtgcatgccaccacacctggctaacttttttaatatatatttttcatagagacagggtttcatcatgttggccaggctggtttcgaactcctgacctcaagcgatccgcccaccttgacctcccaaagtgctaggattacaggcatgagccactgcacccagccaattcctcagatacttaagtttttttttgtttttgtttttgttttttttttgagatggtgtcttgtcctgtcacccaggctggagtgcagtggtgcaatctcggctcactgcaagctccgcctcccgggttcacgccattctgctgtctcagcctccccagcagatggataatttttatatatatatatttttagtagagacagggtttcaccatgttggccaagctggtttcaaactcctgacctcaagcgatctgcgcaccttgacctcccaaagtgctaggattacaggcgtgagctactgtgcccagcccagttcctcagatacttaagtttgtgttttttgttttttgttttttgttttttttgagacagagtcttgctctgtcacccaggttggagtgcagtggcgcgatctcggctcactgcaagctccgcctcccggattcacgccattctgctgtctcagccttcccagcagatgggactacaggcgcacgccgccacacctggctaatttttttgtatttttagtagagacggggtttcaccgtgttagccaggatggtctcgatctcctgacctcgtgatccgcctgcctcagcctcccaaagtgctgggattacaggcttgagccactgtgcctggcccttaagttttaaagatatgataagactggcgacagagcaagaaaactgagaaagaatgtagattttctccaaggagtttcagagcatattttttgttatcagagatctagggtaatttttatggtttctttttcctaagagtacgatagtccagtagacttttttgtggtttcggcctaaacatgggaatgcctggagctgatgagatttgattacagagccccaggaagtaggaggaattgtaaggtacagtgaagcaagcctggctgctcattcccagagcctgtgttaggtctattttctggctatcagtatatacatgtcacctgtatatcttgggcctggaaaacaggctggggtgctttctgtgaattttataggaaaagagaagttaaagtaggcagctgggcattgaaaggatatttggagaagttttaggtctaaaagaaatttgctaaggagaatagggccaagttttgaggagggtaagtgtaagtcaggggcccagatatccgaaagaccttctgggggatcagggacagggacttgggggttgagcagagcacaggtgggtggaggaggataatttacagagggtgcagatttcaactttttttctacatctgatttctgttctttaatattgaggaagattaaaggaagtccctaaagctaaccatatttattttattttatttttttttttgagatagagtctggctctgtcacccaggctggagtgcaatggcatgatctcggctcactgcaaactcagcctcctgggttcaagtgattctcctgcctcagcctcctgagtagttgggactacaagcgcacgccaccacgcccggctaatttttgtatgtttagtagagatggggtttcaacattttggccaggatggcttcgatctcttgatctcatgatccacccaccttggcctcccaaagtgctggaattacaggcatgagccaccgtgcctggcctatatttctttgtgtcttctttttaatttgatatttctctagttaccaataggacggttgtttgggatgaaagcacccttttttgtggggggggacggtttacagatggggtctcactgtgttgcccaggctggagtgcagtagtggcaagatcatagctcactgcagctcaacctcctgggctcaagcgatcctcccacctcagtctcccacaaggttgagattacaggtgtgagccaccacacctggccaatagcacgctttaataaaaatacttttaggctgggcacagtggctcatgcctgtaatcccagcactttgggaagctgaggcaggcagatcatgaggtcaggagttcgataccagcctggccaacatggtgaaaccccgtctctactaaaaatacaaaaaattagccaggcatggtggcagatgcctgtaataccagctactcgggaggctgaggcaggagaatcacttgaatccacgaaacagaggttgcagtgagccaagactgcaccactgcactccagcttgggcaacagagcggaactctgtcttaaaaaaaaaaaaaaaaaaagcttttagattcaaaagtccaaatcttcaatgttatacctactttaattgtgactcaaaaccaataagcctttttatggcttaaaatcagtatgccttttctggcttaactggaggcacagaagagcatcccaaacaggctggaaaagatacaatccccctcaagatccaaagtctttttcaagatagcctaagcaggcaaatatcctaattgttatcaaggcaatgaaagctgagacaagtaggacaaactcctctgagagctggaaccgttggacagagacactgtgtttctgattcctgggcagctggctagcagcctaacaaggacttgtcctcccaacccctgcagctggcagaaaccaaagagaatatttcaattggtcacagagccatgttctcaagacataaaacaagatatgataaaccacacaacagagacatggaaaacaagccttatttctgggaggctgtgggtcaatagccactatgtatgcagagccaaataccaaattcggaagtgtgaaatcaaataattcttttttttttttttttgagacaaggtctccctctgtcacccaggctggagtgcagtgctgcaatcatggctcactacagcctcaaactcccaggatcatgcaatcctcccacctcagcctcctgagtagctgggactacaggtgcccgccaccatgccgggctaatttttgtatacttagtagagacggggtttcgctgtgttggccaggctggtctcaaactcctttcttaagttatccagccacctcagcttcccaaagtgctgggattacaggcgtgagccaccaccaagctgttggaactttacattattatgagcctcaggaggaatgtggccatgtggcctgaggcatggagcatgcagttgcaacttctgcttttccctgtaaatggttagaaatgtctgagcagcatcagagataagatgacctcagagcttgacttcttctcacagaatgttgaaacaattttccttggaatgtagcaagctgtactaatggaatctaacatactggatttgtacagaagatgttgcaatcctgctgacactgtttctgcctctatgagtgaaaccttagcttccccactttggagcaatgaccccaaccctttggaagctgtttcctgggtgtccatcctcaagctttgcactagaataaaaatcatatttcctttggttttttttgtttttgttttttggagactaggtctgtgtcacccagactggaatgcagtgatgtaattatagctcactgcagcctccaactcctgggttcaagtgatccttccaccttggcctcccaaagtgctgggattacaagcataagccaacgtgcctagctgatattttctgaatctcattatttaaggttgacataagagtcataactcaaagaatcaattcttaccatgcttttctcctgccagtttgaatttagaaagggacaaggaaaaattttactctcctctttcaaccaggcattacagacagagatccagaagagttcactttgggctgggcgcagtggctcatgcctgtaatcccagcactttgggaggccgaggcaggcggatcacgaggtcaggagattgagaccatcctggctaacacggtgaaaccccgtctctaccaaaaatacaaaaaaaaattagccgggcgtggtggcgggtgcctgtagtcccagctacgtgtgaggctgaggcaggagaatggcgtgaacccaggaggcagagcttgcagtgagccgagatcgtgccactgcactccagcctgggctacagagcgagactccgtctcaaaaaaaaaaaaagagttcactttggtaagaattcctacctgtgcccgcttttatttgttctcccaggatcccatctttaggcttgagaggatcccatccttgtcaccagaaactgtaggggtggcaaaactccacttccatccctagagtctcagctgggcccaagaattaaattgacataggacaggttaacagaagaaaagcacataaatttatttatatgctattctacatctgatttctgttctttaatcttgcgaacagagtccctaaggctagccattatatttatttataaataaggggtgctggagtgcagtggtgagatcacagctcattgcagcctcaaactcctgggctcaagctatcctcccacctcagcctcctgagtagctggaactgcaggtacatgccacccaccacaccaatctaattaaaaaaaaaaagtgttgaaccgggatctcactatattgcccagactggtcttgaactcctggactcaagcaagcccccctcggcctcccaaagcactgggatcacaggagtgagccaccacacagtcccacaaatttattgagtacaagttttacatgggttgggaaccctcataaggacatttgaagacccaaagaagaagttagagtctgttacttatacactgaattggacaaataataataagttatgaagaggcaactaaattatatggggaggcttaaaagataacagtgttttaacaaggtctgtatagaattctctcatttcaacttctcatccttgaagataagaatgttgcatctttcacatggcaacttcatctcctgcattttagaaatagcacaggcctggttgggtggctcacgcttgtaatcccagcacattggggaggttgaagcaggtgtatcacttgaggaaatgagtttgagactaacctggccaacatgggaaaaccccatttctactaaaaatacaaaatttagcctggtgtgacagtgcacgcctgcagtccccagccattcgggaggctgagacatgagaatcgtttgaatcctgaaggcagaggctacagtgagccaagatcactccacttcactccagcctgggcgacagagtgagactctgtctcaaaaataaaaaataaaattaaaacgagctattcagccatgaaaagtcatagaggaatctcaaatgcatattattaagggaaagaagcctgaaaaggcaatatactctataatcccaactatataagattctgcaaaagtaagactagactatggagacaggaaaaagatcggtggttgccaggtgttagcagggagggacaggcagagcacagagggtttttagggcaatgaaactactgtgtgtgatacaataatggtgtgtctatgtgtcattacacatttgtccaaacccatagaatgtacaaccggaagaatgaaccctaatgtaaactatagaccttgggtgataatgatgtgtcaatgtaggttaatcgattgtaacaaatatgcccctttggtgctggatgtcagtagtgggagagggggctacacgtgtgtgggagcagaagtatatgggaactgtactttctgctcaatattgctgtgaacataaaactgctctgaaaactcaactttttttttttttagatacagggtcttgctatgttgcccaggctggagtgaagaggctattcacaggtatgatcaagctcactgcagccttgagcctcctaggctcaagccatcctcccaactcagccttctgagtaactgagactacaggcgtgtaccaccattcccagctaataaagtctatttttaaaaaatcacttgacgataaatgtaactgtttatttgtggactgtcaattctattccgttcatctatgtgtctactcttatgtcaccaccacaatcttgattacagtcattttgcaatcagtttagaaatcaggaattgtaagtcctccaaaactttttcaaaagtattttgactattctggatcccttgcatttccacatgaattttgatgatttttgcaaaacaggtagttgggatttcaataggaattgcactcaatctatgcaacccctgaatctgtagaccagtttggggaatactgccattttatatttaaagtcttacagtctatgaacatgggatgtctttccatttatttatgttgcctttaatttctttctttacttttttcttttttttttgagacagggtctgactatcacccaagctggagtgcagtggcacaaacatgcctcactgcaacctcaacctcccaggctcaagaaatccttccacctcaacaccacccccgactcccagtagctgagaccacaggcacatgccaccatgcccatataatttttttacctttccgtagaggtgaggtctccctatgttacccaggcaaaatacccaagtattttggctattctggatcccttgcatttccatatgaattttttgttttttgttttttatttttttttgagacagagtcttgctctgtcacccacgctggagtgcaatggcgccatctcagctcattgcaacctctgcctcccgggttcaagcgattctcctgcctcagcctcccaagtagctgcgattacaggcacccaccacttattttaatttatttatttagtagttttggagacagggtcttgctttgccacctaggctgaagtgcagtgacaggatcatagctcactgcagcctcagactcctgggttcaagtgatcctctcacctcagcctcccaaagtgatgggattaccggtgtgagccactgggcctagccaaatactgtatttttgatcgacatttggttgaaaaatatctatgtattagtaaacctgtgttgttcaagagtccactgtgttttgctggggatttctacatctatattcataagggattttggtctgtggttttcttttcttgtgatgtctttgttgagtttagtgtcagggtaatcctggccttgcagaatgagttagaaagtttttgtttcctggtggtttgtcttcactgcatcactgtggggttgctctgtgtagctgtctcactcagtagtgagggaaatatctctggaaatgtacaatttactgcatcagccctgcttagtctcacatatccgttgtatgttggtgcctgtggcagagggtgtggtgtcacaccttctccaggtagataaaaagtcaacactccaaaacactggacaccagcaataaggcagtcattggtaaggcctttggggagctcccattacaaatctgcctaaccctctggcctgaagtgcctagacttttgtggtgacatttcaggacaagggacgtctgctcaggcaacacagggatggggtaaggaagctaccatcccaccggaagtgggagccatctgagaagttcctcaagacaataccagccaaatattagaaggtattggcattctggccgaggcagaatgttccaaattggcaccatcttgtctgggagtccatcatcctgtcaccagcccaataggctggataggctgcagatgctcctaagattccattccacaaaccacatgtaagcctgaacacatgtctagtatagcgttctggggaggccaggagccatggttcatgaatgtaatcacagccttttgggaggccaagagttcgagaccagcccgggcagcatagtgagacccagtctctaaaaaaattaaaattaaaaaattagccaggtgtattgttgcatagctgcctgcctggggcgtggggcactggaatgcagtactcaggacacagtggctgtcgctgataaacacaagtggggatctgctattggggtcccatagggccctcccggcctgccagaggtgcctaggctaggaagggctgccactggggtctgaggagctctactcccccacaggagggctgcaggctggtcccagaagctgcttgcttccttgcaggacgtggtagctgcaggctcaaaacagccagaatgcattccctcaattcgcagaactctctcaaaaggctgcagtctcttccattgtaagagtagaggtcagggaccgccccaggccactctgccagacccatgtcttcatctaactcactgtgcctgaagctcacatgacggtgctgtggggcctgtctggggcccagctgggtggggttcatgtactggggtgagggatcaagaagggtgtccgctgcagtagaaagaaggtgggctgcggactttcagacgtggcccttaacctccccgaactgacctaggctagtcagtcagccggcggtctgaccttctccatctgtgactgagtcacagtcacagggcttccctagaccccggtgagctccggtaacgaccttgcgaggtcgggcagagtgggcagggtgaaatatctgggtgtgtggcagcgggtggggccgcgcggggggcctgggatgggggcgggccctgcgctcggcgccggcgaactgggcgggctcagtgctcagagcggaggcagcggctgcggcagcagcaggtgggttgcagcagatcctgcggggacggggactgggacgggctcaggcccaagaacaggcgaaggcgcaggtgtccggggacgggggcgcggcggagcaggctctagcagcagcggcgtgtcggacatggggaggtgtgcgggcccagggcgcccctgcattccgcctggcgcgcggataccccagcctggccacgggtgcaggggcgggggtgtatgtagccgccactgtctgtctgtggccaggtggctgcctgggccacacccgccccgacgcagagccgcggctcctgttccgggtccggctcgactctggggaagcctcggtttcacctggctctgggaccccaccactgagccgttcccagcctctcaccctgctccccctggagctgctccctccccacccctcagggccaccgagcgggtgagcaggtggggcctcaccaggcctcctttgctgcctgggatgcagacagggcctccaggcttcctgtgacctcctgcccacaggttctgacacctgccccattccagctctccagcaggcccctggtgagggtgtccaggtccccaggtcagggacagagagaggactgggggtggtcagaccaggagggatggaaggctggtcaggccccggctacgcatcctgtcattcccctctggccctagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcggtgagagactcttcctgggcagggtggcagggaaaagagcaagggggaccttgtcctcagattcttggggaatgcaccttcaactggggctgttttactagttgcataatggggcaaggaaagtgctaattattagaaactcttcacttcaaaaaaagtttcttcagaaactttggaagggaccgccccacacatggtccatagcatattagttctgggcatgtccttatagattatttcctaggcagagggactcagccctcatccgatgctccagtgggcctgtgacctaacccagatgtcctgttcttgggcaaagcgctgacaatctattactcctacacaaactcatgcttactctgagagcccagacaagctcatgcccttgttcccaaggagccacccatgcaccgacccccagcagaggcccctggtgggcttctccgccatgctgaccctccccactctctctgctacagccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcaggtacctcccctagccaacacccactcacactcggcccaggcagctgcctccccttcccccactaccatcccagaatgaacaagtctcacggggctggggaggaccacacacccatcccgcacccctttctgcatggtgagtgagcacatgtctccacaatctcccgtgaggaacaaaggctctatggattcccgagaaagtgagccctgggctggcagatctttcctgcagcccggcccagccctgccctgcctctgcctcctcagatccccatggttcccctgattccagccctgagcatcgtcctcaacatctgcctcatgctgaaacttagctatctgacctgggtgcgcttctccatctggctgctgatgggtgagtgggggccaggctgggaccggggtcaggaggagggcaaagaggacaggaagggctggaacctgtacctcaggctcatgccctgcctcctgccctgtctaggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgtatccactgtggcattctttgtggcaccaagtcttcacctgccccagggaaccaggcaattgtctccaatccacatcaaagatgctggggctctctaaagagtaggtgccagtcctgggaccaccctgagtcagggacacaggtgggcctggatccaggtgcccagtgaagaggggagccacacacaccaggcaaggagggttccatgacaggcatggggtcaggctccccacgtctgctaggtggcagatccagggagcagagcttgggccccaaggaggctgcctagaaagggcagcagggttctgagcatggcatgcacctgaggcctgcctggcacaggcacccccacggggacacatgcatccctgcaggcactaccctggggtgcatgcctgtgcgcagactgaggcgacagctgtttctgagctcgggcccaggctgcagctctcttgctgtctttgcccactcttcaagggctttgaggtgaaaagagtgtggccctcatgctcctacatgggtgcacaagtgcccaggcctgttccagttaccttctagcccacctggtagctgcagggcctcagtcttcaggggtagggtccccaagtccaccctgcaccaccccactggtctcttcatggctgtgccatgtctaccatagatgccccccaactttccagtcatgcctgtaaggactacacaggaagagggtggctttgctggctttactccgtgactttgtccagccatgacatcagcttcctctgggccccaaggagaatcaggtgcacgtgcccctccttggatacccaggcctcaggggccctgctctcccaccttcgcccttcagagcccacctccccatggacatggctctggagattgagaggcagcagggaccccaggcattttactgaggctccaggtggcaggtgattctagatgtcagcccagtctcagccccacccctggccctccacagcttgccctgatcaccaggtacccacagtggaaagcagccccttgcctccctggggtggacacttagaattccctgccccgccctgggaccaagaggagaattccagctgcaaaacctggccagcctgagggagatctcggtggtgttgtttggaaccattccttccagccactccatccagcctgggatcagagccagggcctccctcgagcagctgcccagacagcttcctaggtatgacttggactgaagtgaatttcagatgtacagcctcccacagcctcccacccccagggctctcaggaagcctggaggaaagattccaaggggttgggctggggggttaccgaggagggatatagaaggtcctgaagaacccaatgatcaccaacttagccctgccgccctctgctctctctcccagacctccatggcaaaagggctaccactggaaagcagccggtcctcataaactaagcaggtgtgggcccaagacacatgctccgcccttgcctgggggatagggaggtggattatctgcctactccaccccattccctagattaggactctcctggggcatcacagcaccagagaagctgaaacaatccccctcccccatcactcctctttctaccttgcctttttggctccagctgcacagccccatgtaggaccgatgggagggtggggtctctacctatgatgggggtgcagatgggggaggagggccaggacccaggcagcaggagggtctgtgctgacagctggtaagcatacctctgctaggaacactggggacagagcactgggagagagacctccaggcccagacgcagcaggagcccctgccacatgcagtcggagccctgcaatacaggtgcctgctgggctctcccagtctccacgggtcaggttctgtcgccgtctcaaaacacagccgacttctatggctccctgaggcagcaccctaccaaggtgggagtcaggggagggactgtctgctggggttcaagggtggaattctacccccaatcctccatgctggggcctcatccttgagatccccaggcagggccccgcccttcccagcccccaactctcaaccagcagggaacggctacaggctcccggaatgggttggcaagtgggtgtcagaacttggacagggccatcctggtgtctgtgtctgactcccagcagcagtggccgtgggtgcaggtgctgagctccgtctgaggcactcggccagtcgggcttgggatgcaagggccagctccctccacacagagttggcggttgctttcggggccttggcctgcagatgaggacagcaggtcagggatccagccaacatcttcctaagtgtggcagaacccagggtccaagcagagcgacctcagctcacctcctcatactttgtcctccagtagaaatgggcttctctatccacatacagcagtagcaggtcacagaaaaaggtgacctgggagaggcagggccaacccatgttccagcccccgagcctgctctcctgccacctccccagcctgcaccccgagactcaatgtgcaggcaccggaggctccagcatgcattggacacaccctggtcagcagcactcactgcagcctgcaggtgcccacagtgctcgcactcaccacgcccagccaagctgccccggtgcccagtgtgacggccgtggggatgagcccgaacttccctgcctgagagagatctgagctgaacctctcagcccacgactgtcagcctcatgcctcctccagccctgtctgcctgccccatcccatccccggcctgacccctacctgtgcctacctgcccggtgacgaggatgtcgaagcggattccatagagcttgagcagggtgcgggcctccacacccggttgctcccaccagtgagtggctgtcctgtgggcaggaaagaaggctctggtgacctgctttgcccacccccaggtggggctggccctgccagacctctgtccaacttgtcaattgactctataaacccccagcccaagcctgagtcctgggtctcagccctatgtaattggtgagaaaacagaaaaagcaaacgaagacctgtccctcagaagttccctgcctgctgagaggacgggggacagaggagtccctaaacagacccagcagcgggggatgtgaaggggcaggctcagggctgagggattccagagatgggaactcactcttccctgggaactggggtagacttcctggaggggacatgaggctgggcctgaaggaacatgcacacaggtggtttgccagcacagaggtcaggggaacaggatgtgggtgggagccagccccacgtggtttcgaagggctggggaggttggggaagccagatcagacggggtgcagtgagctatgttgaggggcatcatccccaggcctggtggtcgtgtgtgcctgcctgcatgacgaggtgacgctcggtggcagaaggatccaatagatctgcttagaagactcaaagacatgataataaatgcaatttatgaaacttgaggccaggcacagtggctcacacctgtaatcccagcactttgggaggctgaggcaggtggatcacctgaggtcaggagttcgagaccagcctgaccaatatggtgaaaccccatctctagtaaaaacacaaaaattagctgggtgtggtggtgtgcacctgtaatcacagctactcaggaggctgaggcaggagaattgcttgaacccgagaggcaaagattgcagtgagccgagatcgggccactgcactccagtctgggcaacaagagcaaaacttcatctaaaaaaaaaaaaaaaaaaaacacaaaaaaaacaggcttggtggctcatgcctgtaatcccagcactttgggaggctgaagtgggcagatcacctgaggtcagaagttcgagaccagcctggccaacatggcaaaacaccatctctactaaaaatacaaaaattagttgggtgtggtggtgcacacctgtcatcccagctactctggaggcagaggctggaaaatcacctgaacccaggaggcagaggttgcagtgagccaagaccacgccattgcattccagcctggactacaagaaagtgaaaactccgtttcaaaaaaaaaggtcgggcgtggtggctcacgcctgtaatcccagcactatgggaggctgaggcaggtggatcacgaggtcaagagatcgagaccatcctggccaacatggtgaaaccctgtctctactaaaaatgcaaaaattagccgggcgtggaggcgtgcacccgtagtcccagctacttgggaggctgaggcaggagaatggcgtgaacacgggaagcggaacttgcagtgagctgagatcccgccactgtactccagcctgggcgacagagtgagactccatctcaaaaaaaaaaaaaaagtttaggtaaaagcggaagggaggccagacatggtggtttacgtctgtaatcctagcccttcgggaggctgaggtgggtggatcacctgaggtcaggggtttgagaccagcctggccaacattgtgaaaacccatctctatctaccaaaatataaaaattagctgggagtagtggcgagcacctgtaattccagctactcaggaggctgaggaaggagaatcggttgaacccaggaagcagaggttacagtgagccgaggtcgggccactgcactccagcctgggtgacagaatgagattctgtcttaaaaaaaaaaaaaacaaagctgaaggggagaaggggaaagtaaaaatgaaacaccccattgctgtggaggggagatactagaagcgaggtggggtggaggaagggctggcagtgaggagcctgagctgggcaggggcctgggacagatggggtggagggctcaggacttggggcagcaggacggagcctgtgctggaggatgtggggttgagaacagctctctcctgctcctgggacccccttgcacacgtagtggaatatctagaggcctgggcctgggtgtggtctgtcctggccgccacagtgagagggcgatgggcccagcagctgggcactgggagcagtggggcctcacctgaagttgtagctcttctcctgcagctggaaggagtagtgaggccagcagccagagtccccggtgtccaggtcacaatcccagtgaactctgatgcctacagagccaccctgcacatagcacatagcttttccaccggtgggtgggcccgggaccctctcccagagccctctaggaaccctgcccccaacttgggacccaccagcaacgccaggtcctcgaaggtccctccagccttggccacgaggtccccaatgcggaacacgggacagtaggggctgaattgtggttcatagcggcagtgcttaaaataggtggggtcccaggtctccaaggcattggacctgggaggagtgggaaaggtcagatgaggtaggggacaaggagggtcttggggcagatgagacccactctgcttacttagagaagttgaacttgctgaaggtgactgtgtttttgatgaacagtgtgaagttctgggcctgggccagcaggggcctcctgcaggtggaagggaggtgacagcctctgccaggcctggggccctgcgccagttggggtaggggattgtggggacacttacgagggcacaacgccactctccacggggcaccaactccagatctcacaggtcctgtgggtcccattgaacaccacacactggcctgtttttacacctagaaaacaaaagatgaactccagaccttcaaatctctgcaggcctggggaggccttcagccagggggttgttggcagaaagagagatgcagggacagaggcgagcagggcctgcactcaggagccacccaggatcccagcccggcccccaccctgctgggggcactggaagacagagcccacagttaccgtggctgtgtgtgcctccctccccttcggggcagtcctcgtcgacccagcagttagccagtgggacggacgggtgctgaggtgggagagagagcagtcaccaatggcacaggggatgtctcccctccacagcccagtctcaaaggcagggaggttcaaggtgggaaggacaggcccccttcccaccttaaacaacctcaccaccccgccgccagagtaccctgagtgtggggccacacaggaaagctggagggtgcaaataaaaggaggtggtcagaggagggagcggagcaatgccctggccagatgaaggtacagtactgtatttcaaagacaaagggagacccctttcctcctttttcaaaaaatttatttttagtgattcggtctcactctgttgtccaggctctagtgcagtggtatgatcatggctcactacagcctcgccctcccgggcttaagcaatcctctcacctcagtattcccagtagctgggactacagacacacaccactgtgcctggctgattttttaatattttttttttgtagagatggagtcttgctatgttgaccaggctggtttttaactcctggcctcaagcaatccttctgtctcagcctcccagagtgctgggattacaggcgtgagacaacgcaccctgccccttccctcctgacagttctgtccctggtggatgcggaagtgattcttccaggtctagctcctctggtccaatttggatgacagatcagggaaggtgaagataccttgggagggtgagtttttgatgcccggcatggggacatagctgacaaagatcagggccctagagtcaggggcttgggtattgaagcaggaccccacacccttgctgagggaccacaggctactccttcctgctcgctcttctgtaacctggggacattaatgcctgcacagaggcataggactatggggctctggcagaaggggaggacaggtgagctttctggggtcccagaccccagagacgaaggcacccttgagcatcgggcactctcccaggcatggtcctgccccaactgaggatggacactgctgcccagggcactcagctcaggggcagcaggaagaacaccagcaccaggggcgcaaggaaggctgagggcctctgagaagccagaatgaggcggtgggactttctgaaagacagggccgtcgtgattgggtggaggtcggagcagagccacatgctctgcttctttgtccctacctatgtcctgtgtctgcctctcctcttcaccccagctgggctaccgtctcctccaactagaccccacagtgaccaccagtggggcccccacgtcttcccataccctcatccacctatgcccagcagcccaagtggtgcatcccaatgtgcaggaaactgagcaccctgcctctgagcccacgtgtggctctcttctgttcctctaatcaagtttagctcctgccaggcacagtggctcacgcctgtaatcctagcactttgagagtccaaagtaggcggattgcctgagctcaggagttcgagaccagcctgggcaacaaagcaagacctcattgctacaggaaaaaaaagaaaagagaaaaagaaaacaaacaaacaaaaacagtttagctccttagtggggcttacaggggcccctgaaatcctgaactaccttcttcccaccccagtccaaatcttcacttcagctccacccagtggcaggtagccctaaaggcacctcacctcacacagctcagggcctttacccaccaagccccctctgtgtcgacatcctgcttcaaccaaatccacctgctcaccagcttctccccacctttttttaagattctgcttggcctggcacacctgtaatcccaacactttgagaagccaaggtgggcggattacctgaggtcaggagtttgagaccagcctggccgacacagcaaaaccctgtctctattaaaaatacaaaaattagccgagtgtggtggtgtgtgcctgtagtcccacctacttgggaggctgaggcaggagaatcgcttgaaccaaggaggtggaggtgtgcagtgagccgagatcacgccactgcactccagcctgggtgacagagcgagactctgtctcaaaaaaaaaaaaaagaaaaaaaaaaaaaagattctgctcaagtgcagccctaggtcccccacctacagcctctgtcccatcataggacctgccacctgggctgggctgtccatgtgggtggtctttgaagtatgggagatggagttttgtgaatttagcctagctagccccctggcccagcggggaggctcagcggtgtctgctgagggaggtgacactataaagagcatggtgcatgtaagggagggatcaggcaccaggatccctagaggagctggcagaactctggtcttccgggaaagccaggttgtcagatctgataattacgacccagccctgacgtttcatgggaagagccagaagtgtggttgcagacaaagaggaattgcacagattctgaaaaacacagacccacagatccagccaaatttcagaacggtctacaaactgaacactaaatgcacatctgagcattaagaaagagaaggacattgtgtgggttcaccaagagtaagcacatcctgccaggcacagtggctcatgttgggaagaggcccccaaaatctggccataaacaaaatctctgcagcactgtgacatgtttgtgatagccacgacacccacactggaagtttgtgggtttaccggaatgagggcaaggaaaacctggcccacccagggcggaaaaccgcttaaaggcgttcttaaaccacaaacaatagcatgagcgatctgtgatttaaggacatgctcctgctgcagctaaccaaccagagcccatccctttgtttcccataaggaatacttttagttaatctataatctatagaaacaatgcttatcactggcttgctgtcaataaatatgtgggtaaatctgttcgaggctgtcagctctgaaggctgtgatacccctgatttcccactccacacctctatatttatgtgtgtttgtctttaattcctttagcaccgctgggttcaggtctccccgaccaagctctcggcaggctcacgcctgtaatcccagcactttgagaggccgaggctggtgggtcacctgaggccaggagttcgagaccagcctggccaacatggtgaaaccccgtctctacttaaaatacaaaaattagctgggcacagtggcgggcacctgtaatcccagctactcagggggtgagcaggagaactgcttgaacccaggaggcggaggttgcagtgagccgagatcgtgccattgaactccagccttggggacaagagcaagactccatctcaaaaaaacaaacaaacaaaaagagtaagcaatcctttgtgcatatttccaactacggacatgggatgtctccagcaactgtgctaggaccagccaccagggctcaggggacagctgtctgcacaacgaccctccagcccaggaggcacgtaaatgttggacttgcctaaagatgtcactgtggaggtaaactttcaggactatgtcctgagtcccaatagttcaaacaaaattcacagctggagagaatgagcatgctctgtgacagatgcaggatcccagggacatccccaggcaaggggaaaaggtgaaatgtcagggggagaatcagcatttctggatcagaaatgaagaagaacaaggtgggggactctggcttgaccacggttgatgtaaaaactatccagaaatcaggccgggcgtggtggctcacgcctgtaatcccagcactttgggaggccgaggcaggtggatcatgaggtcaggagatggagaccatcctggctaacaccgtgaaaccccgtctccactaaaaatacaaaaaaaaaaaaaaattagctgggcgtggtggcaggcgcctgtagtaccagctactccggaggctgaggcaggagaatggcgtgaacctgagaggcagagcttgcagtgagctgatatctgccactgcactccagcgtgggtgacagagtgaaactccgtctcaaaaataaaacaaaaaaaactatccagaaatcataagcaatcctgaattcaccatgagcaagagtgtgctgtgttggcccacaaagatgaaagctgcctcaggacatattaatagaggctgggcacagacaaggggaggtgatattccagcttggctcttgctattagaacctccctgagcatgtgcgcagctctgggtgtcacactaccaacctggagagtacccagaggcaggaccaggatgggagggcctggacacctcatgggaactgctgctgcccagagctcggggtcctgtcacccacaggcctggaggccttaagaaagtgactcaacctcactgagcctcagtcttctcctctgaaatggggatcacaggacttcctaccaggcaggggatatgtgaagactgaacataatgattcaggaaaagatgtagcccagtgcctgggggacaccgagcacaggctgagccttcagccacctgggaaggggaaagggaaacacgggtggccccctggggctgatggaggaacaagggacccgctgggaggatcctgggtaaactcacctctgggcatctgccctgaacttgggctggcgtcacaaggaagttggtcaccaagaagaacacgttctctccctaggaggcaagtctcaaggttggcctggctgggctcgtgttgactggaaaggccggaagccggcagcctggtttatgagggaagggatgttggccccatcaagtcattaaccctgtccccctgtaaggcagactgaagcagagatgggaggctggcagtggttctggccatttttgagaccaggaagccttgtgcccatgtccatctcttgagacaagtctcttgtctcaaccaaaatttgtgtgtgtgtgtgcatgtgtatgtgtgtatttagagacaggattacacttcgtcacccaggctggagtgtagtgttgtgatcagtgctcactgcaacctctaactcctggactcaagaggtcctcctgcctcagcctcccaagtagctgggactacaggctccagctaccatgcctggctccaaccagaatattccaacagcctgctgcttctagtactgaagatccaagggagagctgggcccagcacctgctcaggatggagacgaggtgagtctcccatctcacacacagcagcactggcatggcaggggccaagggagaagagggaaagctgtgtctgtggtcaacgggtggccgaggacattggaaagaaaggctgaccctccagtgctgctcgtgagagcactgtgaatttggggaatgtatgcccaggaagggaaggtgagggctggccagatggtgctgggagtggcagccattaggattgggaggaaagtgtggacaccgtcatgggcagggttgggggaattcctgagggtagaagcaggcgctgcaggctctcatgatgcctggtgtgaaagttcagcttggctgctgcgtggtgtgcaccgagcagtaagggaggaggcgagaggggcatctagggaccctctaggaggccatagtctcatgcatggcatggcatgggtagtggtgaaaaatcttggaagggacaggaaggggtccagggtgagtcacgggtctggctgaggcactagtggatgtcacagccaccatgactagtgggcgtcacagaggccatgccaggagaggaaaataattgatctttggacatgtgggtgtgcacctagaagacagctgtgctctgggcaggtgatcactgggaatacaccctgggcatcagaggagcagaagtggcagttgaggctggggatgagctgggtggagggaggaggaaaacgcagccgagaagaggggaggagcagcacctgaccgtagtgccccaggtcagggagcagggctacagggaagttccatgccccagcacctcacaccactctcaagctcaagccattagtcctggacactcccttcttttctgttggcagtctttggaaatgcagtttctctggcctggcttttttttttttttttttgagacagagtctcgctttgccacccaggctggagtgcagtggtgcaatctcggctcactgcaagctccacctcccgggttcatgccattctcctgccccagcctcccgagtagctgcgactacaggcgcccaccaccatgcccggctaattttttgtatttttaatagagatggggtttcaccgtgttagccaggatactctcaatctcgtgatccacctgccttggcctcccaaagtgctgggattacaggcgtgagccagcacgtccaaccctggcctggcttcttgagtggcccctttttccaccccaaaacctcctacacatccctgaaagtcctgtccaggtgccactcctctgtgaagcccttcctgagaacccgcagccgtctctggcatcacatgcttctctctcgcacacactggctgcatggcgggtgttcaggctgtcagtggggaaaggacttgcgcccccgtcagcaacatcagggcccccacctgaggtggcttcacgaagtcggccacatcccacagccggtttccaagctccttgatctgagtgacggaaacccctttgagtttggtgatgatggaaaactggggttccaggtcccgctcctggtagccttttttggcgaggagagcccacctggggaggagaagtcgggcagtgtggtgtgtccccagcgtgtagtgacaggggcggagctgagccctacatgctcagttctccccccacaccctacaggctcccggcccaacatcgaaggccccacctcctctctggccccacttcccactccagaccccctgaatgagacagaagctccagccatgcatcagagagccaatgccctcagacaatcaccttcactagccagcacccacccccagcctgactagatccagcttcccccttacagactctcctgacccgagatacagctggtggtctctctgggggcctagtgctccagctctcacagatgttaaggactatgtcatgtgccccctgggtggggcctgggtgggggcctgggaaggaggcaagtggacacacaggacaaacacacagcttgttcttgctctcctgtcttgtatcgcctagctctccccaaccccgtcccaatctgcccccttccactccagcccctaaacagcccaaccctcaacttcaacccagcaggaccaagccccaccccccacctcttcccttgcccctccagcctggccaaaagctcttctctcttaccctaccacatagaccacgatcccaaactgcagcagcctctgcagggcgcccacccgccagttcctggtcatcacatacttctccgtcttataatccagaagcccccagcctgtcgtagcccctggggagcccatgctgccagctcctgctagctgcgggcacatgagtcagcatggcagctgcagccgcagctgaacaggaggcaaagcagggcccgagccaggccaggccagttgctgttaaagggacacttccactaaagcaggatccagatccagcctccaacacccagccctcaacccctaatcccagctgccctgcacctcccaccctccctacattccctttgctgggccctggcacacagagaacagcagcagctctgtccctgccctctggcctcacttcctggggtgggagtggaggtggtgggagggtggagacggacagctgttatcagtgctgtgagaggagggcctgagggcagcagcagcagggcggggagggtgttgaggaaagcttccggaagaagtgacctctaagctgacccttgcagatttctgaagttcgacaagcagacaaagatggggatggaggttcctggtgcagggagcagcgtatgcaaagaccagagcatgcaagataactaagaggcacagagtgagagggtgacctggctctgcgaagttccccaggccctcctgaaaagctgcccccgccaccttccccagtgcagtgaggacaacacaagtcctggagtcaggcgtgtttcccagtccacgaaaggggggcgatgctggaaccccctaggaaggcagggaggatgcccacaaggcgcccagcccagtgcatagcccgtggcgcgtgcagtttatcctctcaggcgaggagcctcagcgcaggagagccacggtttctacggcaacctacagcactgggttgccggggcgaccgccgcgggggagcgcgtcgctaattgccgtggcagacgccagtcgatggacgccacactcgattggtcagcgcagccgcagactccgcccacatccccgggtcgcgctctaagtgaggcgccaagcggtctccgcctcagggtctgaggctgcgaaaggggcgtaacgatgagcggttcctgccagaggtctggggaggataaaaagcaggaggaagaggcgacggcggcctgtggacgtcttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacaggtaaaactaatataatggatgtatagaatttagaactacttccggttttttccctggggaaaatattcacaaaacatttgtggtctgcaatcaggttaaaagacatagtgtgccatttgtcatcagacaggtagaggcctgactctggcaggattagctaccactagctgtgagactttatgtattcatttattagagccagggtcttgctctgtcacccagctttcagtgcagtggcaggatcatagctcactgcatccttgaactctgcactctggtgagcctcctgcctcagcctcctgagtcgctgagactacagggggctaccacatctggctaatttaaataattttttatctcgctatgttgcccaggttgtccagctttcttttgacagctgtatgactttaaggaaaagatttgcgttgccttagcctcgatgttcttatctgtcatatgcgggcagtggtcctaaggagcataggaagcagtgcttctagaggcaaaaaataggccaggtagtgatgcagggcaggggaggaggcaggtggctatagccatgcaggggttcacattcatccccctgtctcctaccaggcacccatggacttggagaactggtcggggacaccctgtacctgaggtcttgctggatccatagcattgtgcccatcttctgctttctgtgccaagggagtgccccagagctgaacctgctgcacggtggcctggggccccaggtaccactggaaggacactgggtccaggcttacagggagaggccccgggagacaacagccatgggagtgcccctgagtctgtcccctgtactccccagcttctgcctgtgccaggcatgccctaccctcgacatctgagagacagatgggattgatgctatgacagatggcatgaagggttggggagccttcaggcttctaacccgctgggggctctgggagaggtgggggtgggggacacctaggtggggcctaaaaggagaagcatgtgtcccttaagcaggtggaaaggggggtactttccaggtgggggacgtggagcgggctgagccctggagcatgagccaggatagtggccagtgtgtttgctctgtctgtcccagggcgccggtctctggcttcctcattgagctccaatccatatgtcaagtggctgaacttttgggacagtgggctctatggggcaggtacagaggccctggcaggtgccctgagcaaaagcagcagcatctgcggtaggtgctgggtctggggcaggtgggcaggcgtgagtcctccctttcctcagggatgtgcctccacccctgaaagctgggccatgtcacctgggtcctgctggtgttgctggtggatagaggaggggcctcatcacaggagggggtatgtggggtggagttagaccctctgctgtgcagctgatgctggatacaagtcccttcctcatccaccctaccccaccactctccttccttgttggctggcacccattctcctgccctgccctgcacatgggagactccccagtgcctgaatgcagagtggaaagtcctgcaacacagagagttgggggcggggaagttcaagaaaggggtgggcaaggtgggagttcattgaagctgaatccaaatgctgtctctgccactgagaaaacggggtgacctatgaaagcagctcagtttccaatctgtgaaatggcccccacaagacctcataggcttggggctgtggtgagcatgaagtgaaatgcactcctgaagtgatcagcagagtgtgtgacccatgtaagtgctccatgcacagtcacctgggctattattgccaatcctggcaatggggcagtgagggcttctgaagtgggtggtgatatcactgccagacataatcattgatggggtggctgccccccaccacagcagtctctacagtaccaggaggtaggcagttttaaccgcttgacacagaagctggtgggcacacagggagggggaggtcaggggcagaggggacccagccattgggagccagagccaccatgcaaccccaggacagttaacctgtaagtccttttcctctgcctcagacctggaggtttgggggatggcagaagaggggggaggggggtggtacctggctttgcatcccactggctgaggagtggctccgtcccccagatgtggacctgttggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggtaatgcctgcgcagggcaccatggccatgaaagctcagcttcctggggcagggatgggtgggggttggcaggaccgcgctgcacatcgccagggagcatgtgctctggttcctgctccccacaccccaccttgccccactcctcttccactccagccacacggaactcttcattccttccacaaatatctcattgcgcgctgctgtatgtgctgggcactgacttagccaccagggatccaccttgaacaaaaccaagttcctgacctcaagggacaatgttaacaatatcattctgagtaattattggcactgcaaaagaaacaaatagtttatgcttctagagaagaatggggaccccctgctttaaagaggtggctggggaggcctctgtgaggtgacatttaagctgaaatgtgcagggtgggaaggagtcagccatggcaagatcagagggagagcatttcaagcagaggaacagtgagcatgcgggcctgtttcccagactggcagacagcagtgtgcctaggctagggagccagggaagcgtggccaggctgtggggtggagagggcagagggctgcagggctgtaggccgtggcaaaaagggtatagattttgttccaggtgaggtagaagacatggttgggattccttggtctcatcactctcatgcccctgagtgtttgctttgccaggaatttgcacttctacctgcctctcctcaaatggtccaataatagtaacaatcacctgtgaccctgggtgaggcatgcagatgttgaccctggacctgctgaaccaaactcttaggggaatgccagtgaatctgcattttaatggatgccccaggagagctcttttctgcagcatttcagaagctctcatctggctcaagcagcttagagggagtggggtggcaccagacttggcctttgagaattggccctggagtgtaactgccagagaagcagtttgtcttctaaaaaaattactactgggagtcagtgaaattaaaagacaggcttatttcagactttgacaaactgaacataggtgtctctttggacccgcacagtaaaagggcaagtgccagagaggcagccgggatggagggcctggaagctaaggtgctatgaaggtttcacaaacagacacatgtacatgagggaggtgggtggggactggaaatcgacaggcccagcaaggccatttttttcctccaagagatctgtgggagggcccaactcccttgagaggtgaaggagcttggatctgtgcgtccccacttgatccatggcaatggtagcacctaccgcataggatggctgcaagggtcacacagaacaagtattggcagttgcaggggtgtgtggaagaaagaatcttcctgcccttgagctgttcagcaaaaacagggcctccccacaaagtgggggattactgtctgaccctgccagccctagaagtgtctgagtaaagaggaaagcacatgtatttgagtacctgtattatcaaatccagtgctgggcgctgagtctagttctcaggtagagagggggcaatgccctgagtccttgcttctgtgcagggagctctccatggtgctaaacaagagtgtctgtagccacgggtgccagtccagcaggctggctgagcgctctggttagtccatccgtttttcttctgtgtatttcttcaaaccagccttcctagacctctgcaacgtcttactgtgaagtgtgcgtggtgatttgtgcatagatctgtattgtctgcttttctctgcttcaaagtgtgatgcgtgttcattatggatggtctgaatccgtatcaactctcagaggcaaagagaagtggccccggcttggtggaggttggtggtgtggctcccacgggcattggcttacgttgtctggtttctctcaggcagatctgtgcatgggactgcagggcttcctcatcttccacagctttgggggcggcactggctctgggttcgtgtctctgctcatgaagcggctctcggtggactacgggaagaagtccaagctggagtttgccatttgcccagccccccaggtctccatggccatgacggagccctacaactccatcctgaccacctacacgaccctggaacattctgactgtgccttcatagtcgacagcaaagccacctatgacatgtcagcacaacctggacatcgagtgtcccatgtacaccaacctcagtcgtctgggcagatcgtgtcctccatcacggcctccctgtgattcgatggggccctgaatgtgtacttgacagaattccaaaccaacttggtgccatacccccacatccacctccccctggccacctacgccctggtcatctcagccaagaaggcctaccatgagcagctgtccgtggccaagatcgccagtgcccgcttcgagccagccaatcagatggtcaagtgtgaccctcaccatggcaagtacatggcctgctgcatgttgtacagaggggatgtggtcctgaaagatgtcagtgcggctgtcgccaccatcaagagcaagcacaccaaccagtttgtggactggtgtccgattggatttaaggtaggactgggtgatgtggagtccttgtgccatcaggaagcaggagacctgcagaataatgctgcccctgaaggcccgcatcctttatggagacaaccccttttcacgtcagctaggttgcaaggataataattttagtaatttatttcctaccgccttatactttaccaaatactttatgttccctcataccttaaccactaccctttaaagttcatggggcaatattaccagtatcttacactttagaaaacagaggctgaggctgggcacggtggctcatgcctgtaatcccagcactttgggaggccaaggcaggcagatcacgaggtcaggagattgagaccatcctggctaacacggtgaaaccccggctctactaaaaaatacaaaaaattagccgggtgtggtggcagacacctgtggtcccagctattcgggaggctgaggcaggaggatggcgtgaacccgggaggcagagcttgcagtgagtcgagattgcaccactgcactccagcctgggcaacagagcgagactacatctcaaaaaaaaaaaaaagaaagaaaaagaaaaaagaaaagaaaacaaaggctgagatagctttaggtgtctggagcctcacaggcagcaagtgatgcagagagaaatcagagattatctgactgcaggtcctggtctgtcctccacattactccactgctcactttagtaatttgtcaggttctatgttatcattttttgtgttataaatagtggtttttacactttacatcatcttggtcacctgttgtcactgaattttgggcaacactaatatttctgtaaagatttttaaatatattgtgcagtgtttactgtgaagaccaaaggcaggtctttgccctttctccaaaccaagcagagacctctgcctcacacacaatcagactgatgatttggtgctcctttagctatgcttacagtcagttgtctaccaaaagaaaagtaccatgtatttggaagccaaataacagaatgtcaggctcgaagatctgttgtgatgactaggctaaatgcctcaccacacctgtgttggtcaactttgtgccctatggttagttaagagcccctgtctacagtggtttcccacattaggcaaagctatagatcccacatttataagtctcaatgagttctgaaggtgtttgaggagttgcaagttccaggatcattccagattgaaatgatatgagaaagtcacaggtatgtgtcttctttttcccatgtggaatggccataacttgcctctgaacgcacacaacttcttgaatctgtctggccctctctcagccactttacaacaccttgacacagatcatctctctttttcatctcacgttgatgcaaaccatctttaagttgacagatttaaagtgattcatagaacagggtaaaatcggccaggctcagtgacacatgcctgtaatcccagcactttgagaagcccaggtgagaagattgcttgaacccaggagttcaagaccagcctgggcaacatagtgcgaccctgtctctacaaaagatataaaaattatccaggtatggttgtgcatgcctgcagtcatagctaatggggaggtggaggtgggaggatcgcttgagacagggaggcagagattgcagtgagccaagatcaccactgtactccaacctgggcaacagagcgtgactgtctcaaaaaaaaaaaaaaaaaaaaaaaagaggaaaaagaagggtaaaatctacaacagttacaccaacctggaatgttcattacatgttacataggaggattacagaccttagatgtaagatgttacaggtaggaggtgaaaccctccattctgtgtctaattattaagcctctcaacttgagtagaggaatttttctttcaattagtgttacatttggaaggtgaagacatccttagctggcaggcactgtgggagatgctatgctgtgcagaggtttcctattgtaactaagtattgtgagacagtagggaggctagtctgtggggagataaagtcacagcctctcctccccccagaagatagtccagccttagatggaccttgttgaattaattctctttgctcttaagttcctttttgtcagtcttagtgtgatttaccatacattcttgtttgtttgtttgttttgagacggagtttcactcttgtcactcaggctggagtgcagtgatgtgatctcggctcactgcagcctctgcctccccggttcaagcaattctcctgactcagcctcctgagtagctgggattacaggcgcccgccaccatgcctggctattttttttttttttttttgagacagagtcttgctctgtcgcccaggctggagtgcagtggcacaatctcagctcactgcaagctccgcctccggggttcatgccattctcctgcttcagcctcccgagtagctgggactacaggtgcccgccatcgcgcctggctaacgttttttttttttttttttttattttttagtagagccggggtttcaccgtgttagccaggatggtcttgatctcctgacctagtgatccgcccgcctcggcctcccaaagtgctgggattacaggcatgagccaccacgcctgaccaattttttgtatttttagtagagatgaggtttcaccgtgttgggcaggctggtcttgaactcctgacctcagttgatccatccgccttggcctcccaaaatgctgggattacaggtgtgagccaccgcacccagccaaccatacattctttaacaaccatttgctttttttttgtttgtttgtttgagatggagtctcgccctgtcacccaggctggagtacaatggaacacactgcaacctccgcctcccaggttcaagcaattctcctgtctcagcctctcaagcagctggaattacaggcatgcgccaccaagcctggctaatttttgtatttttggtagacacagggtttcaccatgttggctaagctggtctcgagctcctgaactcaagtgatccaaccgccttggcctcccgaagtgctggaatcacaggcgtgagtcactgcacccagcttcggatatgctattttcgaagagtcttttccatgcttaaaaacatttgggggctggaccgagtggctcatgcctgtaatcccaacactttgggaggctgaggtcggtggatcacctgagcttaggagttcgagaccagcctaggcaacatggtgaaacctcatctctaccaaaaatacaaaaaattagccgggcatgatgccacgcacttatagctacttggaaggctgaggtgggaggatcacttgagcctaggaggtggaggttgcagtgagccaagattgcaccactgcactccaggctgggtgaccaagtgagaccctctctcaccaaaaaaaaaaaaaaaagcttgagtccaggagttcaggatccattgggggaacatggtgaaaccccatctctacacaaaatacaaaaaattagccgggtgtgatggcacacacctatagttccagttacttgggaggctgaggtaggaggatcacctgagactgggaggcagatgttgcagtgagccatgactgcgccactgcactccagcctgggtgacagaacaagacccttagaaaaaaaaatacgaacatttgggttttttattataaaagtacttatgttggccaggcacagtgtctcacacctgtaatccattgggtggatggcttgagcccaggactttgagaccagcctgggcaacgtggcaaaacctgtctctacaaaaaataaaaaattagctgggcatggtggcacatttcctgtagtgctagctactcaggaggctgagacaggaggactgcttaagcccgggaggttgaggctgcagtgagccaagatggcaccattgtacttcactctaacctgggcgacagagcaaaacccatctcaaaaaaaaaaaaaaaaaaaaagctgggtgcggtcagtggctcacgcctataatcccagcattctgggaggccaaggtaggcggatcaccggaggtcaggagttcaagaccagcctggccaacatggtgaaaccctatctctactaaaaatacaaaaattagtcaggcatggtggcggttgcctgtaattccagctactctggaggctgaggcaggagaattgcttgaacccaggaggtggaggttgcagtgagccgagattgtgccactgcactccagcctgaatgacagagcaagactccatctcaaaaaaaaaaaaaaaaaaaaaaaaaaaaaaaaaaaaaaaaaaaaaacttgatatgggccgggcgcggtggctcacacctgtaatcccaatactttgggaggctgatgcaggcggatcacttaaagtgggaaaatcgcttgaacccaggaggcagaggttgcagtgagccaagatcacaccactgcactcaaggctgggtgacagagtgagaccctgtctcaaaaacaaaacaaaacctgatatgtggcaaaatactgaaagaatgcagaagactgaaaagctgaagtcctcttcttccccagagctgcttctgtcctttgaaaaacattctgtacatattcaaggcatattaatctcttgttatacaggtgatgttgacagtggccagcagatatgtatgtccctttcctgtaggtgacagacccaattgctgcacacaggtggtcacagtaaacagaaagctggcagcactcccacttggaagggctgataggcttggccttagagttgtgggaggacactccctgatcagggtacgaacccttctctctgccccttccaactcctgtggagtatgtctgtatctagttggtgctaactgctacgtgcttggcagggcaaggcagggtcaccacctcagcaggcgtttgtcctcctccggcatgatgctaccctagctgcccaaggttctagcctgtgtatgttattacatggatttttttacacataaatacatagacttcaactcacttttctttttacaaagtatacaatataccttggatgtatttatatcccaagacagggttctcattctttttcatgtgttttactgtatgggtaatatgggtaataatttttttttttttctgagacagagtctcgctctgtagcccaggctggagtgcagtggcgaaatctcagctcactgaaatctccgtcttccgggctccatcttacatgcccataatcccagctactcaggacgctgaggtaggagaattgcttgaacctgggagacaaaggttgcagtgagccgagattgcaccactgcactccagcctgggcaacagagctagaccctgtctcaacaacaacaacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttgcagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggaggtctcgtggcggcgcgtgttgggtctgcgtttcccctctggggtgcttgggcagcatgagcccagggctgtggacagcctggtgctcacgggtttgtggctccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcaggtgggcctccctgccggccgacgctggggtaggatgtggggctcccggcggactgggacagctgcaggtcatggaagtcccttgagcagcctgcgtccaagggggctgtttcctgttcccagctctgcacagtgaaacccacccccaggatcactgtgcctgtgacacaaggggaaaacaggagcctttccagagagtatctttcagagccccagtcttgccagcaagtccacaaatcaaagaattctttctggctggtcagcccagctcggcttatgcaggctttccacacacctggactgtgaggagtcctgcggggaagcgattggtgtagctgtaacttggcgttccccagacgtattgtttgcacgatgccttccagcatcccacggcgctgctgctgggggcagattggcctggggaggcagcacttgctctccagctcatctgggttgcttttccccgcagtggatatcacaggctaaaggagggggcagtccccaccatatttgagtctttctccaagttgcgccggacaaccaagaccaaaggacacagttacccacctggccccgctgaagtcagccggctcagacgatgcaggaagcggtatgtgatatgggtgggggatgccccactcccacccctaggctgagggactgggccctaggggtgtctgccagcagtctcgctggacagggttcttgctacacagaacctgtggatcgggtttgggtgttaagggtggatcaggtgggctggtggaggggggtctggcaagccctcagcctagcccatcagtctctctcttcccccttaccagctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggagggcctgctgtctggctcagctgggggctggagcccctctgagtactaagcttgctgccccagacagtggctgcagctcctagagggctcagtccaagctctttgccaaggagaacagggagcctggctctcacccctcagagctactggtagacaggtggcagtcagccctgctagcgcagctccgtgccccacagggttctctgaaggggcaggatggtgtgagtaggggccaggaagacagctccaggcgccctttccataggatctgaaacagccctgacttaaaccagccagcccctttgagaacacttctaaaacccagtctagatccggttctcaagcaggagcatgacaggcttctgtccacaggccccatcagcctggtgggtaagctggacaaccctctccccgcccccttcactaccatctctatttgaaaaacggggatgatgatgacaatcatcaacctcctgggtcatgtcagcaggtagtaaagccccaacaagctagtccctggaaatctaggaagaggtggccagaacatggagacaagcactcaggtcctggcctcagcatccttttccttcaactcccaggaacctggaaggccttgctgcagctgcagttctcaaacagctccgtcttggggtgactcactgcaagtatggcctctccctgccgaggagcacaaatgaaattcattctagtcccagaaactgccacacaatttcgtaaaatttgctttttagggcccttggcatgtaatttcatttattcatataagtctagatcagggttcagtgacaagggtcagcatagagcagggttgcagactggttcaaggaggcttctgggtaggcccctccaggagggatttggaggaggctgccctgtgggtgtggcaggagccacatcttgtggaaactgggtagatgggtgtgtggccccactctgagtgaatgcacctggcccacatggctgggcgctgcagcctgcactccacttccaggtgctgacatatcctccccagccatggtcctgggcctgctgtgtcctcacctcaagggcctcccggctcagcctctgccccagctcctgctctctcctcccttgttcccagctcatcttgcactaggccacttcctagcctgcaggctgcctatggatctcctgttagctaagcaacttgccactcagggccccccacacacctgcatacacccaaaggagagcaggtcacttccccaaggagctgtggcttcatggcagccacaacaagaaaggggtcctggaatcctgttcccagtaagggagcgctggctcccagcactagagtggatccacatggggccctcactagggcaagagggcagccctccttccacaggagccaagagcatagtgcaggggcaaggcagggcagaaggggcaggagcccaccccaggcctccaggattcccctggaaggggccagcctggaggccttcacagcccttcccaatgtgactgggtgaccccaggtggaggcaggagttgacagcatggatagagacaggtaaggccactgacctacatctgggggtctgctaagccatgggctgctcaaggggctgaagccagcagtggtggccgggccagcaaggtgtgtgtggtgggtagcactgctgtggctttaatggaggcttgtctgtgacagaatactcagcaagggacacgggggactttgctggcttcttcccggccgagccctgacatgcacacaggtggactgggatccttcagcccctgtgaaaaccaggcctggcccagcacgaccgacctgggagctgacctcagggcccttcactccaaaattcacctcaagtcaggtgagacccatacatcatgggtccccactcacaagttccaggtgggaagaggagccccttacatggatctcagtgagggtgggtgggacaggagcagcccaggcagattcgctggtgcagcgcaagtctgctaagcctcctcccgcatgttggaggagccttggtgacaggccccagtgcctgagtccacaacacgcccaggccacagaagccaggccaagccccactgggtgggaggcccaaagtctctccccacttctgggtggtgagcccatcactgagccgtggcctcgcatccacactacaccaggagagggtgatgacaggagggggtctgcttcatcatccgctccctgtgggacctgtgtcttcagtgaattaatgagtttggggccccacatcccctcagctctctttggaggctctgggcaccctgacccttggcctggcaggtgcacccactgccataggcatgcgcatagccggtagtcttctcagtaggcagggcaggcaggcacggcgattcttcacaatgggcaggcgccacagggcctcagatgtcggcgcccagctctgcgcactgcttgtctgagatgtgggaggccagggagtctatgatgtccagcagcagctgctggctcagcgaccgcagggtgggcaacttggagacctgtaaggcaagcaggccggaaggagatgggaccagatccacctaagggccatggtgggcagtggagccctgtggggcctaccctgctcagggctcaggctggtcccaaggatgaagcaaggtgcggccagtgatgggctgctctgcttctctcacccccagggcccaccactgcaggggaccacagagcctgggcaccctccctgcctgggcatggccactgccaaggggaagcgagtcctgaaggggaggccagagccctgaccttggtgaactggtgcacaatgatgtgcaggcagtgccgcttcatgtccagtgcctgcgttttgtcagctgcctccaggatctgcaatggcagggaccttgaggcgctgcccctttcacccactcagtgggagctgcagccatgtgcacggggctggggggctacctgcagcacgttctgcaccgtcacgttcatctccaggttctgcttgcagtacgcctgcagccggttgttgtagaagccgtagtagtagggggccgcaaacaagtagctggggcctggttaaggagctgactaaaggaagctggtccgcccgcaccctcccagggaaggacagggaagggcgcagctggagccccaagcccccacgccagcatgctctccaaatggattctgaactacttagtgggtcaaaggccccattcaggatccaaagaaaaccatgaatcccctcccgagaaaaatagtgtctgtacatctgtagcgctgttccatggccttgcaggcctaacaggcatcctgaccctccatgttcagacccctactgaagtgacataaggagtacctccatgtctgtgctcaactgtcacacaaagcaatgacccaccccgtcctctgggcagttgtgagggtcaggaacccactggttcctcctggctgcaaacccctccttgccagctgccaactgcttcagagagcaccaggcccagccccaggcaccagcaaaccctctggagggaggcgctgggcccagatcacctagctggggcaggagagcgggcctcaaagccacctgaggtgggtgccaggaccccttggtggggacctgggagttcactggggagtgaggatgcagcgagtcctcgggcggcatgttgacctcgccgtagtagatgtagcgcagcatggactcgaaggcctgcctgctgggcaccatctccccgatggagatgttcacctgcccatcttcgggcatgaaggaccggaacatggcttcaaagtagctgcagacaacgagcggtaggcacctggccgtcagcagaacgaagacaccatccaggcccaccctcccctcctgtccagcccccacccacctggagcgggcggccaggatagccttgtgggctggccgtgggtgcccgtcaagcaacagagtgatgtcacagaattccgcgcccgctccctccaggtatgccttcatgtcctggatcagagatgtgcctgggggtaggagggtccctgagcaggtacagcctgggattctggccttggggccccacggcactaccttcctgcatatctgcccatgttgctgccctgaacaaaacttcacccaggcagaaggcctcactcgccctgaggtaccatcagccacattctgtcctccctcggcgccctggccgactcaagcactatgccccacgcacagcccaccacccagcgtctcatcttccacccagcttgctgtaccccctcgctgacctcatgatcaagccccctccaggcccactgcatggcctctggtgcctgcagacatcaccaagagccagcaaccggggtcagcacaagccccagggagagctgggggaatgaaggggcctgtgacattacaagcaaagagaagtccagagactgatcaccgtgaccctgggccatcagacctgacatcctagcccgaaagaggtgccccatgtccacccccagaaattggctcaggaaatcccaggtcaccaggacacagcccactgtggcaagccccatgggtcgggggcttctgccttcatctgtttcctccctgtacccaggagagcactctggggtcccatggcacccacccccaccccgagggcctggcaggtgctctccatggctcccaatctcctaccgcagatgaacaccatccctcccagcccccagggaaggggaacggggctccctaccaatgtccactggctggtccaagggagtgcgagggggcggctgctgcttccgccgcacaatctccactatcagtggagaggagaggcgctcgaactccttcatcatgatcacctggttgaagtgggactcctttaccacgaagttcaggcagtgctcctggggcagacaggcacaggcaggcaggcagagtcaagccagggccccaggctgggcgaggggctcacagtggtgggcagggagggggcctaagcctgagcacaccccacccaaccctgattgcgctgaccccaccccacaccttgagttggctcagctgcagccgggcggcactctcgcacacaaccagcacgttctgcaggtccacggaggcctcgatgtactggcggcacagctgctccaggcggcacaactggaagctcagtgccagtttgtacacatccatgatgagcagcacatcctccacatggcctgcgccccagagcccccgaatctcagggagccggagaggggagggcagggcacagggcgcagggctccccccatggaagagtgtgggctggggccactaggtaggaacaaggcctcgggggactcagatggcgtccagctgcagtgatcatgggtaaggagggtgacctgcagcctctgagcctcagggggcccatcagtaaggcagggctggcagcacccaccttttggctctgctgcccgcaccccagcccacaccaaccctgctccacccccacccaggcggacctttccgtgggtatttgatcttgtcggtgtagaggaactgcatgagcacctcgaagggccgggcctcggcctcccggatggccacgtgcagcaggggcggccgggccccaccagcagccacgccgggggcctccctgggaactggggcggcctcctgctccagcttctgtggggagaagggagctcaaggacaccccagtggacaccaggcatggctgccaggtcagggcagggcggttaggcacctcacctgggccagcctctcccgcgcctgcgtgatcttcctgcgaagccagcggctccgcgctgtgacaatggctacgtggccctgcacgcactcctccttctgcacaaagaatgatgcactggcagagggcacaggaccctcgccccagagaacagagacccagccagccaaggtcagcaccaccaggccagcagctgtttttctgaggggcgaaattcccactgcccaggcacagcaggcagagcagggtgcgaggacaggcacccacctcacccagcacgaactccacgtcgcagaactggcggctctcccacagccgcccgtagtcctcgtgcagcgtgcatttagggtaacaggagaactgcaagaggggcccagtgagactagatgttgcagacagcagggtggccccagtgtggctgtgcaggccgaccctgaggtccccacctggcccatgctgaccctcagggcccaggaggcaggtgggcctggctgaggagaggaagcagccgctaccccaccctgaaaatacagcctggctccagcctcagcacctgcaactgtccacggccggctccacagcaggaaagggctcccctgcctctcttgccttcggctgggccccaggcctcagcagagctctgccgtctccactctgcctggacctgcgtcctcacactggcccccaccagcacatcccaacctcctccaggaagctggccctgacctcactgtggctgtgagtccctgccctgaccacctgctcctccaggcctgggaaggggctgtcaacgcaagccactgtcggccctggctctgccctgggccaggctatgatgcctgtgaggctctggtgctgagcccagcttggcccggctccctccactgactctgccgtgagccccagcaccatctgcctgccccactgcacgaaggctgcccactttagtgccacctcagcccaccctcagcccacagggctcctcccaaggcttccatcctgccaggtgtggccctggcaatggcctggataagccctgccccccaacttggcctcagtttctcatcacgggggatccgtccacccagccggctctacaggcccacaggccccacacctggaacctgtacatctccccgctgcggatgttgttgtccaccgtgcccccgaagatgtacatggcgtccgagatgacagcagccgcgtggaagagcctcccactgggcagctgggggacaagaaggcagggtggaatggtgggggagcagagcctccacagtgcggctggtgcagccaggtaaggcaaggatgcggcacctcatggccatgaagggccagggggcagggtccccaagggatgagggcccctgggtacagacacaggtgggacctggtacccatgtaggcgagtggggcatgacgggccatggagaccctcagagtggtcagggcacttgggccagtgtgtggcacccaccccagaaagctgcagcctggccagcagggtgagggcccttggccctgtaccccctttgtggtgtgaccccaagcaagtatttctcggggcctcagtctccccatgtgtgagaggtgttgatcacaggacctgtttcagggggtgatggagtcttaatgaggatcccagcctgtacctccgaggcaggctgggtgggctgcttggctgaggtggtgccaaagtccaggccaaacacatctcgggacttcttgaagccaacccgctcctcataggtcagggtgggcacctcctcggaagcacaggctcgctcgggcacttcagccccaccaacctgaagaggggagacacatgggcatgagaccagttggcaagggccaggtaggtgcccagagacccccaccatcctggccttgagagtgggttctgaaagaaggaagagctgcatggccgtgggcttcccaggaaaggtctgcagcacagcagccccatgcagccatgatggggtgtgaagcgttaactacctgcaggctgtggggtgaagctggggctggaggccggggcaggtgtccagggctgaggcccaggtgtcctggccttgctcctggtagctgtctggaaccccagggggccccaaagctgtgaggagctgggtgggagcagggtaggagctactggtgtccagctggcaggtcaggacacccctgggcaccctcacctcgctgtcggagctgggctggacgacctcccaggtctggaagtccacgtcatagcagtgcagctcgttgggcagcgtgttgtcggccgcacccccaaacacatagaggtggcggtcaaaggccaccatggtatgcccgtagcgccgctgcgggggtggtggggagccccggagcaggtgttcagttgggatgcgtgtccacctgggggtacacaacagtgaatcaatgctgggacaggggctcctgctcaccctcggggcctccccacagcaggccttcactgggaggtccccctgcatcccttacggtgactagcccagggtccagagggagggcctagacacctgcgctgagcacctctcaccccatccagcacgggcaccagccctgcctggctccatgtggcccaccgcagggtcctgccagagctcccccctctccccatggagcaggcagcagtgatgggcaggagggtggcatctgacccgcccaggcagtcctgctctctggggagtaaagttgtgcagagaccattgcaggtcactgtgttcacgctgcccagtcagagcatccccacagctgagtccccatcctgggagctgcctgtaccccacatcctgatgctgccccagcaccttccacctcccaggcttcccagtacctcccagcaagtcctctcttttgctaagttagctgaagacttcagaacagatcctggcctggcagggctatgccatctggctccatgctgagccccaggcccttgacaatttccctcatcctggggctccctgcccttcctcccacgcacccgtggcctccagggaagctcccaagtcccttcccaaaccccctgtacctgcagctcacactccttgtgccctctcctgcagccccattgcagggatcaagggctggccagcagccaggggcagcatgggccagacctctcaggacctgcaggcccctctggtcttctgccattatttgagatctatgcaggccacgtctgttactggtggcactgaccaagctattcacgaggaaggggacgtccttcacgttcagagggaggcctagccaggggcctcctcgccaggccttatcttgctaagctgtagccatatcctggggacctgccaggggcaccgcacatccctgctccgggctgtaacctcctgctgtttgcagagctcacaaggatggttaccatggccaccaggtgcaagaggcgttcttcatattcagaaggattcgagggaactgaccgtcctccctccaccccactggccagagtactcacgtcttgtccttgaattcaaactggaagaggttgttggttattttggctccgctttgcccagagaatacaaacatcttgtcccggcacacagccacggggaagttgcagcaagatggggggatctcgccactctgggccacctgcagggggagaggacagctcagccccggcctcacagggcccgctcacatttcaccacactcgagactgctgagatgggactgcttttattcttgaaacttccccagatgaggattcacagattcctttgtcttggaacagctcatagccctgtctcatccacttcacggggcccagttgtgaacagctggggttaaaatcgtcagggttaaatcatcaggggctaaactcatgtttttcatgcccagaagactgaaaaacaattttttttaatgaataaataaataaattccatgtttctaaaggggaaagcaagcccagggggagctccagggagcaggacactggatagcagacggccctcactgcactgaaataaagggtgcgttaaagcaaaaccacatcctcacacacgtggcactctgcccatccaaagcaccaaacctcgaatcactgtgcagccacagtgaggaactggtcgtgaaggcccgcaggtcaccagggaggagagcgaggctcaggtcgaggctgggctttgcaaggggaagaaagcagcctcgacccccagcctggctccccctgcctcccacctccctccacctgcaccctgtctccccatgcccctcacctcctccacctgcgccctggctccccgtgcccctcacctcctctacctgcgccctggctccccacgcccctcacctcctcccagcaggtgagctctcggtcctggaggccaattgtccacatgtcattcaacctgtattaggacagaccagtgaggaccccttgggtctggtggtcagggtgggcctagtcctggctggaagggatggctgcagggaggagccccacccccacacagggtaggagacttgtgcggccatgaggcgggaacttctgtgtggggtggcagccactgcctcaaatccctgctgtgccaggccccctgcccggcccagacagaacaagtactctcatgcatgacatcagggcagtgtggcagtgccagctcctcactcagtgtccctcctgggtggggagaggacacagatatcccagatgccaccatcactgcatcgttaggagtttctatgatgctgaagttttgggaaaccagcatatgctacttttgtgatcagaaaaagagagcaaagccaactttctaaaataaggaggaaaaggcctttggcctgggcaagaaccagggctgggcctgagcctgggcaccgcccacccgcccaccaactcagctccgcagggcaactcctggctgaggatcctcatccaagctactctggtagccacggggctccacccagtggccctcacctccatctgtccatcctcctctttccccatccccctcccaagaaacccccagacagagtggcactcaaaatccaccaggcactcaaaatcctcccagcctaagccctcaaatgccaggacggcctgctccgggtctcagtgctgtcggaggtggggtgcacaggccggaccaccacccacctggcgttgccgtcatagccagcaaagatccacagcttgtcactgtacaccgtggccccatgggctgacctagcgactggcaacctggagtgtgagggaagaggggagggagtgaggccgcccagcacagacctgagccacccagccccatgtggtcagtgcaggggccacagccaggctgcatggctacatccacccgacactggggcttcaggacctccacaaggcactaggaataaacaacagccccagaggccgactagtggcttgaagaggaattcagacagccacagaggcacagaaccttctcctaggtgcccccaaaatatcaaagggggtgctcaaaaagcgggaccccagaagcgccatcagcagtacattggatcttattgaacatttttttgtgacaaggtcttgttctgtctcccaggctggagtgcagtggggcacacatggttcactgcagccttgaagtcatgggctcaagtgatcttcccacctcggcttcccaaagtactaggactacaggcatgcgccaccacgcctggtccatttgggtctcttctgaaaggagggagtctaagggctgggagcaggccatgcatagctgcaccgggggatattccaccaatcccaagctccctgctattgcgtgccctcagggtcctcatctgggaggcaaaagggggcagatcccaggtccaatgccacccaggacccagcctgtcccaaatgtttctgcaaagtttctcaccgtccttcaattttccactccgtccactggccagttgcaaacttgtattcaaagaggtcgtttttattcttcaagttagaattggaataaatgtccccagtgtaaccccctgagtaaagagagtgagaaactgtcaaacccaaagggcagtcttggagatttcaaaccctggaaggtggagcagaatctggcccccctgaaaatgcataagccaggactccttccacaagccccggaacgacctgctgcctgtctgcctctgtgctgggctctggggacacagagatgagcaggacactgttcccagccacagctcagtaacacagaaagacacccaaccctgtgagctcagggccgttagggcaaggggtcccagatccagcgcagaattccgaagactggcagacaaagccacgggtggagagagagcccctgctgtacacagcacgagcacaaatgccccaggcctgcagaagggcagggtgtctgtgggcctcggggcgacacagcccctgggaggcaagaggctgcttaccaaagacaaacatgctgctcccatagacgacggccgagtggtggtaacggggggccggtggggtcccagtggtaaaggccctggggtgggcacaggggtggtgagagtcagcgggggtcacccatgaggtccacacccccacagggtggccctgcatccctgtgctgcctttcttttttctttttttttttttttgagacggagtctctctctgtcgtcccggctggagtgcagtggcacgatcccggctcaacctccacctcctgggttcaagcgattgtcctgcctcagcctcctgagtagctgggattacaggcacccaccatcatgcccagctaattttttgtatttttgtagagacggggtttcaccatgttggccaggctggtcttgaagttctgacctcaggtgatccgcccacctcagcctcccaaagtgctgggattacaggcgtgagccaccgcgcccagctacgtttcacttttgtattttgaaggtgatacctgtctcatcatagaaacttaaaaaaaaaaaatcaccaataaggaaaaaacaaaataggcactaaagctcatgcaaattcccattaccagaaaacctctggcaacaccttgaggtcttccctgcacacctctcctacgcatacttaggcttccatgaaattttttaaaatggaatcaagtggcagatattttgtaaattgcttattccactcacagaatgtgaccaggtcctcatgctactccaggaccatccacactcctgctctcagcagcagtgcagcatcttacagcacggggtccatcaatttcatttaatacctatctatctaaccatcatctatctatctacctatcatctatcaatcatctaatctatataatctatatatccatcatctatccacctatcatctacctatataatctatccatcatctatctgtcatctatcatctatctacctatcatctatcatctattgtctgtcatctatctacccatcatctatctaatctacctacctatcatctacctatcatctatctatcgatctgtcatctatcatctatccactatctatctatctgtcatctatctgtctaatctacctatcatctatctatcatctctctttgtctttctatcatctatctatctttctttctatctatctatctatctatctatctatctatctatctatcatctgtctatctatcttcctagacagggtctcactttgttgcccagctggtcttgaactcctagcttttttctgagttttatacttaagcaatttttgacaaataattgtgaagccttcagaatgattttttaaattaatttgtaactactagccatcttacaaaatcaagtgtgagagaaaagacatagcaacttctgtacccatactagcatcagcctcgaggtagaggtggacagcccagaagggtgccgccctgtgtgcccagcttggcagctgcaggtgcggggtggttacttgatctcctcagcctgacagggcggctctggatgtggcatccctgaggccgtggttatctcctcctggaagcttctttctagcttcccatgatgagagagactctgctagcaactgggacccagcactgtgccactgtgttctaggaggaaaggcagggccctggagcacggggccacccacctgcaccaggagcagtctttcacatcgaaccgcaggaggtcattgagcatggtcttcctgaaaggcagccggaagagagggtggcattagccaggtctactctgcagtgaccccagagatgggcactgcatgtagccagggtagagtagggggctgttgtgggctgggtcactaacacagccaggcaaccagctgatgcccaagaacaagagtggtgaccacaaaggaggctccccaactgatatgggcaccagggctgccacacaggcagacaccagcctgcctggggtcaggaccaaagcatgaatgtggccaccaggagcccaaccagcagctgacatgaaggcatgaaatggcccaaaggccagagtcaccctcacacctcaccctagcctccagaacccctattcacacgtcccaatccccttcctctgcagctgtaccctgcaatgcaagtgcttgcccgtgcctcaggagaggccctttgcttctctctgatcttcctgccacttcttaaaaaaaagaaatagagacaatgggctgggctcggtggctcacgcctgtaatcccagcactttgggaagcctaggcgggcggatcacttgaggtcaggagattgagaccagcctggccaacatggtgaaaccccatctctactaaaaatacaaaaaaattagcctggcatggtggcaggcgcctgtaatcccagctactcgggaggctgcggcagaatcgcttgaacccgggaggcagaggttgcagtgagccaagatggcgccactgaacaccagcctgggtgacagagcaagactccatctcaaaaaaaaaaaaaaaaaaatagaaacgaagtcttgctttcctgcccaggctcgtcttgaatgcctggcctcaagtgatcttcccacctcagcctcccaaagtgctgggattacaggtgtgagccactgcacctggcccctgccatttctttgttgcaaaagccatacaatcaaatagaaaacaaattcactggccattgcaccacctaacactaccagctggcatatcactacccagcccttgggaagaagggcaaactgacaggagcccagtgccccgtcatgcccagcctgtgctgggtgccccctgaacggtctcacttagtctgcaccagtgggtgctctctcacctccatttcacagatggcaacaaagcctagtggctcaaaggctgtgtctgaggccatgcagccaggaagccaggagcctagaagctggtggtgattgtgataccgccccccccccctccttacttgccccacgtgccgcaggaggccatctttctttgtactcaggcagtctttataaagttaagactagtgtgagacaaatttgtatcctatttctttgtcatactgcagcaaaaatgtttctgcttattgctacacagttgtcacacaaactacctgctaaggacactcttgaggatgaaggtcccccatttcccacttgctgccttgtactggacactaaagccctttctggtttggagggttctcattaaggctgcagtaaatgcttgtgggtaggcatctcttcttcatttcattccttcatttgacaaacatttatggagttttctagatgccaggatacaatggtaaaaggagcacaggccctgccttgactgaagagatggataataaccaacatctgtgtgcctcaggaacaaatgaagatggtaagaggtatggaggggaagcaatggtctccagttggtccagatggccaagtaaggcctcagtcacaagaaacatcagaggaggggcaggaaggtgagaggagagaatgggcagtgcaagggcctgagcaggggggcacttggtacaatccaaacatagcaaggcagcccgtgccgccccagtgcagtgagggactgagggcagaggagcagcagactctcatgaggacttgggcttttactcagagaggcagggaggcattacaggaggatgagccaaggaggagcatactctgacttgcttttgtaaatgggccccaccggctactcctggggaaagagagtgggaggaagacaggcttgaagccaggggaccatgcccaaggaggctcttctgcccagtatgcagatcctggtggggtccagactaccccaccatcctcaagcccgccccccaaggaggcctacaggaccaaggctgcagagccagtaagaggccagaccttccagggcttcatgctagttcctggggctgagaggcagggctaggacacatggacacaactagtcatgtgcaaatactccaccctctgcataaggaaaccagccacaacttaagtggagacagtttatgtgaaaggaggtgtgcccaccaacaaaacatcacgttgttgcctgatgtttggagcaatttgggaaaacccccacaaaaagtgaaaaatgcatgaaataaataaaactgtgtcctccataccgatgaggcacagggaaagaaaagtgcctggcagggctggccgcaagggtggttgtgtttctttcaaggctgcatctactcagaagagggacatttccacatactgagcatgtgccacccactggaagctgtgctgaggaccatgagtgcaggatctcatttaatcctcaccacgaccagggaggtgagtgcaaggaatctcacagatggggaaactgaagcttagaggcaccagctagcatctgaaaggacagtaatggagctggacaggcccagtccctgaccacagtacttctccgtacctggtccaaacactgatgctgagactcactcacccattgtctccaccaaatacataaatggcatctttataggccaccactgtgtgcttgctgcgcctggaaagaaaggagtggagggcggtaaggacaggaccctcctggggggcacccaaggaatgggactaagcaggagagctgccacggaagttaggtatcacctctcaactgctaagatccatcatcttctaagataacaccaatcatcctgcaagtgaggacccctgacacggctccaggactctctggactcctcaccccacctcagagcacctgggaccccagcccaatatccacaaacacaacttagttccagtaccctgtcccgggacatcgggctctgggactccctcggaaccctctcccctgccctgaacagcgtcctgtacagcaccatccacctcattaccagatcctaccccaggacaccaccccccggcttcgcccctggacccgccctgggaccctcgcagatcgcccttcctgtcctcaggaccccatgaagcccaccgtaccgggcacccacgaactcgtcgcagggcgggaggcgccgccagcgatgcactgtttcgaagggcccgaagttgagcgtcaggtactcgacactgtccgagcagctatggtcgaagtccacgctcggggctaccttggaccgcgcgccgcctgccagggccgcagccccgatctgcccccccgtgctgcccggtccagccatcccgggtccacgccggatcggccgcgctgtaagcccaacttgcggccaccgccccgggccggctggagaaaccacatttcccggcgagccctgcgctgacggtgcggcacgtccggccagcgccgcacttgcgccctccagctcttcccgacaagcctaccgcttgccgagacaccgcgggcgagcgcaggatgcggttgtcgaccgcgcggcgagcgtgggaccttctggggagcgtttcaggctatgtactggcgctgcgttgtcccttccagtgaatgcagtgtgtcgtccctagccccgtcgcgactgctcttcccggcgcctcccaggcccacgcagcccgaagacccgcggccggctcgcagttcccggcatgccctgggtctgcgcgtggctccggcctggatcgtctgccgctgccgggatcccccatggagggttccgggctcgcagcggcctctgcaggcggctcaacgctccctttcctgctagcgccctcagccctgacccccagcaactcccctctccccttggctttcttactgactgagaggcagcccggcgaggagcctctggattctcattcctacttagcagggcctcagctccttcacctccgacatggggattgagaatgctccggctatgaaaagcatggggtctgtctcaggacacagctcccacagccctaagtgggcaaatgccccaaagtgtcaagcatgagccacctctgaaggagcatttactatctcaagacctttgggcatgttgtcccttctacctggaatacccttccttcaaaactcagagccaaaagcaaaaagcgttcgctgatcgcagagggggagagggatgtgggagggcttggggcgcagaattagttgctacctcctctgggcgttcacaggccaaatttccttggtgtggcacctggcattctgtgattgtgcctgtttccctgtggtctggtcctgtgcctattggcccaattacactgggagtcatacagatctgcaaatttgtgcgttttaattttacggtaatgtttaacgtgttgcagggttcttcaggggaccagtcccaatagagggagaagaggcagggcttgtcctgcctccagtgccagctgtcagtggcagcagaggccttgagggttgagcatcttctggatccagcagaggcctcccaggaggggagccaggtggctgaaggcaagcactgggagggctcaggttctgccctgggggatcctgggactggagattggcacctgcccccaaggcttggcctgtgcccttggtgccccctttgcctgcccaagtctactgcatgtgagctcaggatcctttccccgtaagccaggacatgtcgccagtcctgcaggagtgaggggaggaggggtcaagacagaagaaaacaggctctccactctgggcaccctgaacagctggcccttgaggacagcagggggtctgttctgtgccagaccctagtgcccagcagggaggtgtacttggacagagggagataagaccattgggtggagggtctgggctgacatgggaaaggctcagaacggtcaacatgaaggacacacgtacttgctgtgcagcacaaacagccttcacgaaggcaagagagagaaacggagagaaggccaaggagagagcatgtcatttatcatgtccccttctggtcctccattgtttccagcctgaagcctgcccctgtctcatagcctcccagtggcctccaggctgtccccagtccctgggagctctctcccagagggtgaatctcattgacaccacaccaggataagggaactggctggtgttgagtgaaacctagaaccacccccaccatctatgtggagggcatacccagggcatcagtagctgcatttcccacctagcttctgccaggctcagcacaactatgtccagttaggtgtcccacgcctggtgattgcccatgcattgggccctgaccccttcccacagcactggccctgcctggtgacacacatctctatcccttccatccaccatgaacacataaccagcctgctctcaaaccatgatccttgccccacacctccctgtagtcctgtaagcctcaggcgatgcaaaccaagaggggaaaggccctggagggttgtgggggcggctggctgtcataggcaccttagccagtactccagggaactactcccacccccaggcttcccacacccacactcactccacctcccgcttccggatggcacggcctgaggccagcacctcagcgaccttggacacaatgggatcgtagttcatgctggccacggcgatcacctcgtcgcctctgcaaggagaggatggccaagcctgaggactgcgaggcagcagcccctttttgaaaaccctgatgcactgctgtccatctggggcccagggaaggacctaccccagggcaacaagaatggcctgagcacccagccctccctgctttgcacatcgcggcttgaccgtgcacaagcttcgggctttcctaaggaagctccagcactcctcagcggggctcagggctgggctcttgttctgggattttgcctgggatgaatcccccttcccgactgagctcccgctgcttcgcgccaagctgcaccccggtgctctcacttagtgtaaaaagccacaaacttcagctcctccagatccccctggatgatgacgtcgtcgaagccttctccgtagcctgtgggccgggcaggtgggtggcacccacgtgagccgggggagggaacgagacgtcacaggatcccctcctaaccccgcccaggccctgctccatacgtccttttaggtagttcgtagccttgccgccagcgagttcttaccggcctcttcctagtgcggtcatagccctgcccctaggctcccagccccgccccacacccaagccccgcccctaaacgccctcggccccgcccccatccgaggccccggggttacccgcgtagcgcaggctcttgccaaacatggcggtccagaggtagggcacagtgctcatctccgcctcctgcgccaacatgttctgggctgccacgcgccctgcgggacccagggccgtgagaaccctaactctcgctcttaccactcccacactacctgctcctgatgccctggggacccctgacacgtgtggctactcctcctggtctccccagaggtcaagagacatcattgttcagcccactgctcacttgcacctgcagctgactggtgcaggggaacacctgcctcaaagctagccacttgattgcttccttaaagaatctgaataaagtgccctgactctggaaggtctgcttcttggggttgggggagtacgccaccatttcagctgtgcacacagacacctaatcagacgtatcaggtctgaagagggaggaaaatggggcacaagtacacagggaagcacagatgacagccacacacaaggccccaaagagaccagtgtggatggctccccagttcctatgaggccccagtagacccctgtagttggatgtacttcaaagtcccctaaactctctcagttaaatcctaattatacttggctgataagttgccttggttacttacaacctagcaacaactttcgactttggacttgaatagaaattggtaccagaagtggggtttcaagcagcagaccctcaggtgtaaaggcagaggaaaggggagatgggtgcagagaagtcctttgtcccaggctgggagtctggcagtcctctctctgaggcagtgaggcaactaatgtgatggcacctgcagcttaggggcccagaccagatgtgcacagtggatgaggcttgggggacttggtggccagcaaacatcaggaggggaaagctattcctcagaaagcacagtgcctccactgagcccacgtctctgggctcagatggcacctcggggacctgcatgaggctgaactgagttcacagagatacttgagtggcccaagggaaacagaggcataaatgggaaggtgatccactaaatccctccctccctccccagggtaatgcacaggttgatcaggaattctgcagaatatatgtccttgaagacaaaaaagggagagactaccagaaggaaaactgagattgaggagctatggctggctcagtggggtgtcgctctctgtgttggctggatcgccgagatgaggctggccagagaatccacatcagagctttgatgcctaacagtgtccaggacccaaggtcagcaactgaggcatgggcatggggacactgagaccctgagactccctcccacccctccatgtgcctcgggactggccataccctgagcatgagccatctgccaatgtggaatgttcactttgcggttgttcctccaggcaagggggaaggtgacagcatcgccagctgcaaacacgcctgggacattggtctgcatcatctgtagagagagggcccagagctccatgggtgtgacaggggccctgacctgaacctcctgccactcccagcccagcaccgggtcctccccacccagtgccatccaccccaccttgttgacagggatgaagcctcgggaatccaaaccgatgccgctttgcctcaggaagcctgtggcgggcactgcacctgacaggacggaagcctgtgtccactcccctgtccctgccttctgcgtagtcactctccacaccctacagcatgcgcttgatgtgccagccccagactgatcctccaggggctgtctacctgaggccttcatgcaccctggtccccactacccggtctcccacagacccggtgcctcccgcaagacctcagatatcaccttctccaagaagtgctccatgaggcccttaagtggagggacagcatgccatacctcctcagcccctgcaggtgctaccacctcccatcttggcccctacccaaattggcacttcagctggagcagaagccagttcgagtctcgtctatgtcaactctcgcagggcatggagatgagtgttactgggcagcgggcactgggagcatccactgtgccaggcctgggctgagcccagtacataccttccccaacagctccgtaaagtgggggcggttgggggttcccatttgacagatgtggtggaaactgaggctctgggaggggaagggactagcccaaggtcacatgtgagcatgtgcagacggctgggctgctttgtgcctgcctgcccacacaccaactcaccaatgcccaccacgcagacgtcagcccgcacgaccttgctgctcttcagcacaacctccttcagctgtggggagtgggtggataaacaggtggacccagctcccaggctcaggggacagaggacagaaagcagcagggagaagggagaagggcccacctttccctcctggccccgcagctcagacacctccgtctgcatgtagaacttcacccggttgttctcaaacatctgtcagggcaagtgggcaggtgggcggtggatgagagcccagccaggggccgggctgggccccagggctccaaggcactgggtgctggggtgggctcaccttcatgagggctcgacccacgcgctcccccaggaacctcctgaagggcgtctcctccagctccaccacagacacagagtgggccttctccgtcaggtaagcggccacctccatccctggtgatgggcagggggtggcaggctggcacctgcaccttcctcgaccagaacttccctgggactggccatgacgacctgaccaccatctccactgcccactacctctcacccaggaagccggctcccacgacgaccacgttgcggcctcgggccagcctcaccacgcgattggcatcctctggcgtccggatagtgaacacgttctccacttctttgcctttgcagctcagagtcttggggctgagacatggccgtgtcagtgagggcctcctggcagccccagccccgtccaggccagtgccctgcctagtgtccgatgggtaaaaaggagaccctcccacctgctccctggtgccagcagcagcttgctgtactccagcttgaagccatccttgaacacgaccttcttagttctcacgtccactgtgaccacctgcaatccccaccaggcagagcatgagcttgggcatggggctgggcctcgccgcccactccccggtcctgcagtacacccacagcccagccacagcctctgagaagctcccattaaaacagatcctgccacctgggcttcattctttacgcttcagacatcaccttcccctcaaacctctccttaccctcccaagtcccaccagtatctcctatccagccctgatcgttcatctccacacaccgtggggctctgtgtgtgcctatgacccatcaggaaaaagctccttgctgtctcccaagcctggagcacctcccaggtgcctgggctgtggggccaggaaggtagagcaccaagaccccaccccaggggcccacacaacctcacggttcccaccttccctcctcgggcctgtttcccacccttgaccctgtacctgagcctcggtgagcacctcgatgccataggctcggaaaaactccttgggcctcagggccagctgctcaggctgtgtgtccagggactgcaggggagagccagcttgagaggagccagtttacagcagaagacactggggcccagggaaggtggggccagccccagtcacataggggctgcaggacagaactcagcaaacccagatctggccaggcgcagtgactcatgcctgtgatcccaacactttgggaggctgagacaggaggatcgcttgaaccaggagttcaagaccagcctgggcagcatgacaaaaatgacctcatttctacaaaaaatacaaaatattagccaggcatggtggtgcgcgcctgtagtcctagctacccgggaggcagaggtgggaggatcgtttgagcccgggaggtggaggtcgacgctgcagtgagccgtgagacaggcactgctctccagcctgagtgacagagcaagactctgtctcaaaaaaagaaaagccaggtgcagtggctcacacctgtaatcctagcaccttgggaggctgaggtgggcggatgggctgagctcaggagttcaagactggtctgggcaacatggtgaaaccccatctctactaaaaatacaaaaaattagccaggcatggtggtggtgcacacctgtaatcccagctactcggaaggctgaagcatgagaatcgcttgaacccaggaggtggaagttgcagtgagccgagaaggcgccactgcatcccagcctgggcgacagagtgagaccctgtctcaaaacaacaacaacaaatctagatcttttgggggtaccacggacaggcctggcataagcagggagggcagccggccagaccccaatggggtgacaagcaaggcttgaagtgggcttaactgggacccagagggatagggtccctacttgccccaccccctgtaccttgctgagcttgggacggtcgtagggaaggtgccggtctagcgtgcacaggacgatccggtcggagaagccctcctgccgcagtgtctctgcacacaccaggccagctgcacctgaggggaggggcccgtgggccaggaaccacttctcaccaatcccatctcccaccctgcccctcatgaccccactaccaacctgcacccacaatgagcacattggtgctactgctgtacccagcacttggagagatacacttggccatcaccttggtccttcgctgcagctgtagggcctgtgggtgccaggagggtggagggtcactgccatcctctgcatgccatcatcctggcaggcaggtcctggcgctccagcccagcctcatccctaccgcaacccctcactctgctccagtgacacgtgccaagctcctcccaccacagggctttgcacatggcattctctgggccaagatgccctcccggctcctcccttctgcctgagccccgagctatcccctcacctgcttgctggcccggacgtacaccttctccttctcaatcttcacctgcaagggctgcattgctcaggaccagccccgaaccccacacccccaggttcccaccccatcgcactcctggccccacctggaacttgtgtagactgtccaggccagggaagtcctccaggtccccagtgctgatgttgaagcaggcgccgtgccaggggcagcgcacccgaccacgggacagaacgcctgggaaggggaggtgttaggctgcgcccaccagcaggggttgcttcccaaggatctcagtgccccggcaactgcgggcccctccccacagcccaggagacttcactaatagatgaagatcctggggtctggggaggagccaagctggcatggggcctggaaggtccccctcacgcctcccacctgacagctcacctttcaccaggggtgcgccgtagtgcggacacttatggcccagggcgtggaactccccattgtccttcaccagcaacaccttcccccagcccagctccacttcccgcatcctggggaaccgcagcactcagaggtcaggccagacaccaggcacaacctcctggcagctcctcccagtgtccagccttctggggagcaggcccagaccggtagaagccacaaaggcagtgaccagggcagcagctggtcatagccccttcaggccaaccccgacccccggctatggccccctcaccctcccaccttgggacccctgatccccgctcccaggcaagcccagaacccactggccattctcgaggtccttgacgtggcagacagcagcctccacgcaatcctgagggctggggtaggggtgaggggtggacaggcgctcctccgtgtggaagtggcgggccgtgccattgccctggtaggcccgggggctgcccttcccactggccgacagctcctccttgcctcgctccttctcaggcagcaccacctcgatcttgagctccactgtgggcaaggcagcgccttgagccccccacctcagccaacttcctcccccatccctcaagctgggtgcagaggccagctcctcggggtgccaggaggctcagccctgcctggcaacctccccagaattccctctgcaccaccagcccagcaaagagccttaaacctggcacgaagcagcggaggggcatggatgggtgggggtgctcccgggtctgcttgaattcgtttctgcatgtctcttttttctttttttttttgagacagggtctcactctgtcgcccaagctgtagtgcagtcatgcaatctcggctcgctgcagtctctgcctcctgggttcaagtgattctcccatctcagcctccccagtagctgggacttcatgtgcataccaccacgccagaggtgtggcgtgacagggttggtagagacagggttttgccatgttggccaggctggtctcaaactcctgacctcaagtgatctgcccgcctcagcctcccaaagtgctgggattacaggcttgagctaccacaccccgcctcctttttcaattacagtgttagtgagggggacacagagctgagttccttcgaccctgcagttctcctggctgcagaaacctctgtggcagaaagaaccctgaggccctacagtcctgcatcttctgatggacaatgacaatgtccctgacatctcagggtatgactcatgtacatacaggaattcaaaagtggcagcagctcagttcccagccagtgaatctgggtgacaggaagtcaagggttcattgttctagtcttacaactttcccatatatttgaatttttttcaaaaattaaaaaaaatgtacacagcataattcacagcataatttcaacttcttcttttttttttttttttgagatggagtttcgctgttgttgcccaggctggagtgcaatggtgcgatcttggctcactgcaacttccccctcccaggttcaagcgattctcctgcctcaacctcttgagcagctgggattacaggcgtgtgccaccacacctgactaatttttgtatttttagtagagacagggctccatgttggtcaggctggtctcgaactcctgacctcaggtgatccacccgcttcggcctcccaaaatgctgggattacaggcgtgggccaccactcccggcccgatttcaacttctcaaaatagctcttctcaccaatttgagaatccttcatcactaaccaggtgctgggttttcagtgtcctcgtgtgccctgggggtgaacctgagcatgggaatgcatgtggatggcacagagggggcacagccccccccccccacagcctccatacagagccacttccccagcgtgcccacggggccagctctagcggggagtgagccagagattgccattttcttctttatacttttgcacattttccaaattccctgtgatgtgcctgggatatttttctaattagaagggaacaataaacagaatttttagcagcaataatctggcctcccaggctgctgctgcagggaggaagctgagtgatggacactaagcccctggcacagcatgggcccgatgctggagcaggaggtacctctctcacttcccaaggcaccagcacctctgggttttacctctcatcccttccacctcagaactgacactccagaaaccaagaacccagagaggctgccgagatgcacctccaggcctttgcctgagctgtcccctgggctggggctgccatccttcctatctacccagacaaggctcaggagttgcctctcctggctgcccagcccatccatcatctcatgctctgctaaatcctccacgctggccaggtcccctccccagccccaagtcccagccctcagctcaggcccaggcatagcagggcacaggggcaaagaaaaggtcagttccttgaccccagcccagcagggaggatgcagagcacagagccacactgaggccatcgtatcaggtggggggttatgggtggggctttcattccattttctataccttatgtaatggtgttagaatgtttttggaagaattaaaaagagaaatactttggacttagctgacaccagctgtggaagctgtgggagctcacaaatagcctggcaggggggccagataatgccaagccaggctgctctcatcctccacctcctcccagaaggctccaagcccactcactgatgcagtctaatggaagccattaagtcaggggccctttggaaaggtagaggggagaggcgtctctgctcacccacaaaactggatcagccccagctccatgacttctggctgcccataagacctgccttagcccctttgggccttaagatgcctttattataaaatggagagaaggccaggtgtggtggctcatgcctgtaatcccaacactttgggaggccaaggcaggaggatcgcttgagtccaggagttcaagaccagcctgggcaacagggtgagatgcagtctctacaaaaaatttaaaaattgccagttggccgggaatgatggctcatgcctgtaatcccagcactttgagaggccgaggcaggcagatcacttgaggtcaggagttcgagaccagcctggccaacatggcaaaacccagtctctactaaaaatataaaaattagccaggcatgatggcatgcgcttataatcccagctacttgggagcctgaggcaggagaatcgcttgaacctgggaggcggaggttgcagtgagccaagatcaagccattgcactccagcctgggtgagggagtgagattgtctctcaaaaaataaaaaagttaaaaaaataaataaaattgccagtcgtggtggtgcaggcctgtagtccctgctactcaggaggtgggaggatcacttgagcccaggagttctaggttgctgcgagctatgattatgcgactttactccaacctgggcaacagaatgagaccccatctcaaaaaatgaaaataaaacagagagaacagcaaatgcctacctcgttggtgacagtgaatgctgaaggaaatactgtatgtaacccagagtagaagctcaatagatggagttgggcagcagtgttttaccagttagctctgagcctcctagcagccatggtgaggatggaaagcctttaggtatcagttatggcctaataaaaggcaggtgaacagatgctaagagagctgcacttcctcctagctctgagctaggtgagggactggtctgataccttcttatcaactactcagacaggacacacaggagcacagaggggaacccaggaagcaggtgctgatgcacacggagccacagaatcgagtggagcaagatagaaagtgaaggatttgcacagaggtcttctgcttgatctagtctctttgtggccccttaagaccccagctgaaccctcaggccccaaatgctgtcactcccatatctggaaattccctgagcctcatgcctgacctgcccagcatgggcacctggggcctgagcctctggctacagccccacaggggaggcctggcagcacagagcccagctcagaaaagggataacaaataatattccttgggaggccgagatgggcggatcacaaggtcaggagatagagaccatcctggctaacacggtgaaaccccgtctctactaaaaatacaaaaaaatagctgggcgtggtggcgggcgcctgtagttccagctacttgggaggctgaggcaggagaatggcatgaacctgggaggcggagcttgcagtgagccgagatcacgccactgcactccagcatgggagaaggagtgaactctgtctcaaaaaaaaaaaattccgcaagtgcttctggtgtgccaggccctcatgctaggcacaacagccccactttacaatgaggatgcagaggctcagagaggggaaatcacctgcccaaggccacacagccagaaaggggcagggctggatttgcctaagttcttaggactgcctttggtgagggtggccacccccgacactggaagtcctggggccacgggtcccaggcaggccagccatttggggtcctttaaaagaacctgcaggtggcatcttctgccagggcctcctgccagcccagcggtgccacagacgcctggtatgaggccagctggcatcatcccacccactgctagggggagacaatggacgtcatctgcccaaggcacattttgaggcagagagggatccagcccaggcctaggtgtccacagcacaggagcgggggaggaagagtggcttcttggagcagaggcaagtgggtccctctgcctggtgggtcatcacagccctcctccctcgcccaagttctcccttagacccaggaaagggagaaaagcctcacaagttccaaggtaacggagctgatgggtatcaggtaaggggagctggggtgagctggctggggtgagctggctggggtgagctggctggggcagcgtggcctggcaggttgagtggagcactggctgcgctcttgaggtctctctaagcctcagtttctccacctgtgacaaagctgcacactcctgcctccccaggtgttgtgaggagagaagagggaaagtggggggccagagggagagctccgcagacatgagtctttagtggagaaaagacccaggcctcccctagcaccccaggacactcccacttctggctggagtagctcaggctaggttggatggtgatttcctgtataaatggggaagtgtgcccagaaaggccaagaaggcagcccgagaccacacaggggatcagaggaggcaaagagagccaggatctgcccactacaccctcacagcaactctaagaggtcagggtggccaggccctctcttttgcagagagaaaaacagaggctcagaggggtaacttgcatgccctaggtcacagagtggctgagcgtgtccccagctccccccttccctggccctgggggcatagccccttccccaaccctgcaacaggaggaaccctgactttccttttccaagaagggtcctgctgttattcccaccaccaacactcaaagccccaaagaaaaaggggcacccactggagcaggggccagctgggggaactgctccaggccccctaccccctcctggcggcagcgtattaacattccgagcgggttcttggatagcctgacctacttcggaggcctaccgagtgcagagggggaggggggggagacgggggaggaggaggcggggagggaggagaaaggatggagacaagaagacaggaggtacctggtttgggtttggagaagcagccgcccatggcgagtggcctgaggatggccggcaggcaggagcacagatggggagctgtcggaggcctagggcgccccccatggggctggaccccctgcaggccttagagacgctggagccgccatcctgctggagctgctctaggacctgcaggggagactggagccatcaggaccggggcgtgtgggcaggtagagacacagagggacggagagagacagtgggagcttcggaaagagtcttacatttgagctgggaaccatggcgtgagcctgatcccagagcgtggggccctggaggtcacctcccctttgaagccctccaagctcagctccctcactcctccagtggagttcctctgcccgaacctcggccgcccatcgtccagccccgcggctgccttgcccaggaaatcctccctgatttctactgcctcctcgtgccccccttcccctctccaaatcccacagcctgagagctctgggaccctccattctcccgggagaccactatgcctaggctcaaagagggggtcaccttggggaagccaaagcccttctcatccttggtcttctccctcctacaatgggggtgacatcaggctccccctagcccagccccaccctggctagcactccggacacccacctcctcgcagggcagccactgctccgtgttccaggcccagcagtggactgaggctgccgggccttggaaggccgggcagggagggcaggggtccaggaggcggcccagcctccaccctcctcccagctcaagctgtggccaggaggggctggggggcggtgtggggctgggccagtccactggtccccagggaaaccctgctctgtggtgaacagaagtgggcggccagcccgggcctgatggggttaggggaaagggaagccaggcacacagccctgccacgcctgtgcccagcagccataagctccccctacccccgactccagcccttcacaaacgcccaccaggcctgtgggcagtcatgcccaacagcatatggggaaagcaaggggtcaaggtcccatcaaggtcaagcagcaggggcatccctgtggcctcccaccccaccctcccaccttgatcagttttaaggtgggcaggggcccagaaagcccccatatcaccctaaggccctgcaaggtgccctgggggaggggacacctgcacagcagagagatcactgtagccaggtgccttccaggctacagggtgggccttccggaagatgcagcctacaggtggactttggaaggcccagggcacaggcataagctgccttgtttgcaaatgacctccccacagtccatcccactgccatcctccagtttcctctggaagttcttcctgaagtctcacttgaggtggggctgagacccacctggtctggtccagataccaggaagggccgtgggtgggtgcctgagagcaaggggtggaaacaaaaggccaggttggagagggacccttggtgcctggcccctgcgcctgtcggtcctcgaggtgcccattacaggggaggaggcggtggctcccacagccactggggcgtgccttggctctttcccccacttgtcatcaaagaaggtctgtaaaactcaactgccacctgccccacctgccccttccctgggcactaggctgtcccttcctgggtcctggtttcagccctggttcagccctgcccgcttccttcctggctgacctcaggcctcacctgatgggccacagatcccagaaaaggtcagacctggtcttgccactggggacctgcccaggctgtgctgtcccttcccgagtacccagggacctgaatcccccagggcctgggccaggaaggagactgggtggggcccctgtgccttcggcctactgtgtgctagatcggcttggagcccagtcaccccactcaaaggcaaaggtccttgccaggggcagggcaggagggacccccagagtgcagagcgcccgagtgctattccttgcccatgagctgcccactgcagaaaagttctagcagagcccagtgctaaccacccagcaggagtctgtgtctgtcccagggaccccaggacctgtgaggcgggactggattactcccatctcacagagcggcccctgctccacctgaccctcccagggctcctggcgcccccagggtgcaggctgggcagggtcctctccccactcctccacctctcgccacctgcccccactgcctcatcccaagggctcctgcccagatcggactcccagtggcttccaggcgtcctaggggtggcatctgatcccagtcctgccttcgagtgtgggggctccgcgctctcccctcccccacggagctcagggcaagcctctgtccactctccccgcctctgcacgtgcagttccctctctctgggaagccgatgccagcagcctcgccggctccgtcccgttgcccccgccagaccttgcagcccgagaagggggactggcacacagtggggccccgcggcgagccgggaaggggccgttgtgggacgagagaaggacgaggtgagcttcggaccccggccagtgcctctggccccgcttgccaacccccagcccctaacgtgccgggccggggtccgagacttgggagcgcaagcgctggcccccggcgccggggcgaagaggcggggcggcgggcggggaccggggttccggggaccagggtccccggggcgggcgctcacctgggctcggcgcgggcctgggctcgggaaccgcttggggccgcgggcgcgggggggcggggaggcgcgggcggggcgtgtctggcgctgcgtttgcactgcggccggggagcccgcgggcccagcaccgccccgccgggccggagcaggtggggggcggccgggggacaggggcaggccgaggccctcggcgtccggaccggagtcgcggggcgtagggaggcagccaggggccgctctggccgggggcgccccgggcccgagtctgggtctccggggatcctcgcgacctcccagggatgcccagctggggcgcgggcagggtcttttttccttttctttctttccaaagtctcagaaccatctgtgggcggggtgggggaacttgaatcactctgagaaacctccacaagaaagaaaaccccaatcaaaccttgctgcccacagctcccttcactggttgggggagttcaggttccccggtgtcctaggttcctcccggccctctctccacacataccagggtctgttttcaattatattttattacattttctttttctcacctgtcatttaccagaactccttgggtctccagaaatcacagtgcaccctgatgttgtgcctcctcctccaggaggccctccctgatcagcctcccctctattagggctgattattctggttcctaacacttgggtgtttcattgtccttaatgtgtgcatctctgcgttgtaggtagaccttgtctttcaagcaggctggagcacagaggctgtgtgggttcctccccggtctgggccttgctctcctctcctgtaaggaggacaataatgacagcagtaaagtcccctgtgccaggcccagccagccttcccaggccatcctctgggactatttatgccccaccccacccagggggcaagttcgagcccccaccaccaccaccctcctacaattttacagataggaaatgcagcccagggagtcctggtctcgttcagggtcaggaacaggccctgcatgggtcacactgggggcaggtggtggggtgaccaggcccagagggcacatgtggctcagttcaggcaagtcctctcagctcatgtgttgcttccacagtgggaccgttgccactgccacaggagagtcccatcacagggcagatggcagtgcttggggctggtgccctcagtctccaaccagcctgcccccatttcatacacgtggtgatcttgctgccccacccaccttcagaatctcctctagccaggaagacagtgtgcctcatagtaactacagctgtgattttgcatgcatttatttccttacccatcacaacagcctgagaaggaaagttctctttgtattatctccatttcacaaacggagaaactgaggttcagtgaggttagggactctccagggccacacagctgctaagtggcagagcagccctgggcaggctggcctcccagatggagggctggaagcaggaggggagaggcctaccaggctcatgcaagaccacagggcctccagtgcacaatgcaagtcctgttctgtgaccttggcaatcagtgagtggacccctctgctccagccttcccaggacaccgcaggtaactgaaatactctcccagactgctgccaggacaccatgacaggcacagagccaggcacagggggtgcttgggaagtggggtcggggctgctgagtttggggtgccagagataaagctggggaaacaggtcagtgtagggactgaggccagcaacttggggagataccctgacacaaggcaagtgcaggcctgacctggggcaagtccattgtggctccctttgccgcaggcactgtgcttgaggttcctgctgccccatggtggggcagaaatcacaagatcttcgtagagcaaaagctaaaaccaagggcaggctaaaagtgctgcctctcccgaagggccctcaggcttagtggagatgcatgtggaccaggggccccaggaagacccaggagggctctgagccccgggcagcctgaggtcctgatattgccccagggatagttctggaaagacgataatattccagcagctttgacagtaccaaatggggcacatggctgcggtgagatgacctagagcagctgggaggtccctcaagcccatcagacaccccaaaggcagcaggagatagccaaggttagagaagcagtgagtgcggggaggataattccacagcctgggagagaggtggatccctaggcacccccagccctggagcaccccaccacacagcaagcttgtccctctcctccttacatgtaccctctactgtcaggttctcctgttccccactcccctcaccctagggtctccaagtagggtgtgcaggtattttaggtaagaaagtggccgggcgtagcggctcacgcctgtgatcccaacactttgtgggggctgaagcaggaggatcactgcctgggcaacatggcaaaactgtctctacaaaaaacaaacaaaacaacacttcaccttggtgtggtggtgcaagcctgtagtcccagccacttgggaggctgaggtgggaggatggcttgggcctgggcagtcaaggctgcagtgagccatgattctgccactacatccagcctgggcgacaaagtgagaccctgtctcaaaagaagaaaaaaaaaaaaaaggccgggtgcagtggctcacacctgtaatcccagtattttgggagaccaaggtaggaggattacttgaggtcaggggttcaagaccagcctggccaacaagatgaaaccccatctctactaaaaatacaaaaattagctgggtgtggtggcacacacctgtaatcccagctactcaggaggctgacgcaggagaatcgcttgaacccaggaggcagaggttgcagtgagccgaggttgcgccactgcagagtgagatggcagagtgagactccgccaaaaaaaaaagagaaagagaaagaaaagggaggaaggggaggggaggggaagggaagggagaggaaaggaggggacgggaggggagaaggggaaggaaaaaaaaaaaaagaactgagccaacttcagtatctaacattgtgattgacactgtcgcccctctggagcccaatctgagaatcagcaggattctccttgttctgtctcagggttctgaaggcagaaacaagactaggggccttttccctgcaggctgaggcggatttccagacgcagagacctcaacttaattaactgatccccaggaaacgttgaaggactgatacagcacagccaacatgagccaagggcagctgtgtggaggggcaagctgatgcagtggtgcccacagatgcacagtgattcattcatatggaagcataggttgggggattccccaggtcaaagaactggggcccaaccccatcgcccatgcctgttcctgcccctctgccttgccctggctactgcagcccagcttcttctcggcccaggtctgtctacacaggcctgacgactgtatgcccagcacccactggattctttggggttgttcaactctgtccaaagtcagctccagcccattgacctattcagttcagactaggccctcctcaaatggctggctttgcagcgcacactctcctgtccccaggctctgggatagccagtcttatttatttatttatttatttatttatttatttatttatttattttgagacggactcttgctctgtctcccaggctggagtgcagtggcgcgatcttggctcactgcaagctccgcctcctgggttcacgccattctcctgcctcagcctccccagtagctgggactacaggcgcctgccaccatgccgggctaagattttttggtatttttcataaagacagggtttccccgtgtgagtcaggatggtctcgatctcctgactttgtgatccgcccaccttggcctcccaaagtgctgggattacaggtgtgagccaccgcgcccggactttttttttttttttttttttttgagatggagtttcactctttttgcccaggctggagtgcaatggcatgatttggggtcaccgtaacctccgcctcccaggttcaagcaattttcctgcctcagcctcccgagtagctgggattacaggcgtgtgccaccatgcccggctaattttgtatttttagtagagatagggtttctccatgttggtcaggctggtcttgaactcctgaccccaggtgatctgcctgccttggcctcccaaagtgccgggattacaggcatgagccaccgcgcctggtgagggatagccagtcttaatccctgttctcatggagggaggtggcaggagctgagggcagatgcccgtaggtgttcataggagaggaaaagggcattcacacagaagaaacagtgtgggcaaggaggtaagatggtaaattctggagaactcagaatatgccagtccagtccagcttgccatgaagttctgggcaggggcctggcatggaggttggctggtctggaggaacagggggagctgggtaaggagtcttcatcacatgtgttttgtttttgaaatggggtttctctctgtcacccaggctggagttcaggagtacgatcatagctcactgcagccttgaactcctaggctcaagggattctcctgcctcattctcccatgtagatgggactacaggcatatgccactgtgcccggttgcatgtgtcttcaggaaagaaatctaagactggtgttggactggaaggaggcaagaggtaggcggaagaggtcagaggactcctacagtgagggctgggcaagagctagcccacagggctgcagggtagccctgtccctgtggcacttaattagaccccatgaggaatttctatcatcaatttggcaacaggccaggagcgtggctcacacctgtaatcccagttctttgggaggccaaggcaggaggattgctggagccctggagttcaagaccagcctgggcaacatgacaaaaccccctctctaaacacacgcacacgcgcgtgcgtgcacacacacacacacacgattgacaacaagctccacactcccagtgaccgatgagctagtatgagctgtctcaggccaggcgtgatggctcatgcctgtaatcccagcactttagtaggccgaggcaggtggatcatctgaggttaggagttcgagaccaggttggccaacatggcgagaccccgtctctactaaaaatacaaaaaaaaaaaaattagctgggcatggtggcgggcacctgtaatcccacctacttgggaggctgaggcaggagaattgcttgaacccaggaggtggaggttgcagtgagctgagatcgcgccactgcattccagcctgggcgaaggagcgggactctgtctaaaaaaaaaacaaaaaacaaaatgaaacaaaaacaaaaacaaacaaacaaacaaacaaaaccagctgtctcagtccacacagtggaatattattctgccgtgaaaaagtttttttattacaaacattttattatttttaattataaacagtgttttgtaattgtgttaaaaatacatattttttttttgatacagggtcctgctctgtggcacagactggagtgcagtggcgtgatgacagctcactgcagcctccacctcccaggctcaggggatcctcccacctcagcctccggagtagctgggactacaggcatttgtcaccatgcctagctaatttttgtattttcttggtagagacagggtttcaccatgttgcccaggctgatctcgaactcctgagctcaagcaatctgcctgcctcggcctcccaaagtgctgggattacaagcatgagccaccatgctgggcctaaatattttaaatattttcttttttttttcttttgagacagggtctcgctctgttgcccaggctggagtgcagtggtgcgattacggctcactgcaaccttcacttcccgggctcaggtgaccctcccacctcattctcctgagtagctgggactacaggagtgggcgtgccaccatggctggctaattttaaaaattttttcgtagaggcaggttttcgccatgctgcccaggctggtcttgaactcctggactcaagcaattcgctcacctcggcctcccaaagtgctgggaatacaggcatgagccaccgcacctggcctttctttctttctttctttctttcttttttgagactgagtcttgctttgttgcccaggctggagtgcaatggtgcgatctcagctcactgcaacctccgcctcccaggttaaagcaattctccggcctcagcctcctgagtagctgggattacaggcgtgggccaccacacccagctaatttttgtatttttagtagagatggggtttcaccatgattagccaggctggtctcaaactcctaacctcaagtaattcacctgcctcagtctcccaaagtgatggggttacaggcatgagccaccacacctgggccaactcccaggttcaaaccatcctcccacctcagcctgtggagtagctgggactataggtatgccaccaagcccagctaattttttcatttttatttttttgtagactcactatattgcccaggctggtcttgaaccctggggctcacatgatcctctccgcctcagcttcccaaattgctggggttagaggtgtgagccaccgcgccctgcctacgggtcttttgaatgctgcatcctatagctatttttttccttcaacccagaagccaaagcataattccctaaattcttcagagctgtcttggtgagctcaggtggtctgcaaaccgctgtttccagaaggctggcatgggggcctgtgtcttcctccttgcagccctgtccaggcccctcctcttcttggctcccaccctctaggcagttactggttatctactccgtccttcccggacttgactgttgggcatctcgagggcttcccccttgttagtcttctcttcctcagaccccttagcctgaaagtgtgttcccccagggctttccttggcgggcgggcgagcgggcggaggctgtcctcttggggcccccaccctggccatcccatgcggccgtccctcctccacacggtcctgcttccatcttagggagggcagagctcagtgatcctgcgcctccctcagggactctgggacacaggttacttagggccgagagcccaggaagccctgagagggcaaatgcaacggctccgaagagccatacggagaagggcggcgcagccggccgttgggccccatgccccgccttctgcaaccccacgccacccaaccccaccacacgccaccctccgccccgcagctgccccggcccacagcccccagtctctgcagtcgctgaatgcgcccccctcccctccccgccatccgtggacgccagaagccatgggcactggaggatgtcagggaaaggtcaagttcttccttgggatccgagagcgaggacggagctcccggaagcaccaggggccacgagagttgggccgccctccacacccgccccgcgcaaggtccgccaccctctacccccatcccaagctgggatcctccctgcccttcacccccttccgtgcgatgtccaccttccccggagtcggcgctggagatgccctacctcggctgccgcgggcggggaccgaaggtgcagctcggcctggcgatgcggggacatgagtaaaggtctggaggacacggagctggccagggtccgggttgcacgccccgcggccacaccggagtccacgctgcagcgggggtccgagcccgttttcagggtccagggacgtggcggcctggccctcagccccgcctcagggctgtgcccccgactgcgcccggctctgtccccacctccccagccccaggtaagggcgcgcgagaagggacgcggagagcgccggtcaggaagcccggactgagcgcgggggctgggatctgggatccaaacgccgtggccgcgggcccgcgcccgggcagacccgggctccgctctcacgtcacgcggtacatgggctacagttccttgtccgagggcttccgggagctggagccgcacagaatgaaggggttcactggtagtggttcccaacttcgttgcatattaaacccccctggagaacttaaactccagtgcccagtcctatgcaatcagatcctgggtctccactgtgcagcgcccgtggagagccagcgatgtggagggtcgagatcacccagttctttggggacagggtctcactgccaccaaggctggagtccagtggtgcaatcacggctcacagcagtctcgacctccagggctcaagcgatcctccagcctcagcctcccaagcagctgggagcacaggcgcataccacgcgtggcttttttgagacgaggtcttgccatgtttcccaggctggtctcgaacttctgggctcaagcgaccctcccgtctcaggccttccaaagttctgggattacaggcgtgagtcactgcccctggccccatccagctccttcagcctgaattaccagtatttcccctcctccaggaagccaagaatgcttcctaaacccgcctgggctccatagcgcccctcatcctcagcacactagttaccacctaagctgccccagctttccagtgcggggccctgagctccagctctggttgctaccggaatagtcctgcttgctgcccttgaagaaccagggtgtacactaagactgcaagagcagagtccagccataatagcgggttggggagtcaccgacttggcagagaagacacctccagaattaccagcctggaggtgtcaagtttttgttgcagggtaaggtttcaagactggctgggccagctgtactgttaacccagcagggaggcaagcagaggcccccactaggtcccatgtccaagagtttccctcacctcaaaggaacccagtccagcattgctggccaagatatacctgttcaaacaagttattttttagttatttattaaaaattgagatgctggccaggtggtggctcatgcctgtaatcccagcactttgggaggccaaggtgggcggatcccctgaggtcaggagttcaagagcagcctggtcaacatggtgaaacctgctctctactaaaaacacaaaaagtagctaggcatggtggcgcaagcctgtagtcccagctactggggaggctgaggcaggagaatcgcttaaacctgggaggtggaggttgcagtgagccgagaatacaccactgcagaagacactgtctcaaaaaaaaaaaaaaaaaaaattgagatcctactatgtctcaataggtgtcactatgtcgaccgtgctggagtgcagtggctattcgcaggcacagtcataactcactgcagtctggaactcctaggctcaagcaatcctccagcctcagcctccagagtagctgggactataagaacgcaccaccgcaccaggctctaaaggtagttttcaaagatgtctctggagtattgtttcttccagaatgatgtgacagttttgatatttcaagacagacttctctcaaattcagcagaaacctgaaagtaggaaccagggacattttagcctcatagttctatatatatatatatatatatatcctgggccaggcacagagggtcatgcctgtaatcccagcttctgaggaggccaaggtgggaggattgcctgggcccaggagttggaggctgcagtgagctatcatcttaccactgcactccagcctgagcaagacactgtcttaaataaatttttaacttttttttttttgagatggagtctcactctgtcacccatggggctggagtgcagtggtgtgatcttggctcactgcaacctctgcctcccgggttcaagcaattctcctgcctcagcctcccgagtagctgggattacaggcgcccgccaccatgcccagctaatttttttatttttagtagagacggggtttcaccatcttggccaggctggtcttgaactcctgaccttgtgatccaaagtgcctcagcctcccaaagtgctggtaaatttatttttaagacagggtctcagctgggcgcagtggctcatgcctgtaatctcaacactttggaaggctgaggtgggtggctcacctgaggtcaggagtttgagaccagcctggccaacatggtgaaaccccgtctctactaaaaaatacaaaagttagctggacgtggtggcacacacctgtaatcccagctactcaggggaggctgaggcagaagaattgcttgaacccgggaggtggaggttgcaatgaggtgacgtcacaccactgcattccagctctgggcaacagagcaagactgtcttagtgggggtgggggcggggagggcggtgagaaggatcttcctctgtcacccaggctggagtgcagtggtatgtcagctcactgcaacctctgcctcccaagctcaaaagatcttcccaccttggccctccctgcacagtagttgggactacaggcctgcatcaccatgcctggctcatttttatattttttgccgagatgagatttcaccgtgttggccaggctggtcctgaactccagatctgcccatctcggcctcccaaagtgctgagattacaggcatgagccaccacatccagccataatttttaaaaatggcttcctgaggttttacaagaaaatatgcacctcaaaatacacaaataggcatgggaatagagtacagtgaagtgaaagataaaatgtactgagagctgggagtaggagagacaaggccctggctgagggggtgtcagtgggcctcccaacacctcaagccaatccacttggaggtctcccaaagttcatcaggagaaccacctacagccaagaacagaaaaggattcaagaaagccgcacagatatcatgccctgacctgcaatgaggctgctcacttcccatgacttctgcttgataccattcaaccctggttagctcatgctgaagaaatatttactagaagcctcagatatgggtgcctagaaggaaaaagatccaagttctctgtggtggtgcaacctgtgggaactattgcctcatgctcagaaggccaagcactaggctcccatacaatacctacaagacagacactctgggaggcagatttctcttttggagggagaccccaggtgctctcctctgggtgcccgagtgttggaatgggcggatgccaagacttcattctagctcttggtcagcagcagcactaagggtctctgagaagcatcagagatttcaccactgatgaactgccaggaggctagtgggggcggactgaggagacactgaaacaccgaagctgccgccaccaccggctgatgcaagttttattgagacaatatacaaacaggccatggaaacaagggttttgatgctgggaccagtaacgtaaaacggaatacaaaaataaaaaggcactaatctgttaagaaaagacactcgatgtattctaagaatataagtcatttaatactgttaattttatagcacaaaataaaacaagctatgatccccaaaaataattttaaaagcttacacagaaaatattattgcctgaagtttatgatctttaagttacaggtcaaaagagttttatgttgttgttgttgttgttgttgttgttttaaaacacacagtgaagaccgtctaagaagcaaggccactgttcctcctgtagggacaacgatcctgtctcagagacctgtccttctgctcctttagaaaacagaaccagcacagcgtccacaccgacagcagttactaggggcatagtcctccggtcgcagagggtggagttgaggcagagctcagtggtgtccacagaaagcattagtcttaggtactgtgttaaaacaatcaagaattcattcatgtttaagaggttaataaccataatattaaaggattaattataaacacctggcaaaaaaccacatcatcccttttcaaaaataaaatgttcatattcctctgagcaaacatcacaagagcagtggccatctgcctcaggcctgccttgtctgtaaacagctgtaaaggaaagctagcacagcgccagggacacatgagctcccaggagggcacagctgtccttccctttcagctttccaaacatgagcacagaaggtgtctagtctgggtgaccaaagtcctcaaacggcagccggtcaacacatcgtcttcctcgttaaccatgtcatcaggtggttccacacagcacagacatggctgactcctgtaccgcaggtccttcccgggatacacaagtttttaaccagtcaatgccctctagtacgtaatttgtttccttcccaggtgaaaaaccatagtgagttaatttaacatccaaatatttctttaaacatggtagagcagagcaagtagcagttatgaacacccaccctctgggtcagatgtgcactgctctatggagcacaacagtcttcccagaccagtggggaacccaggcacgaagctgagctgaggcagcagtgctgcattcatatgtttagtgtgaaaaacagagtatccctgcctcattaaaaaaactgacaaggttgtaagtccgttaagttttactagttttggcacatatctggagtgcagaactcaagctcgccttgttttgagctctgaatctcctggcagccctggatgccattttcatgggctgaagtaacgagctgattaattataaaaccaaaccacaggtatactctaggtatatctgattctgaagtgcgccacacaaggtgagtcggggtattggtcagtagacagggctgaaaggaaaccttgctttccaaaatggccagacttcttgcactctgagtcaactgctgtaattcaaaggtgtcaagcccttcagctaaatctggttgaaaaaggcctaagggtcgtgccctccttgaacaaggcacacattcctccctctgttggaaactccactcatggctcaacatgggccgggatgaaccacgtcactggccaaagggcaaacactgtttctaggcagagtctggggactcttgtgatatgtctgccacttgtgggtgctacgccaggcctgaacccaaaataagccaacctgacacacctaaccagaagcggcaactgccgcagaccgtgcagagcaggaggcggtcaccgttctcactggcaaggaagggctaatctccaaggcttttagaggaaaaccacagatgggaagccatggcgatagttttcccaaatgaccattaattctgtctcaggaacactctcaagattcatgaatacagcagttatctgcctgatggaatactgatttaaagaaaaattgaaaaatggctgttctgctggttctgtctccagaatgcattgctctaaatctcaaaacctaggaacctccagacagggccacagtcacagcagatgatcagtaaatgaaagctactcagtaggctgctgctacatttctaggtctgctgtgttcactatgagctgaggcttttctttaccagggtccacaagggagagcagactgaattgcacagggttcccagaattctagtctgctatgtgcagcagatgatggatgaaccacacgtatataccagttggcttgtatgaacaggcctcttttagctaacagggaaatgctttaacatcaatacactgataagtggttaatgataaactagttaatggtctccctagtcactaaaacactaagacatcaaatacattaacgaatttccagagcttgcatttcctttgcttgggagcatcacagacacttacttagactgtgagaccagtatgagcagcaccaactttctctggcagcctgacgagattgggcctgggcacggaggtctgggcttcagtgagtggagttgaacgattcattaatgagtccaacgattctatgaacaacgccactttttaaggaagtttaagtctgaaccttaaaggggtacattcactgaaaagctgaacagaaaactggccaagtgccctccaacccactgctcttatcactggcaaaacaaggtaagcaaaggtttccctaaagtacccccaactctgatgctttttaaaacaaagtaatccaaggggctgtgcacatagcatggcacaccacaactgcattattttgtgtgttgtctgctacatggcaaaacaaggtactactggcaaccaagacaataaaggcctctgcttcagggttgttcttttcagattcctttagttacagcagcttcagtttagaagctcagaggcatgagtcattccttgcactatcataaaaacccaacctgctacttaacctgtttagaacacacaagtctaggccaggcgcggcggctcacggctgtaatcccagcacgttgggaggctgaaggcgggtggatcacctgaagtcaggagtttgagaccagcctggtcaacatgatgaaaccccgtctctactaaaaatacaaaaattagctgggcgtggtgtgcgcgcctgcagtcccagctacttgggaggctgaggcaggagaatcgcttgaactcaggaggcggagactgcaggaaggcgagattgcgccactgcactccagcctgggtgatgcagcgagacaccgtctcaaaaaaacaaaacaaaacaaacaaaacaaaacaaaaaaaaacccccacacaagtctaattaattagttttccaaaaccaaaccaaaacaaaagaaaaaaaaaagccagattttggagttttagaacagaattctctcttccttaaggttcacttcctgttgtccaaagaaaagcaagatggcagctaagccactgctttgtggaacagcaaacatgcagtatctcgccatggcctcaagctttctctggtgaacacaacagaatcagtcccatgtacaaacgggcagcaatgagaaggaagaccctttccatgtcaacttctctccacttgtgtgcttccatcagtatttccagtttatgatccaaaagaactctaaaatcggctactctttgacaatacgactatgatacaaacatcaggaggcagccgctgtgtgcattccaaatgtgtgtgcgactgccagtctgcagaaagctggacttcggcaatgcagtgtgacttgcctatgagagaaaatgctttcccacttcaaaggagactaggacaggcagaacaacaaagcagcaggaaacagggcaacagcaatcactcgttttcatctgggttttgagggtcaaagattttgacgtgcgtaaaggggaaaagccctttgcgcccgttcacttcgccttcccactggccatttatattcatccttgtgactttcacgatgtcaccaacctgtatggatgaagaagacaaagttagcatttctctgcaacaagaaaaagacagtttacattaaatcacaaacactaccttatccaaagggcccatacattattatttagacacagggtctcactctgttagccatgctggagtgtagtggtgagatccctgctcaatgtaacctctaacgcctgggctcaagtgatccttccacctccacctcttgaatagctgtgactacaggcgtgcaccaccatgcacattattttttaattttttatagacggggtctgtcgcccaggctggaatgcagtggcccgattacagctcattgtaaccttgaactcctgggattacttgaggtcaggagttcgagaccagcctgggcaacatggtgaaacctcatctcttctaaaaaatagaaaaattagccgggtgtggtggtacatgactgcagtcccaactactcaggaggctgaagtgagaggatggcttgagcccatgaggctgaggctgcagtgagccgtgatagtgccacggcaccccagactgggcaaccgagtgagaccctgtctcaaaaaaacaaaaatcaaaacacacacacacacagaaacagcttttgagcacaaagcagctccccaccccacaccaaccttctattttggccactaaccccaacaggatagaaatgaacacatgattctgagaatggttaaagtcaaattacacaaaaaggtgtattttaaaaaaagaccttcaggtggtagtcattgtagacagggtgttactctgttcagcagagcactaatctaaggttctgtattgtgtacttaggtccataaaaacgctacttgaatataagacccacctaagatctaagacaataagaaataagcttttgtctgcttaaacacatatagaaccaggcatcgtggtacatgcctctagttccaggtccttggcagactgaggtgggaggactgcttgagcccaggagtttgagaccagccggcgcaacgcagcaagactacatctcaaaataaaaacaggcataaggtttttatggcacagtccaatggtccgtgccatgaactttggagcatgcaggacaccaaacaaatgtcctggttctgccacttttagaaactacatgactgtagcaaactgcttaagttctccaagtctcagtttccttccaactttgaaaggttcttgcagtaattaaatgattgttacttgagtagagattcctgaatagaacccatcccccaaccccacgccccctctaatgatcataccctttggatgcacgaagggaagagctggaattagcactgagaagcacaacactgtatatatcagaggatttccaaccttgtcaccaacaagggtcctctcaaaaccaatgaggaacaggctgaaaacggggtctaataaatgactgtgatggatactaagcagccaaagaagactacgggaagattaaagatgaggctaaggattgaaagctgccaagaacactcacacctcacgccttccaattaacttgtgagtctggcggtcttcaacaggatactttctacatgatcctacctaatcaattaaataaatttactgaacatctactccatggaaaatgggcaggtcagttcgtatccttaaaaaacttctgtcttttgagtgggatacacaatgaatctttgtcagataataacatagtgtgaaaagcacaaagtggccgggcgcagtggctcacacctgtaatcccagcactttgggaagctgaagtgggtggatcacttgagcccaggagttcaagaccagcctgggcaacacagtgaaaccctgtctctaaaatacaaaaatgagccaggcgtggtggcatgcacctgcagtcccagctacttgggagaatgaggtgcgaagatcgtttaagcgcaggaggcagaggttgcaggggtgcagtaagctgtgatcacactactgcactccagcctgggtgacagagcaagaccctgtctcaaaaaaaaaaaaaaaaaaaaatgaaaaaaagaaaaaagaaaagaaaagaaaagaaaaagcctaggcgcagtggctcacatctgtaatcccaacactttgggaggccaaggcagatggatcacctgaggtcaggagttcgagaccagcatggccaacacggcaaaacctcatctctactgaaaaatacaaaaatcaccaggcgtggtggcagatgcctgtaatcccaaattccaactactcgggaggctgacgcaggagaatcacttgaacctgggaggtggaggttgcagtgagccaaaatcgtgtcactgcacttggtgtagctgggcgcagtggctcacacctgtaatcccagcactttgggaagccaaggtgggaggatcacttgaggccacatgttcaagaccagcctgggtgacatagtgagacctagcttctattgaaaaaaaaaaaaaagagagagagacagaaaacacataaaagcagcaagtggcagaaaaacactattaactcaatgctgcagagcacaggattcaaggagctactgcttagacagagggaacctggaccagcagaagtaggtcaaagagcagcctaggaagagaatggctgagagacttctggtggccccttgaccattagtgcctcattgtggccttgcaggagtttccacatgctaaaacaccatcatcattcttcatgctgttttctatctcaacacagtaaagatatcctggctgttatgcagcctgctgtccagttacaggcctggctatggaccagcttcttccatggctctaccaaacagtgcttgtgctcagatcctaaaatggctggtagcttggcagccatcttgccgtttccctcatcactccctattctggtgtggtgctcttcctctgggttcatggtacacggatccagctcaaagaagcactcactgtggagggcagatcaatctgttttttttttttggagggaggggtgctctacaccttcagagaaacttctctagtaatgaactatagaaatgatccctgaaagtatagtcttagagggcagaccaatcttgatgtgggtagataccaactcagttcacggggcaaactacacctgggagatgtggctgaccttatcaacagattaagaggaagcacatacctaatgcatcatccttattaattttcactctatggaacaggccaatcctaatcattattagaactgtcaaaacactatctttgtggctggccgcacttagcacctggggagtggacacattaactctaaaacacatatgccagggacactagtcagcccttttatgtctaccaagagttaaatggcaagagggtacctcttgctgctggcaatagtttcctacagccctacttgtccagagtgttgtccaggaaatgactctactgactggcatctggcacttgattcaaagagcagtcaacgcactggagggcccaagcactggtcgtcacagcagttttttggttccataatcagtctccgctccctgtactgataggctgagattgtatgctttcaggttacataaaagtaagatcaggagtacactggtgacactggaatcataaattctaacttgagtgatgtgaatgggtctcagtgatcaaagaacatcctgcgaagttgtatgcaaatacatgaatgtatgctgtttttctgaagactgcacaactttcactggattctcaaaggggcttatagcccccaaaatatctaaaacaaaacaaagcccatgtactataatcaccagacaggtatcatcctgctctctgtggcttttattcctctagtcattcaacaaatattgaacatctatgtgtaggccgtgaagagatacaacagaggacacaaaggagacaaacacccctggccctcacggagctgcatgggtccactgcctgcccctgtgttctctgtgcacctgcacctgaatcagagtagccagagagatagaggctttaagagggctaggctccctgtctgtgtgccctggctagcagtcaagtaatctcatacactcaaacccacaactgaatgctatctaatagggttttaatactgaagacttggtctctttcttaaaattaccactatccttcagagtagtaacttgattcaagagggctgtttactggttaacacagagattttatttgggaaaggtagggggcggggctaaaggtatcacaggccagtatgctgtggtacaagagtatgtgggcttttggaaaagaggaagtcaagacacgatcatatatataagaaaagatacaaattcagcaaagtcgcagggtacgagatcaacacatagatatcagttgcgtcttatatattggtaatgaataattaagaaagtaattccaagccgggtgcggtggctcatgcctgtaatcccagcactttgggaggccgaggcaggcagatcaggaggtcaggagatcgagaccatcctggctaataccgtgaaaccccgtctctactaaaaatacaaaaaattagccgggcgtggtaggaggcgcctgtagtcccagctacttgggaggctgagtcaggagaatggcgtgcacccgggaggtggcgcttgcagtgagccaagatcacaccactgcactccagcccgggtgatagagcgaaactccatcccaaaaaaaaagaaagaaagtaattccaggcagggcacggtagctcatgcctgaatcctagcactttgggaggcgccaagatcatgctgggcaacatggtaaaaccccaattctactaaaatacaaaaaaaagttagctgggcgtggtggcaggcacctgtagtcccagctactcaggaggctgaggcacaagaattgtgccactgcactctagcctgggcaatggagcgggagtgaggctctgtctccaagaagaaaaaaaaaaaagtgattccatttacaatagcatctaaaataaaaatatccaagaataggctgtgcggtggctcatgcctgtaatcccagcactttgggaggccgaggcaggtggatcacgaggtcaagagatcgagaccatcctggccaacatagtgaaaccccatctctactaaaaatacaaaaattagctgggcatggtggcgcatgtctgtagtcccagctacttgggaggctgaggcaggagaatcgcttgaaccagggaggtggaggttgcagtgagccgagattgcaccactgcactccagcctggtgacaaagccaagactctgtctaaacaaaacaaaacaaaacgagaataatttaaccatggtgaaacacttgcataccaaaaattattaaagacctaaataaatgcaaaaacatttgtgttaatggatggaaagacttatgattaagatattaatattggctaggtgcagtggctcacacctgtaatgccagcactttgggaggctgagacaggaggatcacttgagcccaggagtttgagaccagtctgggcaacatagtgagaccctgcctcataaaagaaattaaaaaaaaaaaaaaaaaaaaagctaatactacccaaagtgatctacaaatacaacacaatccctatcaaaattctaacagcctttttttttgcagcaatgggaaaaccaatcctcaaattcatatagaattgcgaggaacctgaatagccaaaacaaccttgaaaagcatcaaagttagaggacttacacttccttgacttcaaaattactacaaaaagctatagtaatcaacagtgtggtgctggcatatggagagacatatagaacaatggaatagaactcagaggtcaaaaataaacccacacatttatgatcaagtgatttttttttaacacgtgggagtctcactatgtagcccaggctgatcttcaactcctaggctcaagcaatcttctcacctcagtctccagggtacctgggattacaggtgtgcaccaccacacccagcttggccaactgatttttgactagggtgccaagtctattcaacagggaaagaataaccttgctgggacaactgcaccaatttccacatgcaaaagaaagactctgaaaccttacctcacactatacacaaaaagtcatttaaaatggatcaacagcctaaatacaataactaaggtcaggcatggtggcgcacgcctgtaatcctggcactttgggaggccaaggcaggtggatcacctcactttaggagtccagaagagcctggccaacatggtaaaaccccatctctactaaaaatacaaaaaattagcggggtatggtggtgagtgcctgtaatcctggctatttgggaggctgaggcaggagaattgcttgaatctggaaggcagaagttgcagtgagtcgagatcgtgagtgccattgtactccagccagggcgacagagtgagactctgtctcaaaaaatataaaacaaaataaaaaacaaaaacgctcaaataacccaattaaaaaatgggcaaagaacttgaaaatatttatccaaagatttgccaaaagccaatatgaaaagatgctcaacatcagtcactaggaacatgcaaatcaaaaccacaatgacataccacttcacacctactaggatggctataataaaaaatatggaaaataacaagtgttgatgaggatgtggaagaatttttttttggcggtgaagaagggagcccttatatactgctggttggaatggaatatggtacagctgctatggaaaatagtttgacagttcctcaaaaagctaaacataggaggctcatgcctataatcccagcactttgggaggctgaggtgagcgatcagttgaggtcaggagttcaaagcctggctaacatggcaaaaccctgtctctactaaaaaatacaaaaattagccaggtgtggtggcacgtgcctataatcccagctactcaggaggctgaggcaggagaaatcgcttgaacccaggagatggaggttgcagtgagccgagatggtgccactgcactccagcctgggcaacagagcaaaactccgtttcaaaaaaaaaaagctaaacacagaattacccatttgacccagaaatccactctgagatatataaccaaaataactgaaagcaaggactcaaacatttgtgtgtcaatgtccactgcagcattattcaccatagccaaaataacgaaaacaactcaagtatccatcaagagataaatggattaacaaaacgtgatatatacataacaatggaatattattcagccctaaaggaatgaagtctttatcataatttcctgtacagatggagtctcactatgttgcccaggctggtctcaaactccttgcctcaagtgatcttcccaccttggcctttcaaagcactgggattacaggtgtgagtcaccccatgctgggacaagaaatgaagttttgatatatgctacaatctggatgaactctgaaaacattgtacccaatgaaataattcagacccaaaggacaaatattgtatcattttacttatatcaggtaggtagaataggtaaattcatagacagaaggtagatagttggcaaactatataaacctcaagctcttagtgtgggagcagtcatgagaataaacttctctctgtgaacccctagctgatggttcttcttactcaacagctatcaccagagaacagctatcacagaaaacagaggtcagcctaatgaccaggatgggacaggccctgcctgaaccacaccagggccccaattccatggcattctgacttaatttacacattaggaaagaggaacaaaaaccttttaaaaatatttttttctgggccgggtgcagtggctcacgttgtcaggagttcaagagcagcctagccaaggtggtgaaaccccatctctactagaaatacaaaaactagcccggcctggtggcgggcacctgtaatcccagctactcgggaggctgaggcagagaactgcttgaacccgggaggcagaggttgcagtgagctgatatcatgccactgcactccagcctgggtgacagagcaagactctatctcaaaaaaaaaaaaaaaaaaaaaaaatatatatatacacacacacacacacacacacacacacacacacacacacataaaatatatatatatatacacatacacaaacacacatatgtatatatttttaaatacgagaatattctaaaggactttctaaagattcctacatttgcatggtattatagtcaaggaaaaaaagcacttttggtactaaagaaataaagctgagatgctgtgaaggacaactgacacaatgtcaaagacagaagggtggaggaggatcctggtcagtcctgatgaaaggtccaaggaggcaagtggaaatgattcctcgggcaccagacatccacacaccaccacggcatgggaaggacacacctgagattcttgcttaaggtgaatgctaacttgtgggcctttctgggaagccttggtaagaaggcttcacgttgctagaatgtgacgtgaggtgagggacagaagccccattacactgggagcctgtaagcttgccacatggacccccagggctgagtcagatgcttcatgatgaacacatacagccccaagagcactgcaggccacccagcaggaggaactcatgatgatctcttagggattcatcatgagtccaatacaaagtccaatcagtattaatgaaacctaaacttactttgcagattacttcacctcagcaagcagatgcagcaatgaagaaaatgctaatacaaatttaattctaagcaatgaagcaaaaccaattggtaaagtgggaatctgataattccaggtcagtcagtaaaggaagttgtaccatgggcccttgggaaggccaattcaaaagacacagagaccagatgtaatccaaattactacaggttttgaaatggggcaaagacaatccaagaagaaattataaaaacgcaatcacagatgacacagagcaattatgggaatgaagagcaagaatgttgaggatgctggtgacctcaaagaacgctgagtatcactaagaaaaaaaatgccaaaaaaaaaaaaaaaaaaaaggagcaccaaagatgaggaaagggtgttcttaagagctgaccaaacacactggcaaacagcagtaagagtccaagactagtctcctgtcatagagaaattacatcacaggacactggaagacttaggaagggtcaagtctcttgttttttgtcaaaagatggcaaattccataaaatgtaaaacagtgagcttgaaatgaaacccagacaaaattctggatgcgattagctaacagatggtttgtgagaatttagaatgggaagtggagcatctggaagcagcatgagcccaccaagaacaagtcacgccagatcaacctcactgtctttttatagatataagaggcagatctggagaggctgcatagaaggactttagtacaaagatctgttggtgcttttacaaaacctgcagttaggaaactggagggtaatgaatatgctagatgacataaccaggattttaaaagattcagaggctgggcgtggtggctcatgcctataatcccagcactttgggaggctgaggcgggcggattgcctgaggttaggagtttgagaccagcctggccaacatggtgaaaccctttctctactaaaaataaaaaaattagccaggcgcggttggcaggtgcctgtaatcccagctactcaggaggctgaggcaggagaatcacttgaacctgggaggtagagggtgcagtgagccgagatcacgccattgcactccagcctgggcgacaagagcgagacttcaactcaaaaaaaaaaaaaaaaggattcagagatgtacgcagatcatatgacaagaccaataaaaaccaaaccaacaacaaaactacaaaactcaagagggacaactatggggccatgcacttttaagtccacacactgggctaggcaaacacaagaaggggacttggctgtggcttctttctccctggtggagagccagaacacaagacttgtcagctaccacagccatacaacatgagacagaccacctcatgaaactgttatgggccaggcgcggtggctcacgcctgtaatcccagcattttgggaggcctaggcaggtggatcacgaggtcaggagatggagaccatcctggctaacacggtgaagccccgtctctactaaaaaatacaaaaaaaaaaattagccgggcgtggtggcaggtgcctgtagtcccagctactccggaggctgaggcaggagaatggcgtgaacccgggaggcggagcttgcagtgagccaagatggcgccactgcactccagcctgggagacagagcaagactctgtctcaaaaaaaaaaaaaaaaaaaaaaaaagcaacttatgttccagatgtgccacaggaaatacatctttgttttgttcactactgtatcccaagttcctagcctgtcacataataggcactcaataaacttttgttgaagtgaatgtttttttggaggtgtccaagttgagactggagggccatggagttagactctgaagagggctaaaagcacagggaaaatgattgaactaaatgacctaaggtatcaatacaacctttctgcttgatttataccaattccatcccaaatcactttaagtctcacttgtaagcctgggaaactatttttcctccacacgatctgtttcactgacttcaattcccacagatccccagcttgtgtcaccaattgttttcttatgccacaccatgggggaaaagcacaggtgaggctgcatttagacacttaaatacaaattttcatacaaatagtcatgggtgtgtgtacccagggttaagtacaattctaaagttgctatttcttccgttttagtcagaaaagcatactggaatgcaaatgaatgagaatgatattattacatgacagtcaagcatttgctctaaatttaaaaattaatatataaaaagaaattgcctgtaaacctgaccttgtcagttgtgagaaactggctgtttcatgactcaaatgaaggcaatgcaagaaaattgttaatctcctcagctcagcccttcgtgatatggcaacagcccactgccctggctgtcttttgccacttttgccctttgcccagcatgctcacctgtctacagctattcagtgacgttagtctcatcacacaagctctactcaccttacagataccaagtattccccttcaaatcaaatctcaggatcaactctttccttgcagaaaagtcagcaagaaaagaaaatagctaaacacaaactggttttaaaatatctctttacttacaggaatcctcttttgaaaatcaagattaaaaaaaattgtaaaataatttaaggaataaagtcacctaagccatcatcattctctgtaatactatctaggggaataacgaagcttcaattatcagcacattttgtcctacttgtctgtttctcattttaattttaatacttttcctagtaacctaattgcaaaagtcccaagagttgtttttaacaagatcagacaggcaccactatcctaataatagttttagaagataacaatcataaaaacatttaccccagctactcaggaggctgaggcatgagaatcgcttaaacccgtgaggtggaggttgcagcgagcggagatcatgccactgcactccagcctgagtgacagagactcagtctcgaaaaaaaaaaaaatttacttatgctataacctaaagtttcatttaaatattcagaaagcaaaataccactaaatggaatttggtaaaggtctatttctcaggtcccatttacattctctctcagtcaagcaccaaacaaacccttggctgaagctcagctggctgggttagtgtcatgaggctcaggtgtggagaacctctctctggggccagagagactaggaactatgtatggccaagtatgtaggttatcttaaaatacacaatcattaaccaggcttccttcctcctactcctgacctctctcaggcacctacttatccacccactcaccaagctctaagtgatcccttctgtaatacctggtattcctccctacaacctcctagtactcgctccagtgagcacacacgcacgcacactagatacaggtttctaaaacacacatcctagagccagaggtcaacaggcaggtacctaaaattctgactgggagcctcgactttcaaggttctcaacgagcagctgccaaacacacacgagtcacacccactctgactcctagctccccaatcctatgctatgatggacgtgaaaatgcctcaaaaggctgaaaacacaatgcatgctacagggtattaacagcccagagcaccaaggtgctgaggcatagaccaggccagaggcatgcacctgtgcctaggcaggtctgtgtgtgggtgagaaagctggaaggcctggccaggtgcagcggctcacgcctgtaatccgagcactttgggaggctgaggcgggcagatgatcagaggctaggagttcaagaccagcctggccaacatagtgaaacccggtctctactaaaaacagttgggtatggtggcgggcacctgtaatcccagctacttgagaggctgaagcagaagaatcgcttgagcccaggaggcagaggttgcagtgagctgagattctatcaactgcactccagcttgggcaacaaatgagactccatctcgaaaaaaaaaaaaggaaagaaagctggaaggcctgctcagccagcactcctatctgtggaggcagcctcctgagacctggagcctctcagtccctgacccccaccacagcctcaaatgctccttttccttatagccaacatgaaagggaggcaaaaaatcaaacattgaaacaaaccttcaggtgcagttcattcagatactactactggtccaaagaaaaacttgagggccaggcatggtagctcacgcctgtaatcccagcactttgggaggccgaggtgggcagatcacctgaagtcagcagttcgagaccagcctcaccaacatggagaaaccccgtctctattaaaaatacaaaaaaattagccgggcatggtggcacatgcctgtaatcccagctactccggaggctgaggcaggagaatggcttgaatccaggaggcggaggttgcagtgaaccgagatcgtgccattgcactccagcctgggcaacaagagcgaaactccgtctcaaaacaaaacaaaacaaaaacaaaaacaaaaaaacactgaggacaacctatggaaaaatacccatgaaaccaattctagctaacttttatctgtgggcaggctgtttggtgagtcaggatttggtttttttgaagcaagagggtcccttacttcatccttctgaaatgcacttaggctctctctcaacattctcccccctttttttgagatagggtctcaccctattgcccaggcttaaatgcagtgtcatgatctcggctcactgcaacctctaattacctggttcaagcaattgttccacctcagtctcctgagtagctgaggctacaggtgcatgcccaccacgtctggctcatttttgtattttttggtagagatggggtttcaccatgtctgtgaccagactggtctcaaactccagacctcaagttatccaccagcctcgccctcccaaagtgctgggattacaggcatgagccactgtgcccagctgagaaagagtttttttaaaaagtaatatttagttagaagaaaatgacttggccaagtgcagtggatcatgcctgtaatcccagcacttgcgggctaaggtgggtgggtcacctgaggtcaggagttcgagaccagcctggccaacatggtgaaaccccgtctctactaaaaatacaaaaattagccgggcagggtggtgcatgcctgtagccccgctactcgggaggctgaggcaggagaatcacttgaactcaggaggcggaggatgcagtgagccaagatcacgccactgcactccagcttaggcaacaaggcaatagagcgagactctgtctcaaaaaaaaaaaaaagaaaagaaaatgacttggtaattaaaatgttcaagttctatttcatgctattctaatttacaaaatccataacaagcaagggctgatgtattttaaaatcattcctctatggctgggcgtggtcgcacatgtctgtaatcccagcactttgggaggccaaggcaggcagatcgcctgaggtcaggagttcaaaaccagcctggccaacatggtgaaaccccatctatactaaaaatacaaaaattcgacgggcatggtggcaggcatctgtaatcccagctactaaggaggctgaggcaggataatcatttgaacccaggaggcagacgttgccatgaggcaagatcatgccactgtgctggagcctgggtgacaaagtaagactccatctcaaaaaaaatcattcctgggccgggcacggtggctcacacctgtaatcccagcactttaggaggccaagataggcagatcacgaggtcaggagatcgacaccatcctggctaatacggtgaaaccctgtctctactgaaaatacaaaaaaattagccaggcgtggtggcgggtgcctgtcgttccagctacttgggaggctgaggtaggagaatggtgtgaacccaggaggtggagcttgcagtgagcggagattgagccactgaactccagcctgggcgacagagtgagactccatctcaaaaaaaaaaaaaaaaaaaaaaaaaattcattcctctaccaagctcaagagaaattctaagacattttcatatttctcaactgattccaatgttagaaatacagaaccatatatgttgattttgcctctaggtcatgggtcttccttaatcattatctttccttactggaagaaaaaccaacaactgcaaaactaaatctgttaggctttgggaacaagaaagagcaagaaggctgagaatttggggcaaacaaggaataggacagaacaaaacaagctgtgaaacactaataatgggccaggcatggtggctcacatctgtaatcccagtactttgggaggtcgaggtaggaggattgcttgaggccaggacctcgaaatcagcctgggcaaacaactcttttaaaattagagacctcgtctctataaaaaaattttaaaatgaaacgctaacagtgcgtatcttccaaaatcatccagtgctctaattccatgaatataagcttaaatgagcagaaactaaactaaaactaaaaattaaaaccaaatgtcaaaggacccaaaaagctaatctgaacagattttacctctaatgccaaggcagtcttgtcataagcacagggtactcttttctggattgctttcgcaaagacaggtccattctgtgtggatggcaaaggggtgattgctgccccaggagaaccggaaactgcaggtagaggagttgtggtctgaggttgagcgtatgcatgagcaggttctgggatcccataactgttggaattcctatttccatgctttccgtgtggtgaggatctcacaagcttttcgacataagggacaggaatcatcccaacccggccatccttgttccgggcactccaccactgttcttcaggcttctctattatcactaggatctcaccctttttaaagggcaggtcttcggcatcattcccaggaaaatcatacagagtccgtacatattccaggttatcttctgctgtaggcaggttgggtgctgagacagatcccattggtgggcttggataccttaagagagaaagaaaattactctaagagaaaaatcttactctaagccagtgcctgtcaaacttcttaatataccactctcctctataataaattattttccttttttatgagacaagttttgctcttgtcgcccaggctggagtgcaatagcgtgatcttagctcactgcaaactctgcctcccaggttcaagtgatgctcctgcctcagcctcctgagtagctgggattacaggcgcccactaccacgcccaggtaactttttttatttttagtagagaaggggtttcaccatgttggccaggctggtcttgaactcctgacctcgggcgatccacgcacctcggcctcccaacgtgctgggattacaagcatgagccaccatgcccggcctctacattttttttggagatggagtcttgttctgttgcccaggctggagtgcagtggcaggatctcagctcactgcaacctctgcatcccaagttcaagcaattctcctgcctcagcctcctgagtagctgggactacaggcacatgccaccacgccccgctaattttttctatttttagtagagacggaatttcaccttgttagccaggatggtcttgatctcctgacctcgtgatctgcctgcctcggcctcccaaagtgctgggattacaggtgtgagccactgagcccagccttttttttggagacagaatcttgctctgtcacccaggctggagtgcagtagcgcaatttcagttcactgtaacctctacctcccgtgttcaagtgatttttctgcctcagcctcccgagtagctgagattacagatgtgcaacaccatacccagctaaattttgtatttttagtagagacaggattttggcatgttggccaggctggtctcaaactcctgctggcctcatgtgatccacccgcctcagcctcccaaagtgctgtcattacaggtgtgagccaccacgcctggctttattttcctttctatattcttagtagttaagaaggttctatcatgttgtaatttttgtagtctgtactgtcccaaaagttactattctgaatgtcttttcaaattacaagtatacacacacacatacactccatctctgttttacagaaaccttttgattacacagagatacctggtttaaatttatttttataatctcaagtaagttcggaagctgccttcctttggacccttgtcacaaccaccacacactcttcctcccagtcctaatctatggcttacatcctgcacacttccctggacacacagaaaatgacaaaggcctctgcctctggcctcttgaaaaaaaaggaacaaaaaagggcttacagacttgccaaattaaaaataataaatccaccaggcgtggtggctcagacctgtaatcccagcaccttgggaggccaaggcaggcagatgacttggagacctgcctgtccaacatatcaaaaccctgtctctactaaacagacaaaaaatgagccgggcatagtggcacacacctgcggtcccagatactcaagaggctgaggcaggagcattacttgagcccaggagttagaagctgcagtgagctatgactgcatcattacactccagcctgggcaacagaacaagactgtctcaaaacataaataaataagaggccggcgcagtggctcatgcctgtaatcccagcactttgggaggctgaggtgggcggatcatgaggtcaggagatcgagaccatcctggctaacacggtgaaaccccgtctctactaaaaatacaaaaaattagccgggcatggtggtgggtgcctgtagtcccacttactcaggaggctgaggcaggagaacggtgtgagcccgggaggcggagcttgcagtgagccaagattgcaccactgcactccagcctgggtgacagagcgagactccgtctcaaaaaaataaaataaaataaaataaaaataaaaataaatagctagcaagagtagtaggagcaagagtaataataaagagctcatacttattatctatgctaggcatggtttacgatctttgaagagattggattatttaatagtctgtgaggtagatgctgttattatccccattttacaaatgaggagccaaagaagaggttagacttgcactcagggagtctggttctaaactcttcactcataatgagctaatcagccttagggacgaaccctgcatctgtcaggtgtatgagaattaatggcataatgcatgtgaggcattcaaaattaccgagcagcaccaagcatccaatgtaccgacatgaacacacacataccccttcaagtatatccctgcttctatttctttctcttttttttgagacagggtcttgctgtcatcctggctggagtgcagagtggcacaaccacagctcactgtagcctccacttcccaagctcaagtgatcctcccacttcagcctcctgagtagctgggactacaggcagttgccatcacacacagccaatttttaaattttctgtagagatgggggtctcactatgttttcagggcttgtcttgaacttctagcctcaagcaattctctcgccttggcctcccaaagtgttgggattacaggtgtgagccatcacacccagcccctgctatttcaagagccacagagagcctgtgaacagtccagtaagtaccatataaatttcagacactattaagagcacagtcagttccaccttagactccatccaagagtattttattatttgtatagttaaaagcagttagccagtgtgtggtggctcacgcctgtaatcccagcactttgggaggctgaggtggacggatcacaaggtcaggagattgagaccatcctggctaacacggtgaaaccctgtctctctactaaaaatacaaaaaattagccaggtgtggtggcacacgcctgtagtcccagccactcgggaggctgaggcaggagaatggtgtaaacccgggaggcggagcttgcagtgagccaagatcacgtcactgcctgaaacagttaagactctatctcaaaaaaaaaaaaaaaaaaaaaaaaaaaaagccaggcgtgtggtggctcacgcctgtaatcccaacactgggaggccgaggcgggaggatcacttgaggtcaggagttcaagaccaacctggccaacatgacaaaaaaccctgtcactactaaaaatacaaaagttagccaggtgtggtggcgtgcgcctgtaggcccagctacttgggaggccgagggaagagaattgcttgaacctgggaggcagaggttgcaatgagctgagatcacaccactgcactccagcctgggtgacagagcaagactccatcttaaaaacaaacaaaaaaaagaagatagccaagcccattcatttacgtattgtctatgactgtttttcactacaaaggcatagttgagtagttggacagagactctatggaaaagctgaaaatatttaaaatctgaccctttactcaacagtttgctgatcccccatctaaattcctgggttagggaggcaaagtgtgcttttcaacttccttgcttccctggtgaggggtatgtctgtgtagaaatttgataaagatagtttctatttccctccactactatactgctatagtgaccttggggctcattttctgtgttagtatctgcagagatattcataaatttgacaccaaatcaatctcaccagccataaccctgacacaaattccaagtcctctgccctatattctcaaactcatttattcatcaaactcccctgaaaattacacattagttccactgaagagataaatacatgttgctccatgtcagatatcttagcctttccattagaccccactgtctaaagaaatatgaagcatattcatcagaaaatttattgcttcccaattatttgttctttgagcaaggttgaaaatagcaccctcccccaacttccctttaaaatataaagtgttgcccaggcgcagtggctcatgcctgcaatcctagcactttggaaggccgaggcaggtggatcatgaggtcaggagtttgagaccaacctggccaacatgacaaaaccctgtcactattaaaatacaaaaattagccaggtgtggtggcgtgtgcctgtaggcccagctacttgggaggctgaggcaagagaattgcttgaacccgggaggcggaggttgcagtgagctgagatcatgccactgcactccagcctgggcgacagacagagattccgtctcaaaaaattaaatagataaggcaggtgcagtggctcacgcctgtaatcccagcactttgggaggccaaggcgggcggatcaagaggtcaggagatcgagaccatcctggctaacacagtgaaaccccatctctactaaaaatacaaaaaaattagctgagcgtggtggcaggcgcctgtagtcccagctactcgggaggctgaggcaggagaatggtgtgaacccgggaggcagagcttgcagtgagccgagatcgcgccactgcactccagtctgggtaacagagtgagactccgactcaaaaataaataaataaaataaaataaaataaaatgcacagggttttcaagcccatccaaacacccttgaccatgcttctcactttttgcctattgtccactacacactttgagcagcaaagcccctaacaactaattcgtaactgacttttcttttctgatgataacgaatctctcagctcttttggttaaaagcgttctcagtttctacatgtataaaccatacacaaaacatctttaaaccaagtgctaatatgttctaagcttaaaatctccttatgcatgctaagaaccaatacaatcaacttctagaaaaaggaagtttcaaaggtgctggtaatattcctttttttttttttttttttttttttgagatgggatctcgttctgttgcccgagctagagtgcagaggcacaatcatggctcattgcagcctcaacctccaaggctcaagcgatcctcccacctcagccttctgtgtagctgggactacaggtgcatgccaccacatccgattaatttttgtatttttggtagaaacagggtcttgccatgttgtctaagctggtcttgaactcctgagctcaagcaatcttcccacctcagcctcccaaagtcctgggattacagtctgggccaccacgcctggccaatgttttatttatttattttttaaagggagcacacagatgatagttttttttggcttgttttgtaaatttttttgagatagcgtcttgctctatggcccaggctggagtgcagcagtacgatcatggctcactatagccttgacctcccaggctcaagtgatcctcccacctcagcctcccatgtagctgggactacaggcatgagccaccatgcccagccaatccttgtttaattttttgcagagatgggggtttatgttgcccaggctggtcttgaactcctgggctcaagcaatcctcctacctcagcctccccactatttgggactacaggtgcatgccaccacacccagcttacatatactttttttttgagacagagtctcactctattgcccaggctggagtgtagtggtgtgatctcagctcaccaaaacctctgcctcctgggttcaagctattcttgtgcctaagcctccccagtagctgggattacagggccccactactgccgggctaattttgtatttttaacagagatgggtttcacatgctggccaggctggtcttaaactcctgacctcaagtgatctgcctccctcggcctcccaaagtgctgggattacagacatgagccaacgtgcccaggcttactctttttccttttttttttttttttttttttttgagacagagtcttgctctgttacccagactggagtgcaatggtgcgatctcaactcattgcaacctccacctcccgggttcaaacaattatcctgcctcagcgtcccaagtagctgggattacaggcatctaccaccacgcccggctaatttttgtctttttagtagagacagggtttcaccacgttggccaggctggtctcgaactcctgacctcaagtgatccacctgtcttggcttcccaatgtgctgagattacaggcgtgagccacggcacccttactcttttctatgtatgaaatatttcacagttaaaaaaaaaaaaaaaaaggtagaaaacttaattccagctgggcgtggtgactggctcatgcctgtaatcccagcacattagggggccgaggcaattggatcacctgaggtcaggagtttgagaccagcctggtccaatatggtgaaaccccatctctactaaaaatacaaaaattagccgggcatggtggtgggcgcctgtaatcgcagctactcaggagactgaggcaggagaatcacttgaacccgggaggtggagactgcagtgaaccgagatcatgccactgcacttcagcctgggcgacagagcgacactgtctcaaaaaaaaaaaaaaaaaattcaattccaagatgagctaagtacttctctagtgaaactgctttaaccaccattctttttttttttttttttttttttttgagacggagtcttgctctgtcacccaagctggagtgcagtggtgcgatcttggctcactgcaatctctgcctcccaggttcaagccattctcctgcctcagcctcccgagtagctgggactataggcgcacgccaccatgcctggctaattttttatattttagtagagacagggtttcactgtgttggccaggctggtctcgaacgcatgagctcaggcaatccacctgcctccgcctcccaaggtgctaggattacaggcgtgagccaccatgtccagccagtaaccaccattctttatcactgaccagcatttaatgcccaggtcccctcccttctgtccctgggctttcaggccatcactaatggctcctcctcctatgcttgtggctgcctctccttccgcagcttctctttctctacttattcctgttctgcctcctcattctgggtgatcccatctaagctgcgattcccaaatctatatgtattcagcccttacctctcttctcaataacaaacccatcagattgctaaataccacctggcttccagcaggtacctcaaagaaagattcttcctgttgaaaagaatcacgcacccaccctaatccctttctcttgtctcaaaggcaccactcaatcctctctgaagtcatcatacctctcccctcaccttctatgtgccactttacattcctatggcatttgatcttggctcagcttctcagggtccctctccagtaacagagaattagtccttcagatctttccccacccagagcagtttctcaaaagtaaaactcatcagttctccttttaaaatctgacagttctctttttaaaaactttagatggctcccattgttaagctcatttacaaggctgaggaggccctttacaagttggctttatctttccttcctaggttcctgcccatcatctacattaattataactgtgtctttaccagcaagcactgccaccatctcttctaccaccacctcttctacctcgtatacttgttctcatccttaaagaatcagttgaagagcatctcctctttcaagcctctccccacctcttaggtacagttgattgcctttgcttttaagctgtcatggcattctaattttttcaatagaccaaagcttctcaaagacaaaaatcaaaaacaaaaacatggtttacttccattagattccaagagtctagcagtgagctttggtatattgtaggcctctatatatcaaagaacttccctttcctatttccctccttttttgtttctgaaagcacaaaagctcaggtattcaaattacctaactctggtttaatactgtcacaaaactggtgtgacagaattcgaataccgttgagtgtgcaccttcaaagcctcttctcatcctcttccactgttcttgtcacgttcattccaggtgagttgctatgtgcctggtggccccacccaacttgttatgattttagctcagattcaactcaagttaatctgaactcccaactaataggctgtgcccccttttacttatctgaaagaattaaaataatgttttttgtttgtttgttttttgttttccgagacgaagtctcgctctgttgaccagactggagtgcagtggcgctggcgcaatctcggctcactgtcatctctgcctcccaggttcagtctcgaactcccgacctgccagacctcccaaagtgctgggattacagtcgtgagccaccacgcccggcccagaattaaaatattttaatcttaaagaccctcagaaatctagtctaatcattcagatcaaaaggaaaaatttaggtcacaattctgtggatttgagttttaaaagtcacaaatcgaatggctactagtactttccatgggaacacaactctttttttttttttttttttgagacggagtctcgctctgttggcaggctggagtgcagtggtgtgatcttggctcagtgcaacctctgcctcccaggttcaagcgattctcctgtctcaacctccggagtagctgggactacagatgcatgccaccacgcccagctagtttttgtatttttagtagagacggggtttcactatgttggccaggatggtcttgatctcctgacctcatgatccgcccgcctaagcctcccacagtgctgggattacaggcgtgagccaccacatccggctgggaacacaactcttaattggacaagattccattctcagcatgacagtgttcttgttttttgtttttttggagagagtctcactctgtcgcccaggatggagtccagctgcacgacctcgactcactttaacttccaccccccaggttcaagtgattctcctgcctttagcctcttaggcacacgccgccatgcccagctaattttttgtattttagtagagacagggtttcaccgtgttgcccaggctggtctcaaactcctgcactcaggcaatccacccaccttggcctcccaaagtgctgggattacaggcgtgagccactgcacctggccatgttcttgtatttttctctgaatcaaattcacatgattttaactactggtcaggagaaacgcaaaggggtttattcacagagttgaattctatgctgattaaaattactggcaatcctttccccattccaaattatggaagtctagatttgagttcttaaataattagaacaggggatgtaaagaggaggcacaaccatgcttcttgtttcctcctgtcccttcagggattggcttctacttcacaggtgtgtgaggctcctcttctgggctctcaggttagactaagcaccctttctcagttctcccacagctgtttcaccatgcatggagattaaatatattaaatatatacaacttacattcattcattcattcattttttgagacaaggtctggctctgttgcccaggctgaagtgcagtggcatgatcatagctcactgtagcctcgacctcccatgctcaagcaatctttccacttcagcctcccaagtagctgggacttaaaggcgcatgacaccatgctcagctaattttttaattttttgtgggaatggggtctcactatcttgccagggctggtctcaaactcctgggatctagcgatcctcctgccttaacctcccgaagtgctgggattacaggcacgagccaccgagcacagccaacctttacattttttttttttttagtagccaggcgcggtgacttacgcctgtaatcccagcactttgggaggccgaggcgagcagatcccctgaggtcaagagacagaaaaccatcctgctcaacatggtgaaaccccatctctactaaaaatacacaaattagccaggtgtggtagcgcgtgcgcctgtagtcccagctacttgggaggctgaggcaggagaatcacttgaacctaggaggtggaggttgcagtgagccaagattgcaccaccacactccagcctggcaacagagcaagactctgtctcaaaaaaaaaaaaaaaaatgccaggcgcggtggctcataactgtaatcccagcactttgggaggcccaggcgggcggttcacgaggtcaggagatcgagaccatcctggctaacacggtgaaaccccgtctctactaaaaatacaaaaagttacccgggcatggtggcgggcacctgtagtcccagctaactcaagaggctgaggcaggagaatggcgtgaacccaggaggcggagcttgcagtgagccaagatcccgccactgcactccagcctgggcgacagaacaagactccgtctcaaaaaaaaaaaaattttttttttagtaaccagtaagctcctcagaagcatgatagggctgtctgattcaatgttggttccatattaccaggtacatgtaatgctcaaagtctgctgagtacagtacattattttcttgaagggccaacttcctttagtttttaatggtaaaattttatttattctaatttttcttcatagcctgaatttatctatcgacacaagctagaaatggaaaatgtcaaacaaagcaagctaccttctgaagcattctgttgttaaactggaaacagcccttattaaataaaaatacactagagctaggccaggcgcagtggctcacacctgtaatcccagcactttgggaggcccaggcaggtggatcacttgaggtcaagagttcaagaccagcctggccaacatggtgaaaccctgtctctaccaaaaatacaaaaattagccaggtgtggcagtgcatgcctgtaatcccagctactagggaggctgaggcaggagaatcttaaaccccagaggcggaggtggcagtgagcccagattatgccacttcactacagcctgggggacagagggagacttggtctcaaaaaaataaataaaataaaatccaccataggaataccacaaatacaaaaagcagttaaagataaaaacacagaagataacaaagttacaaatagaccaaatcatcccttcttccctttcccttcatccccacccaccagcaaatcaattttatctccaaaataggcatctccaagtcacagctccactgtcactattagtcaccatcattttgtagctggattacaataacagccccaggtcactcctctgcctcaaattccttccttggagcccacagcactttaaataaaaacccaattcctgaccctgatctttatctccaaactcattttatatgtccccctttctcctttaagaaacacactcccaggccggagagggtggctcacatctgtaatcccagcactttgggaggctgaggcaggtggatcatgaggtcaagatatagggaccatcctggccaacatggtgaaaccttgtctctactaaaaatacaaaaattagccggacatggtggcgggtgcctgtagtcccatgcagtcccagctactcaggaggctgaggtaggagaatcacttgaacctgggaggcagaggttgcagtgagccgagattgggccactgcactctagcctggccacagagtgagacgtcatctaccaaaaaaaaaaaaaaaaaaaaaaagccgggcgcagtggctcacacttgtaattccagcactttgggaggccgaggcgggcggatcactaggttaggagatcgagactatcctggctaacatggtgaaaccccgtctccactaaaaatacaaaaaatttgcccggcatggttgcaggcgcctgtagtcccagctactcgggaggctgaggcaggagaatggtgtgaacccaggaggcggagcttgcagtgagccgagatcgcacactccagcctgggcgacagagcaagactccgtctcaagaaaaaaaaaaagaaaaaagaaagaaagaaaagaaacacactcccaacacaatggactttctcacctcaggacatctacataagcttttccctaaacttggaaggctcttctcctcctctcaggccaagccttgcctaggctgggttcttctttaccctcaggtcttagcttcatgctttctctgaccacgccaccccaggtaggtccctcctgtatattgatcttactagtactttatttttctacttttcagtctgtcttctccactacagtaggagttccacaggaagaaagtatgtctgtcacacatctttcccagtacctacactgggttacactgggttataattctcttataaacatttgaataaaaatataaaattaaaaattatgaagcattctaatgaaaaggataagactataacaatgcaagccaccagtccttaaatttcgagtaggacattattgttacaaattttagctatgcaagataaaccaaaatattagccaagaggcatgaaactctggctttaaaagctcagttttgatgcctgcaaagttaagccactaaatgtaccctgtttgggatgcgaagaagcattacactgagttttccgtttggcccaggctctagtagtcactagctttctataaaaggctaataacatgttaaacctaagccatgaaaaccaggcttgggagtggcaattcgaagattcagtataacaaagtaaactcagtcaggatctaattcaaccagcatggtgatctccttcagagatacctaggaaaatgaaaaactaaattaaagcaacaggcctgaggcagagggcacagagaaggagaaacaaagctgaacgtgaggggtagggtcagagaaaggccctataatctgtgaggggactggaacaacaggtaggatttcaacagatggagagtgaggtgtagttaaggcagtcagtgaagagccaacagctggagcaaaggtgcaaaggtacaaaggtatgagtaaggaaggatggctaccagggaataagtgagcagcctagtacagctgcagtaaaggaaggacgaaagagggcaaagacagaattacatgcttgttctctaagaagatgcatgcatgtacggaaaatctggaggcgattctgtggatagagagaagcggcatacttcttttccttcctctagaaggagactcaagtcattaactttttccttttttttttttgagacagagtctcactctgtcacccgggctgtgcagtggcgcgatctcggctcactgcaacctccgcctcccgggttcgagcgattctcctgcctcagcctcccgagtagctgggattacaggcacccaccactacgcccagctaattttttgtatttttagcagagacggggtttcaccatgttggccaagatggtcttgaactcctgacctcgtgattcgcccggcttggcttcccaaagtgctgggattactggcgtgagctaccacacccgcccattaacttgctttttgaaacagctgtattattagtactcatgacctcaacataagcatatgcatggcttaatgaatgcctggtattaattatataattcacgctcacaaacgagaggaagaatttattcagtcatattacaaatctcactacagtgggttctaagattctcaactccttaaattggaattatattgtgctcaaagttgactgcaactaccagcatctgccaggaaccgcaggtttcaccaatcagattcttggtgtcctggtctttgttatacagtatttgatttataatcactttctccccacttttaaagtccatttagttcagtagttaatcttgtagtcattatactgtcatggcttttttttttctatctctatcccactatgcaaacagttggtgtcctcaattataatagcttttaatgtttaaagtttagagtaatacccggtcgacaaatccataaagtcataaacatctaaccctggaaaaactgtatcaacacccagtccttttaaaatagatgtttaagaaacgaactggccagtttgttactttaaaaattctaggcaacttttcaactcaaatttgggataatttaaataaaagaaacctctgataaaatcagtgttacagggcaaacacaacaataaaagcaaatctctgctaaaacgcttaaggcaaattaaagcaactaatcaattaaaataacgtatttcacttggaaaagagaatgcttggtcactttgcgttaattttaaaataagaaatacaaaatcattagacttaacacaaaaagcatgtctgaaattgaactaggatacaactaagtgtcattcaaaaattttccttaataacattctagcctaattccaccttggaaattaaccagactgatctctggcctactaatggtcctcggggagaaaatatgcaataaattttccaaaaaatatcctcgctgaagccaatgcaccttctcttatctttgtaattaacgtactataaaagtggtggtgtctggcctgcttcaaacttggcaccacagtatcaatatacagttctgatattttggttaaaggtttttttgtttctaaacgctaaagcattttcatttttttgactgttccaaaggctgcagtcctggagttcttaacctggagttcagagatctggagggagtacaagcacccgggatggtgtgcaaacttgtgtgtacgtgcctttggcggggaggggtgggggtgggggtgggggtggggtggtgagtgctcggctatcttcagattctcaaagaagtctatggcttaaaaacggtttttggccgggtgtggtggctcacgcctgtaatcccagcattttgggagaccgaggcaggcggatcacgagggcaagagatcgagaccatccaggccaacatggtgaaacaccgtctctactaaaaatacaaaaattagctgggtgtggtggcgtgagccagtagtcccagctactcgggaggctaaggcaggagaatcgcttgaacccgggaggcggaggttgcagtgagccgagatcgcaccactgcactccagcctggcgacacagcgagactccgtctcaaaaaaaaaaaaaaaaaagaggtttttagaaaaaccaacaaatccctgcatcagtattacacccagagaaagtcacgaaaggcaaaaagcgtgcattttaactatgcaaccaccgttaaacattcaaaacgcatcctcttcacattgagaaacagcctcgtgagagggaaaaaaaaaaaacgcatcctcttatccagtgacccagatcctgacactagctttctgttaggaaggccttctggaaaataatttggttcagaatgcggggaatatgggttcaagcgcgccccacccccctatacaagcactcttcgacagacccggttctcgaccttcctccgcggtcggggagggctctcgcgtacctgggcgcaggctcgatgagggtggtggtgtccaggtagtggatcttgtaaaactccagcagggccggcaaatggtcaaattcctggtccccgatcttaaaacggcggttgggcagcgagttgatgatgtagtgggagacccgcgagttctcggacaccgacagcacatagtccccagggcaggtggaagaatcgcggacgaggaacataccgtggcgctggccctggagccgggtctgcgcctcctggcgagacaccggccccatataccaggcggagcggtccgaggagtcgaacctggcggaggacatggtgttggaccggggactctgcggcggtaggggcggcggctgtcctcgcctgctctgcacgccttagcccggcagacggctttggggccgaggaagggcctctcgcacacctcgaggagcgctcagagggctgggccagcactttcctctcggctccgggcccgcagcatcctccgacgccgcccgcctgctccggggccgccacacggagagagccgcccgggaatgcacggcagagccggggggtcggggcaggcaaacccgagccgcagcggaggccaccccggggttctcgggctgctcggcgtcccaggggtgcctccagtgactcccggcctggaacgcgccggcgccgcagctcgacgggtcttcaccgacccccgccgtcacacgaggcaccgaactcgaaggagcgtcgcgcctccggggtgcttttgcccagcttgttcccaatagccacagcaacaaaatggcggacgcgggagaagcggcagccacctccccctccgctcagcgcgctccgtctgcgcacgcgctgggccccggctcccggcggccgccggggccctcccgttacgtcacacagcgcagccaatcaggagcaccgtcgcgacgatcagggtgggcgctggtcgcgcccgctcccgcgttccaggaggaggctgaagaggcgccggcggtaggcactctcttcctgggccgctgcgcgccgctgggggcgctgcggctgccgggtctcccagcgctggcaggaaaacagctggagccgagagggaaccgcgtttcgaaaacctgcttctgggaacaaagcgtaacgtgcaggctgaatcgcgggccagggaggcgtggcactgaggcgacctggccagcctaggggcctgagggaggtcaaggactgacaggtcccgatgggccgaggtggcccagtaaaaggatgagcccaggggcagatgtgaccaccagataggtgactgactgaatgactcagtccccaggtggcctgataggctaaggaagccctagtggctacgtgacccgctaaatggagtgagaggagagagaaggtgagggttagattgactcaattaagtggtcaaggaagtccacaagtgggtaacctggctatcatgggctctgaactgctgaaagtaaaatacaaatgcctctcgggcgtggccccgaggcttcccctgccccggattatgcctgcttctgcctatttattaatccctatttgtttttgtttgttttctttctttctttctttctttctttctttctttctttctttctttcttttcttttttcttttcttttctttctctctctctctctcttcctttcctttccctttccctttcctttccctttccctttcctttccttctttcgacggagtctcgctctgtcaccaggttggagtgcaggggcgcgatctcggctcactgcaacctccgcctcccgggttcaagcgattctcctgcctcagcctcccgagtagctgggattacagctgtccgccgccatgccctgctaatttttgtatttttagtagaaacggggtttcaccatgttggccaggctggtctcaaactcctgacctcaggtgatctgcctgcctcagcttcccaaagtgctaggattacaggcgtgagccaccgtgcccagcctgtttgttttattttgtttgtttttgagacaggttctccttctgtcacccaggctggagtgcagtggaactatcatggctcactgcagccttgatttccccatctcaagggatcctcccacctcagccttccgagtagttgggactacaggctcgcgctgccatgcccagctaatttttttgatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctttgatttttaatagagacgaaatctcaccatgttgcccaggctcgtctcagacttttgagctcaaacaatcctccccctcagccaagatgtgagccaccccgcccagctatgtatgaaacaagttaatatatgcaaagtgcttagaatagtacctggcacatagtaagcatcatatgagtcttccattattattattcagtcattccctgggcctctacctctataccctaaaaccctgagcatacaccctcagtgggtgggtgagggtggagagaaaaatctccactttgttttctaactacttttcactgtcagatttaccacttcataatcacctgctccttgcccagccctttttttttttttttattctgatacggactctagctctgtagcccaggctggaggagtgcagtggcgtgatctcagctcactgcaacctctgcctcccaggtccaggttcaagcaattctcctgcctcagcctgccaagtaggtgggattgattacaggcatgcaccaccatgcccagctaatttttgtatttttagtagagacagggtttcaccatgttcgccaggctggtcttgaactcctgacctcatgatcctcctgcctcagcctcccaaagtgctgggattacaggcgtgagccaccgcctgtaatcctagtggtgattttttaatttttaaattttttgtagagatgaggtctcactgtattgcccaagctgatctggaactgctgggctcaggtaatcctcccagcttggcctcccaaagtgttgggattacagacgtgagccacccacccagctgctcaaccttcttaatctggcttctacccatgctttgactgaattaggctttttgggttttgttttgtttttaaagacatgtctctctgttgctgactctcgtctcaaattcctaggctcaagtagtcctcctgcctcagcctccaaagtagctaggattacagatgtgagccacagcaacccgctctctgccctctaaatgcagagcgtccttcacctctccatagtttttcctttagtaggctaataatcagcatgaagcatttaggggtcacatctctggtgactccaaacacatattctaaaagcagaaccaaaactgaccatactctctgattactatgtatacactgtgggcacagcctaaattaatttttatcacattctattgtaattgttcataaatatttttctcatcccaatctgagcatcttgagggcagcctgctatatattattttttctattcccagtacctagcacataatacatacttttttttttttttgagatggggtctcattctgctgcccaggctggagtgtagtggtgcaatctcggctcactgcaacctctgccttctggattcaagtgattctcctgcttcagcctcctgagtagttgggattacaggcacgcgccaccatgcctgactaatttttgtatttttagtagagatagggtttcaccatgttagccaggctggtctcgaactcctgacctcataatctgcccgccttggcctcccaaagtgctcggattacaggtgtgagccaccacgcccagccgatacatacttaatgtatggtttttgaatgtagatggataaagatgggaggaagccagagaaaaatgataattgaacattagctgctggctcactcccttttcagcagccctctttgcctcagccctctttgcctcatcttttcagggtgtactatctgtctatataaactatctgctcttggccaggtgcagtggctcacacctgtaatcccagcattttgggaaggtgaagcaggtggatcctttgaggccaggagttagagaccagcctggacaacattgcaaaaccccatctctattttaaaaaaagtaaaaacattctttttttcgagacagagtctcactctgttgctcaggctagagtgcagtggcgtgatctcggctcactgcaacctccgcctccctggttcaagtgattcttcctgcctcagcctcctgagtagctgggactacaggcgcatgccacaacacctggctaatttttgtattttttagtagagaccaggtttcaacatattggccaggctggtcttgaactcctgacctcgcaacccgcccaccttggcctcccaaagtgctgggattacaggagtgagccacggcacccagtcaatgtaaaaacattgtaaaaataaactctctgctctctattttccttaaataaactctctttttagaaaaaagtaaagtccgggcacagtggttcacacctgtaatcccagcactttgcaaggctgaggtgggcagatcacttgaggtgaggagttcaagaccagtctggccaacatagtgaaaccctgtctctactaaaaataccaaaattagctgagcatggtggcgctcacctgtagtcccagctacttaggaggctgagacaggagaatagcttgaacctgggaggcggaggttgcagtgagccaagattgtgccactaccctccagcctgggagacagagtgagacaccatctcaaaaaaaaaaaaaaaaaaagaaccaaatatctctcattttgcttctaaatactccagaggggaataaggtgtgggttagataaaagtgaaacaagaatggccatgtgagattgataattattgaaaccaggtgacatgatgcgagggtagggttaattatattctataatacttttatgtatgtttggaatttgtcataataaaatttttgtaaaagatactttcctttatttttccttagcacagttgagacaagcataaaataaactttccaggctgggcatgttggctcatgcctgtaatcccagcactttgggaggccaaggtgggtagatcacttgagcccaggtgttcaagtcccagctactcaggaggctgaggttgggggatcatctgagcccaggaggtcgaggctgcagtaagccttgattgtgccactgcacctcagcctaggcaacagagcaagaccctgtcaaaaacattccaaaaaaagttactaaatgctgagatagcaaaacagcaatgagtagagaaacagaaagaaaccattaaaaaagctgtaataggccgggcgcagtggctcatgcctgtaatcccagcacttttggaggccgaggtgggtggatcacgatgtaaggagatcaagactatcctggctaacatggtgaaaacccatctctactaaaaatacaaaaaattagccgggcatggtggcaggcgcctgtagtccccgctactcgggaggctgaggcaggagaatggcgtgaacccgggaggcggagcttgcagtgagccgagattgcaccactgcactccagcctgggcgatagagccagactccgtctcaaaaaaaaaaaaaaaaaagctgtaacatatagattttgattcttccttagcttgcatattcccagggtttctagatggtattatacttaaactcttgtcttctaaaataattacaatcgccagaccagctgcggtggctcatgcctgtaatcccaacactttgggaggccgagataggcagatcagctgaggtcaggagttcaagaccagcctggccaacatggtgaaaccccgtctctactaaagaccaggcatggtggcacatgcctgtagtcccagctactgggaaggctgaggcaggagaatcgcttgagcccaggaggtggaggttgcagtgagccgagatcgcaccaatgcactccagccttggtgacagagtgagactccgtatcaaaaaataatagctacagttgccacgtgtggtggctcatgcctgtaaacacaacactttggaagtctgagtcaggaggagtgcttgagcctaggaggttgaagctgcagtgagccccagatcatgccactgtattctagcctgggtgacacagtgagactgtgtctcaaaaaaaaaaaaaaaaagggctgggtgtggtggctcacacctgtaatcccagcactttgggaggccaaggcaggcagctcacctgaggtcaggagtttgagaccagcgtggtgaaaccccatctctactaaaaatagaaaaattagcgaggcatggtggcgtgcgcctgtagtcccagctactcagggggctgaggcaggagaatcacttgaacctgggaggcagaggttgcagtgaactgagattgcgccactgcacgccagcctgggtgactgagagagactctgtctcaaaaatatatatatatttttatcatggattagtttcagatgaataatgtcataaataaccataggctctaaacaccttatattttccagggctttataaatttgctcaactaagcctttttctgcttcatacatgattaccaccatcacttgttacccattttagcagattccactttgggttatactgaattattgttttctcaacttaaaaagaatacgtatatatataatgcacacacacacacacacatatatatgtaaaaactctgcaaggcaggcatttggtgctgggctcttacctgttcacttgccattactgagggaatcctggttagtttcttttcctctgctgactaatatgcttaaattcagctggtcatcacgtctggtctgagttcaagtcttttatttatttattttgttattgtttgtttgtttttttgagatggagtctcgctctgtcgcccaggctagagtgcaatggcatgatctcggctcactgcaacctctgcctcctgggttcaagtgattttcctgcctcagcctcctgagtagctgggattacaggcgcgcgccaacatgcatggctaatttttgtatttttgtagacactgggtttcaccatgttgggcaggctggtcttgaactcctgacctcaggtgatccgcctgcctcggcctcccaaagtgctgggattacaggtgtgagccaccacacccggcctatttatttatttttgagacagagtctcactctgtcacccaggctggagtgcagtggcatgatcttggctcagtgcaacctctgcctcccaggctcaagcgactctcatgcctcagcttcccgagcagctggaatgacaggtgtgtgccaacacgtctggctaatttttgcatttgtagtagagacagcgtttcaccctgttggccaggctggtctcgaactcccgacctcaggtgatctgcctgcgtcagcctccaaaagtgctggattacaggcatgagccactgtgcctggcagaggttaagtctattagagatgagggcccactgtgttgcccaggctggtctcgaattcctgggctcaagcagtctgctgtccttggcctcccaaagtgttaggattacaagcatgagccaccatacccggccaacttttcagaatattgcctatagttattccatgcacactattcaagagaaatgtatttgtcagtgattttatattcagcattggcacctcaaataaacaacaattgagcactaatggtaacatctatcaagtcgttgataatcaaggaaaatcattcaaaatcatttttctttggacacttttcttctgctacgacaaacacaatttaatgaactcaccgccagtaagcagctttctttggctaacacataagccccttggaaacttacttttgcagtttcattttcattttttcttttcttttttttttttgaaacagggtttcactctggcacccaagttggagtgcagtggcatgatcacagctcactgcagcctctacctccagggctcaagtgattctcccacctcagcctcccaagtagctggtactataggcatgtgccaccacacctgcctaattaaaaaatttttttttgtacaggcagggtcttgctatgttgcccagtctggtctcaaactcctgggctcaagtgatcctcccaccttggcctcccaaagtgttgggattataagcatgagctaccacacccagcctcatttttcatttttgtgcagaaattctgataagatgttccatttgaaattttcctattttttttctttatttctttctttttttttttttttcctttttctgagacgggttttgctttgtcacccaggctggagtgcggtggcatgatcacagctcactgcagccacgacttcctgggctgaggcagtcttcccacctcagcttcccaagcagctgggagcacaggcacatgccaccactcctggccaatttttttttttttttggtagtgatgaggtcttgctgtgttacccaggatggtctcaaattcctgggctcaagcagttctcctgcctcagcctcccaaagtgttgggattacaggcatgagccacagcacctagccaaaattttccaatttttctgactgttgctttcctataaattggtaatactgtgatgactgcttagtctaagttaacatacattttattcttttagcacagatacggtgtcactgcataataaacacaatacttcgcaattgtatgctttttttttttttgagacagttttactcttgtcacccaggctggagtgcagtggtgcaatctcggcttactgcaacctccgtctcccgggttcaagtgattcttctgcctcagcctcccaagtagctgggattacaggtgtgagccactgcgcccccgaccttgcaattgtatacagtaacaaaataatctacactttgccttgaaagtgtgacatccaaagtctacttttctggcctggtgtggtggctcatgcctgtaatcgcagcactttgggaggctggggcaggaggatcacttgaggtcaggagtttgagaccagcctgggcaacatagcaagaccccatttccacaaaaaatttttaaaaattagctgtgcatagtggccccagctactcaggaggctgaggtaggagaattgcttgagcccaggaggtcaaggctgcagttagctgtgattaaacaccacggcactccagcttgggcattgagacagcgagaccctgtctcaaaaaaagaaaattatacttttcttcttttgatacaagaacgtgcattggcaattttttttttttttttttttgagaaggagtcttgctctgtcgccaggctggagtgcagtggcatgatctcggctcacggcaacctccgcctcccaggttcaagtgattcctctacctcggcctcctgagtagctgggactacaggcacccaccaccacacctggctaatttttgtatttttagtagagatggggtttcaccatgttgatcaggctggtctcgaactcctgaccttgtgatctgcccacctcagcctcccaaagtgctgggattacaggcgtgtgccaccacgcctggccaaaatactgctgaattataattgcagcactccaacttgtagtgcactgagcagcagcacaaagggatgagagtgccaggtacgtgtctgccacaactactcaactctgccattgtagtgggaaagcagccacactgtatgtgactttgtcccaataggtttaggtacagctatattccaggaaaactttatttatgggccctgaaatttgaatttcacataatcttcatgtatcatgagatattcttttgattttccccccaaccgtttaaagatgtaaaaaccactcttgactgggtgcggtggctcacgcccaacactttgggaggctgaggtgggtggatcacctgaggtgagaccagcttgatcaacatggagaaaccctgtctctactaaaaatacaaaagtagccaggcgtggtggcacatgcctgtaatcccagctacttgggaggctgaggcaggaaaattgcttgaacccgggaggcagaggttgcggtgagccaagatcgtgccattgcactccagcctgggcaacaagagcaaaactccatctcaaaacaaacaaacaaacaaaaaaacactctttgcccacaagccataaaggtagagttgatgggcaagatttggcccatgggccattgtttgccaactttaggtcaaaaatcttctatattgaatgtgtgccttttgtgttgctcccagtgtgacccagaacttttttaaggtcactaccacaaattcttttttgtttttttgagacggagtcttgccctgtcgccgaggctggagtgcagtggcgcaatcttggctcactgcaacctccgcctcccatgctcaagcgattctcctgcctcagcctcctgagtagctgggattacaggcgcctgccaccacgcctggctaatatttgtatttttagtagagacagggtttgaccatgttggtcaagctggtctcaaactcctgacctcgtgatctgcccgccttggcctcccaaagtgctaggattacaggcgtgagccaccgtgcccaacctactaccacaacttctaatagatgtcttcccctaaaaaagacccctgattataaccacacagccttgataaattcaatattggtttgcatcttacttcatctctgtgtctagcccaattctctagttcagagtattcagttccagatagcctggcacatgatccgggcatatcccacagcactgtcaacatctgtgccagatggagctccctcatctagttatagtattccaaccagaagggttacttgagccatcagagttaggttctagaacacagagcaaaggccaaatactacccatacccacaacacaaaaactgcctctcagatatcgtgtttcatctgagactgaagcttaaaacaccgattctcagtgctgactgaacatttgatcacctgcatagcataaaaaaacaacaacaacaaaaagcccagtcctgatcccagaagactgatttatttatttggcttgcagggagacctgagtactatattaaaaaaaaataatgtattaaaatggttcaaatataaagtgatacaaatggtatttattgagaagtcctgctcccatcccatccgacttggaggaccctatagttaactacttctattcatctcttgtgtatcacacaaatgtttatgtaagaatatttttattttccccctttcttacactaaaggaaacatatccactcttctgcgtcttgctttttaaaaatctaacaatatatcctggaataatttccacatcagcattttgagagtttccttgttgtttgtttgtttgtttttatatttgcatactattccattgtgaagatagaccatagtctatttaaccagtctccatacttagatatttatttccaaactctcgttacaaacaatgccataatgtataactttgtgcatacatcatttcatatgtatgcaggcatttctgtaggatgaattcccagaagtggaattaaatgatagattaaatgataaatgtgcatctatagctatggtcaaattgccctccatgatgcttttagcatttggtactattgcagcaatataggagaatacctgtttactcacagcttcatcaacagcgtgtgtcacaatgggctgggattatgcagcagtggcttaactatttctgacacagggcaatgttcctcggtgcagcggctcagatccagggtggtgaaactcccccatcctgaggctgcaccaaatggaacacttcaccttctcacttagtagctgaattggggaacagaactggagaatccccatagtttgattaatagcaccagctattaaatccttcagcccagaggaaaatatgttaattctgctcacattttatgggccagaatgagtcacatgctaagcctaaattcagggggtgcaggaaattgtatagtccatattctcagaagtagaggagaactggatattaataaaattttatgttcaacttttagactcttgccaatctgataggtgaaaaaaaatgttcaaagtagttttattttgcattgctcttattaggagtgaggtcaagcatcttttcatatgttcaagggctatcatgagtatttattaaaacttctagccaattctaatgtgcaaccaggcttgcacctcctggggctttcctactcagtttagattttctgagagaaacatcttttccctccatgattagtaggaccacagtgactgaccaagggagaattcgttctatagctgagactgccttttatgtaatagcaatagggtgtctcattataaaatggctttcagtcaataaccatagcattcttgttatataacctgtgtaccataatgggtggccagatggtctttcagtaatagagccagaattagaaatctttgactaaaaaacaaccaagagtcaatgcttactaagagtattgcatcgatgcctgttatcatcatctctatttgaaggaggaagtattttataatggatcttcactgaactcgaatctttgatagggtaagatttttttttttttttaattgagataggggtctcactctgtcactcaggctggagtgcagtggcttgatcttggctcactgcaacctccaacttccaggctcaagtgatgctcccacaccagcctcccgattagctgttcccacaggcatgtgccaatctgatagggtaaaatcttttaatgctgtagattgtgtacggacagaagactttaatcctaaatccacttttcctaacacaagactaaaacctcaagagctagtataaaatcatgaacatagtttttcctgctcaggtacctgtttccacttttttatctcctacccatcatggagcagtttcttgggacatcttttcttctaaaattgaagattttatttttgtttaaactcctagatcacctaggttcctcccactcaattcctggtgccaagcctattcagaaagtagtcatgactgaggtcagggcctaaccctcctggaattaggcaatcagatccgtctatacttgcaacaccagagtgactcaatggtcttacaaaagtttactcgccatggattcatgatgtaatcatcttaactaacaagctgtattagcatgctttggctgcaatatcagaaatccctattcaaaatagtttgagccaggcgcaagggcatttattatttttcataacatgaactctgtagcaggcagctcaagatgcaggatgtccaggccgtgggtctgcttctgtgtgattttttttggttctaatttctttcaggttttggcttcatcctctggctggttatcccaggcctcacatccagttatgccaatgcccagtgggagaaggacagtcatttccttgtgtcctttttttagagacagggtctcactatgttgcccagactggagtgcagtggcacgatcatcattcaccgcagcgtcaacctcctgggctccagtaatcctcctgcctcaacctcccaagtagctgggaccacagttatgtgccaccatgcctggccttgtgtcctcttttatttttttcttttttgcagagatgaggtctctcactatgctgctcaggctggtctcaaactcctggcctcaaatgatcctcccaccttgccctcccaatatgctgggattacaagtatgagccaccaaggccagcccttgtgtccctttttaagggcaaagagcacttcctccagaaacctgagagctctccctttacatcccatcccatcagggcacatgcccattcctaaggcaaggaccagcaagaatgggaccacttgtgcttgactgagctcatacaagactctggcttcctgctaggcatggtggctcatgcctgtaatcccagcactttgggaggccgagacaggtggatcacctcaggtcaggagtttgagaccagcctgaccaatatggtgaaaccccttctctactaaaaatacaaaaattgccaggcacagtggctcacgcctgtaatcccagcactttgggaggccgaggtgggcggatcatgaggtcaggagatcaagaccatcctggctaacacggtgaaaccgcgtgtctactaaaaatataaaagattagctgggcgcggtggcaggcgcctgtagtcatagccacttgggaggttgagacaggagaatggcaggaacctgggagggggagcttgcagtgagctgagatcctgagactccgtctcaaaaaaagaaaaaagaaaaaaagaaagactgtggctttgccttcaagcggaaggaaacatttctttgggtaatcagacacatgcggactaaaactcctccttgctggatttcaggaaaagaagccctttgtaagatcctgagataatgaacatttaagtgacaaataggttcagcacacctgtattaagcatctcccaggagctagacttggggatgcaaagtgaatgtgatatggtcctgcttggtggtacttagtctagtggaggaataagcactattcaatctgattttaacttggctcctcaaatagccttcctacagaaagagaatgagcttttttcccctttcacttgctccttccccaccccctcttctctcccttccttttcttactatccatcctacaaaaacttcttaagtgcctactctgtgccaggcacaatgctctgcgctcgcatcagaaaacttacattctggtcagttatctctcttattgtaaatgagtaataatggtcttctgattataagatttattgtgattttggttagtacctgtaagacgctagccacctctcgtcctgtgaacccagggccacactcagggccatcagtggagactgtgtcatgtgctgcctaaactggccaattggcttccttaaatgacacgttaataggagccaacagaagtgggatttgtttgtttgtttgtttttgagacagggtcttactctgtcacccaggctggagtgcagtggcatgatcttggctcactgcaacctccacctcccaggctcaagcaatactcctgccttagcctcccgagtagctgggattacaggctcctgccaccatggctggctaatttttgtatttttcgtacagaaagggtctctcacaatgttggccaggctggtctcaaactcctgacctcaagtgattcacccacctcggccttccaaagtgctgggattataggcatgagccaaggcacctggcccccaacagatgttttttttgtttttttgttttttgagacggagtctcgctctgtcacccaggctggagtgcagtggcgtgatctcggctcgctgcaagctccacctcccgggttcacgccattctccttcctcagcctcccgagtagctgggactacaggcgcccgccacgacacccggctaattttttgtatttttagtagagacggggtttcaccgtgttagccaggatggtcttaatctcctgactttgtgatccacccgccttggcctcccaaaatgctgggcttacaggcgtgagccaccacacccggccccaacagaagttttaagtggtggaatgacatgatcagtattagcctatcgtggagaagggaaacttgaaacaaaccacattttaaaaaagaaaaaaaaaagccaaatcaacccacaacagaacttggtctctcaatgttgcccaggctggtcttgaactcctgtactcaagcaatccttctgccttgccctcctaaagtgcttgaattacaggcatgagccaccacacaggtcttttttttttttttttttttttttgagatgagatctcactctgtcgaccaggagtgcagtggcaggattatagctcactgcagcctcaatctcctgggctcaagcaatcctcccgccttagcctcccagatagctgagactacaggtgcagaccatcacgcccagctaattatttttattcttattttttatgtgtgtgtttgtgtgtgtgtgtgtgtgtgtgtgtgtgtgtggagacagggtctcgccgtgttgctcaggctagtttcaaactcctgggcttgccgggcacggtggctcatgtctgtaatcccaacactttgggagtgttgggattacaggagggcagatcacctgagctcaggagttcgagaccagcttgaccaacatggagaaaccctgtctctactaaaaatacataatcagtcgggtgcggtggtgcatgcctgtaatcccagctactcagaaggctgaggcgggagaatagctcgaacctgggaggtggaggttgtggtgagctgagattgcgccattgcactccagcctgggcaacaagagtgaaactccatctcaaaaataaataaataaataaaaactcctgggctcaagtaatcctcctgccttggcctcccaaggtgctgggatttatagacatgaggcactgcacccatctgttttcatttaatttttttttttgagatggagtcttgctctgtcatccaggctggagtgcagtgatgtgatcttggctcactgcaatctctgcctcctgggttcaaatgattctcccacctggggctcctgagtagctgggattacaggcatgcaccaccacgcctggctaattttgtatttttagtagagatagggtttctccatgttggtcaggctggtctcgaactcaggtgatctgcccatctcggcctcccagtcgctgcgcctggccttgatttactttctttttttttttttttttgagatggagtctcgctctgttgccaggctggagtgcagtggcgcgatctcacttcactgcaacctccacctcccgggttcaatcgattctcctgtgtagctgggactacaggcaagtgctaccacacccaactaatttttttttttttttttgacacggagtctcgctgtcgcccagactggagtgcagtggcgcgatcttggctcactgcaggctctgcctcctggttcccgccattctcctgcctcagcctcccgagtagctgggactacaggcgtgagccaccgcgcccggcctaatttttgtatttttagtagagatggagtttcaccatattggccaggatggtctcgatctcttgacctcgtgatccgcctgcctcagcctcccaaagtgctgggattacaggcgtgagccaccatgcccagcttggtttaatttctaaatgacctagaggtgctctttgtctccaaggtttgtatcttctttagggtgttgttgtgcttccttcagcattggtgggggtcgggtgagcagtttctttcctatttataaatggcttgcctcactcttttgcttttagtctatggtcaagtcctggctgggtggagtggctcacacctggaatcccagcactttgaaaggcagaggtgggaggatgatttgagcctaggagttcaagatcagcttgcacaacacagcgagacctggtctaaaaaaaaaaaaaaaagaaaattagcaggacgtggtggcatgtgcttgtggccccagctactcaggaagctgaggtgggaggatcgcttatgcctgggaggtcgaggctgcagtgagccatgattacatcactgcaatccagcatgggcaactaagcaagtgtcagtcaagtcaagtcctatccggattttgggacattttttggggaatatttaaagcacttaaatgcaaagatcaatgtcaagtcagctttactttttctctgatttgagccctgggtctggcacctagacttctgccttgtgaccgtagtcagggaaccagacctttgccctaagccttaagccagagccctgatttctaacttgcctttcttggctgtctggtcagcccagggacaggaggcttgatctttttaaaatttaatttttagctgggcacagtagttcactcctataatcccagcactttgggaggccaaggcgggtggatcacctgaggtcaggagttcaagagcagcttggccaacatggtgaaaccctttctctactaataatacaaaaattagccgggtgtggtggcgtgcgcctgtaattccagctactcgggaggctgaggcaggagaattgcttgaacttgggaggtggaggttgcagtgagccaagattgcgccattgcactccaggctgggtcacaagaatgaaactccgtctccaaaaaaaaatttaattttctaagaagtgtagggggccagtgcttgctgtgttacccatgctggtcccagactcctggcctcaagtgttctcgctttagcctcccgagtacctgggattataggtgcaagacagagggcctggttcaggagtcctgctcttgaacttcagccgtattggtgaggtcctctactacctgctgctaagcagctgcgaagctaactagtgactctaaggctagaaactgctactctatttctttaaatccatgaaatgtgttaaagaccagggtccttctaagtgccctgtcttagctgggtctatgacagccctatccttggtgatctaactctccagtcatctatctctgctccatccaatttcagccacgcaaagaaaataaaggccaggccaggtgcagtggctcatgcctgtaatcccagcgctttgggaggctgaggcgggtggatcacaagatcaggagattgagaccatcctggctaacacggtgaaaccccatctctactaaaaatacaaaaaattagccgggcgtggtggcgggcaccggttgtcccagctactcaggaggctgaggcaggagaatggcatgaacccgggaggtggagcttgcagtgagctgagaccgctcccctgcattccagcctgggcaacagagcgagactccgtctcagaaaaaataaaaaataaataaagaaaagaaaggccgtcagatgtcagctccttccagctgaaacttatttgtataggttctgggttgaactgtgctcccctgactcccctgccaaattcatatgtggatgttctaatccccagtaccttagaatatgaccttatttggagatagggtcttaacaaaggtaattactgaaagtaaggtctttggggtgggccctaatccagtataactggtgtccttaagatgatataaagatacagggagaagactgccctgtacaagccagggagagacccagaacagatctttctctcaccactctcagaagggacccaacactttggttcctctagaactgtgagaaaataaatttctagactgggcgcagtggttcatgcctataatctcagtactttgggaagccaaggcaggctgatcacttgagctcaggaatttcagagcagcctggccaaccccatctctacaaaaaataaaaaaatcagttgggtgtggtggcacatgtctataatcccagctatttaggaggctgtggtgggaggatcacttatgcctgagaggttgaggctgcagtgagccgtgatcccaccacagaactccagcctgggtagcagagtgagacactgtctcaaaatatgtatatggctgggtgcagtggctcatgtctataatcccagtactttgggaggctgaggcgggcagatcacctgaggtcgggagttcaagaccagcctggccaacatggtgaaaccctgtctctactaaaaatacaaaaaattagctgggcgtggtggcaggtgcctgtaaccccagctatttgggatgctgaggcaggggaatcgcttaaacctgcgaggtggaggttgcagtgagctgagattgtgctattgcaccccagcctgggtgacagagcaagactctgtcgcaaaaaaaaaaaaaaaaaaaaaaaaaaaaccaggcgtggcatgcctgtaatcccagctactcaggaggctaagacacaagaattgcttgaacctgggaggccgaggtggcagtgagccgagatcgagccactgcattccagcctgggtgacagagtgagactgtctcaaaaacaaaacaaaacaaacaacaacaaaaagtatacaggagaatgtacataggtcatatgcaaatacttcaccatggtcacatttaatattctattaattttcttttctctttttttttttttttgagagggagttttgcccttgtcacccacgctggagtgcaatgtcacagtcccggctcacttcaacctctgcctcctgggttcaagcgattctcctgcttcagcctcccaagtagctggaattaataggcacccactaccatgcctggctaatttttgtattttgtatttttatttatttattttttttttgagatggagttttgctcttttgcccaggctagagtgaagtggggcaatcttggctcactgcaatctctgccacccgggttcaagcgattctcctgcctcagcccctggagtagctgggattacaggcacccaccagcacgcctggttaatttttgtacttttagtggagacaaattttgccacgttggccaaattggtctcaaactcgtgaccttaggtgatctacccacctcggcctcccaaagtgctggcattacaggcgtgagccaccacacccagcctaatttttgtagttttttaaattgttttgtaatttttgtattttttagtagagagggggtttcaccatgttggccaggttagtctcgaactcctgacctcaggtaatctgcctgcctcggcctcccgaactgctgggatgacaggcgtgaaccactgcgcctggcctgttttctttcctttttttttgagatggagtttcgctcttgttgcccaggtcggagtgcaacggcatgatcccagctcagtacaacctctgcctcccgggttcaagcgattctcctgcctcagcctcttgagtagctgggattacaggcatgcaccaccatgcccagttaatttttttatatttagtagagagagagtttcaccatgttggtcaggctggtcttgaacgcctgacctcaggtgatccacctgcctcggcctcccaaagtgctgggattacaggcctgaaccaccacacctggcctggcctattaattttctttcttttttttttttttttgagatggagtctcgctgttgcccagactagagtgcagtggcgcgatctcggctcactgcaagctctgcctcctgggttcatgcgattctcccacctcagcctcccgagtagctgggaccacaggtgcccaccaccacgcccggctaattttttgtatttttagtagaggcggggtttctccgtgttagccaggatggtctcgatctcctgacctcgtgatctgcccgcctcggcctcccaaagtgctgggattacaggcgtgagccaccgcgcccagcctattaattttctacttgtcttattcattgtcttctctgtccattccatgagggcagggattctgatctgttttgtgcataacttttggtgcagcacctgggatccatctggatgtcccaaaggtcttcaaacttaacctgtccagtacctagttcatcaatgtccctaaccccaaacttgcttgtgctttttttttttttttttttttgagacagggtcacactctcttgcccaagtggcatggtcatggctcactgcagccttgacttcctgggctcaagcagttctcctgtctcagcctctctagtagctgggaacacaggcatgcaccacaatgcctggctaattttttattatttgtaaagacagggtctcactatgttgcccaggctggtctcaaacacgtggactcaagcaatcctcctgcctctgcctcccaaagtgctgggattacaggtgtgagctgccatgcccagccatgttttttttgttgttgtttatttgtttgtttgtttttttgagacagagtcttgttctgttgcccaggctggggtgcgtggtcaatcttggctcactgcaacctccatctcctgggttcaagcaattctcatgcctcagcctcccgagaagctgggactacaggtgctcgccaccaacgtgggtaattttttgtatttttaatagagacagggtttcaccatattgcccagggtggtctcaagctcctggcctcatgtgattcacccacccattgatcttggcctcccaaagtgctgggattacaggtgtgagccaccacgcctggcctgtttttgtattccttttgtgaaaaacactgtctactaattcctttgcccagaagcctgagtgctatcttcgcttcctccttctacgtcatcctacattggtgagttggtcactaaagcctgtcctacccagtgctctgcagtctgccccatctctccctttctgtcctgccaccactctagtttgggcccctcttcaattcttgcttggaccatgaccaaagtcttttccttactctgttcccagcttgtcctcctcactgatgcaagagtgatttttttttgtttgaaattcatatattggtttgcttttccacaaagttgggaccataccatataatgttttatgttaatcttgcaagcattatctttgaagacttttcatagatgcaattgtctgttgcagctatgggtgaacatagttgactccatcatcttcctaatcaggttgtttctaggcttattatttgcttttatttatttatatttatatttatttattttgagccagagtcttgctctgtcacccaggctggagcacagtggtgtgatcttggctcactgcaacctttgcttcccgggttcaagcgattctcctgccttggcttcccgagtagctgggattacaggtgtctgccaccacgcctggccaatttttgtattcttagtggagacagggttttgccatgttggccaggctggtctcaaactcctgacctgaggagatctgcctgccttggcttcccaaagtgctgggattacagtcaagagccgccgcgtccagccattatttgcttttataaataatgcggtgatgcatctttatgatctttcaaaatctgaatcttgtcacgtcactcgcttgcttagactccatcagtacctccctgtcattgaagtgcaatattctgactcctcagtatggctcataaggcctcttagattagatcctgcctacctttcatgtcatctcccacccacaacccataacgccagttccctacttgcagatgccaaatgtgagccgccttgatttttttcacttatgcttcttcctctgtaatgtcctcttcttttttttttttttttttgagatggagtctcgctctgtcacccaggctggagtgcagtggtgcgatctcggttcactgcaacctccgcctcctgggttcaagagattctcctgcttcagcctcttgagtagctgggattacagatgcctaccaccacgcccagctaatttttgtatttttagtagagacgaggtttcacaatgttggccaggctggtctcgaactcctgacctcaggtgatccacccacctcagcctcccaaagtgctgggattataggcgtgagccaccgcatccagcttgtaatgtccacttctttgtctccccagaaaagtccactgcctgggttcaaatcctcatcattccttatttataatgatgatatttaaagatgatatttggccgggcacagtggctcacgtctgtaatccctgcactttgggaggccgaggcgggcagatcaccaggtcaggtgatcgagatcatcctagctaacagggtgaaaccccgtctctactaaaaatacaaaaaattagtcaggcttggtggcatgcacctgtaatcccagctactcaggaggctgaggcaggagaatcacttgaacccgtaaggtggaggttgcagtgagccgagatcgcgccattgcactccagcctgggcgacagagcaagactctgtctcaaaaaaataaaaaataaataaataaataaataaataaataaataaataaataaagatgatattccactaaaaccacagtggcttttgggacacggggagctagcccactgacagataaaaatttccaagatgggccagactccgtggctcacacctgtaatcccagcactttgggaggctgaggtgggcagatcacgaggccaggagtttgagaccaccctggccaacatggtgaaaccctgtctctactaaagttacaaaaaattatctgggcgtggtggtgggcgcctgtaatctcagctacttgggaggctgaggcaggagaatcgcttgaatgtgggaggcagaggttgcagtgagctgagattgcaccagtgcactccagcctggaagacagagtgagactccatctcaaaaaaaaaaaaaattaattaaaaaaaaaattccaaaatggcctagcctaacctacagatgctttctcagaccttttgattctacaataagatgctgtctcaaaaacaaaaaaaattcatagcattttatcacatgtgaattatgtgaaatttcagtctccataaataaagctttggaacacagccactctcgcgcactctcacttatttacgtattgtctttggctgcttttattctttattttttgaaactcactctgtcgcccaggctggagtgcagtgatacaatctcggctcactgcaacctctgcctcctgggttcaagtgattctcttgcctcagcctcccaagtagctggtactacaggtgcaccccaccatgattggctaatttctgcatttttagtagagacagggtttcaccaggttggccaggctgttctcaaactcctgaccccaagtgatccacccgcctcggccttccaaagtgctgggattacaggcgtgagccactgcgcccggatctttggctgcttttatgcaacaatggcagagctgagcagctgcaatagagatagagatggtttggcctgtaagcctgaaacactgactctccggccctttacagaaatttgctgagccctggtctagatagtgctgcagagcgggtagggagctaggagacacaccggaaaactgatgagagggtttcaggacagaaggtagttcatagggctaaacgtggcatcaaagaccaaatgcatgaagactcaacgaggaagatcccctccaccaactcactaagaaataactacacaggagacaaaatttgtttaaaaaaacaacttcacattttgatggaatatggtcacttgttgagttgaaggcatggaggaaaagtgctgttctgaaacagttcgaactaaagagcccatcccatccccacataatgagcacttttttttttccttttttttttttttttttgagacggagtctcactctgtcacccaggctagagtgcaatggcacaatctcggctcactgcaagctccgcctcccgggttcacgccattctccttcctcagcctcccgagtagctgggactacagctgcccgccactgcgcccagctaattttttgtatttttagtagaaacggggtttcaccgtgttagccaggatggtcttgatcttctgacctcatgatctgcctgcctcggcctcccaaagtgctgggattacaggcgagtcaccatgcccagccataatgagcacttttaatgactagctcatcaattttttttaatatggaatttcgctctgtcacccaggctggagtgcagtggtgtggtctcggctcactgcaacctctgccttccgggttcaggtgattctcgtgcctcagtctcctgagtagctgggactataggcacatgccaccatgcctggctaatttttgtatttttaatagagacagcgtttcactgtgttggccaggctggtctcgaacttagctcatcattttattattttttagagacagggtctccctctgttgcccaggccagagtgcagtggcatgatcataactcactgcagcctcaaattcctgagctcaagcaattctcccaccttagcctccaaagtagctgggactagaggccaagctatttttaaaaattttttctagaggtggggtctcactatgttgtccagactggtctcaaactcctggcctcaggagattctcctgcctcagcctcccaaagcactgggattattggcatgagccaccatgccctggctctagctcatcattttgtactgacaccgcattcatcagagctgaagatgctgaacaacatttgtaactttaaaattctacaggtcacgtgtaatcccagcactttgggaggctgaggcgggcagatcacaaggtcaggagttggagaccagcctggccagcacagtgaaaccctgtctgtattaaaaaaataaaaaaattagccgggcatggtggtgcacacctgtaaccccagctactcgacaggctgaggcagaattgcttgaacctgggaggcggaggttgcagtgagccgagattgtgccactgcactccaggctgggtgactgagtgagactctatctcaaaaaaaaaaaaaaaaaaaaaaaatctgcagaaaaggcccatatgggcaaagtataagattattactaaattggtatagtgtacacttaaaattacatattcacaaaaagaggttaaagagaaatttaaatgcactgacatttttatttcttgcaacccgagttaaattcacgtttcatttcctacagaatgcaaaaaagacatccacaaggcaactccacttctaagttacaaattactagatgttagaaaactttctcgaaggacagtgcactattttttattttttgagacagagtcttgctctgtcgccttggctcactgcaagctccgcctcctgagttcacgccattcttctgcctcagtctcccgagtagttgggactacaggcgcccgccaccatgcccgactaattttttatatttttagtagagacggggtttcactgtgttagccaggatggtctcgatcttctgacctcgtgatccgcctgccttggccttccaaagtgctgagattacaggcgtgagccaccgtgaccagccagagagtgcactattttttttttttttttttttttgagacggagtcttgctctgttgcccaggctggagtgcaatggcgctgtctcggctcactgcaagctctgcctcccaggttcatgccattctcctgcctcagcctcctgagtagctgggactacaggcgcccaccaccacgcccagctaattttttgtgtgtttttagtagagatggggtttcaccgtgttagccaggatggtctcgatctcctgacctcgtgatccccccgccttggcctcccaaagcactgggattacaggcatgagccaccgcgcccagccactattttttaagttagtagcacacttaacatataaccaaccttaagttagaaaagtcattttttgaaggcacagtttgtttccagctcaactgtggaaatcaaaatctgtctgcagtaccaaatcccatcccacagtcagcccagccctggcaccattttgcttgtctccatgaaatgtgtctagtctagagggtagcatttttttgtcgatcccaatcatcatgtgaaaagtttctggagccatgttacgtcttccttcattctctgtgaaaatgcaagcaactcatttataaagtagcatcagcaaccaggccttcctgggcatgggagtggggaagaagtggcagaaaggaccagctcgctgtcctgtagcttacggacagtcccctcagcacaggacgtagaacgagagggtctgaacaagaacaggacaaaacgaggccctctaatatgtcagacgaagacaaatttccagaaaagtgaaggcaactccccttccatatacctggggttaagaaaaaaaaaaccaaaaaacagagaagggcgggtgactggcttcatcagtccagcaaaagacagggaatgtgcataaaataagatgttactgtgcttcaagtcagttgaatcactaatctcattaggcaagtggaagtctgctgagaatgtggcagtggcctttacatgtatttattttaaataattagcttaggtctgagctataatgactaatctccacgagtctatgcctgacggtgataaaaagttgacatacatggaaggtgttagaggaaagaaccagaaacaattacagtaagtggaaccgtgcacaaaagctgctctgcatcccgggttcatgcttttaagcagcctttttgctgaaagcctcacgaagtagttttgtttgggttgagtgttatgtttaaaatttcccttctaccagttattgagaaaataataatgccgagctcatctaataaacaaatgtctagttcgataagctttaatcaggccctcacaccctgggatggtcgttaatgacatggatcagaatccctgaggtggctggaatctaacaagtgggtagcacagaaagctcaccttgcctatggaggctgtggatatttttaggaaggtcatgcattatgggatgggaatttttataaacaaattgctacataaaaactaatgcactgttgcagcacttgtggaggtttcctttgctttgagacaccactgtttataggctgcagactgtaaagggaagtactgggaaatggcaaaggtcacatgggccagtgccatgttttaaggtcaaaggcactgttattttaagtgacctatctcattattaaaatcagtcactttcaccatcttcaaaatattttgtttttttaaaaagacaagggccttgtggctccaactattttgttggatgtaccaacataaataaatcagttttaattgatgcttctgcatgatttcttttgtaaaatgaaaggagaaaatgaactgggccagttaaaatggtatctgggctttttgcccccttagcaaaatccttctatacaaagtcagcgtcatttatagagtgccagtcctaaaaccaggtggcagagaaataagtgatgattcaagttaccttgcaagaagtgcagaagagtgggtgggaatgctagacaggtcaggagacccccggtaccaaataaacattttgccctactgaggcctgcctaatggtgattcccagaggggtggaggaagaccattgtgcagctgcatctgtgcaatactccattcccacaaactctattgggcgcccctgtcggtcagcctcgcagcctcgagccagtggaagacctgttgcaaatcacagatggagagttacagatgggagcacgtggggaagaggggctcacccaattccccacacatttccaggagtcgcagtgagcagtgctggtgtgaagccctcctactaatatacatgccaaggatggggggctggagggaagcggggacatctgccaacaaaagagcaagatggcacactctatttcccattctaacactgatcctttctgggaggatgaaagaatcacagataatgtgctcagagagtgtgtgtgtgtgtgtgtgtgtgtgtgtgtgtgtgtgtgtgtgtgaatgatgactcctaaacaaaggtgtgggaaggaccctcctccaccaaacgactggttcacaggcccccttaacactctgactcatggtaaggcttaggaatgagaaatagaggctcatggctgcaagactgaaattctgttcccatctttccatatgctcattaaaatgagaaatgcaactcttcttattccagcatggtaatcaaacgcccaagatatgcagggccaggctactgtgctcagacaaaaactctaataagcattttgctggaagaacttggtgaggtgttaaccctaggaaaatgtgggacaaacacttccttataacagcaaaaatgtcttaagacctactctattataacatttgcaaacacacattaatttacatactaaaatagtaaatgaaatttcttggaagttcaaaaaaagatctttcaaatcttttcatcacaatagagtggaaatccgtctgtcttcagagttgtcgaacttttctttctgtgctttttatgttgacatctaacttgtccactttggttgtcagccggtcaagaatgtcatcttgctcctcaatttctgtctgcatccccagggctatgtccttcagacgacccagtcccatggacagctcatctgcaggaggaggaaatgacacgcaggcatgagcaaacagtcacggcacctgcaaatgcttcttgatggtgtgggtaagtgggagagacagggatctgtgttgcctggggggactgcacccactgcagagatgagtcttgacttaattgattctgtcagggtgaagagtaaagccttttcccaggtttgtgactgtgtgtgtgtgtgtgtatgtgtgtgtgtgtttgtgcacgctgggggtagggagatatgcccagggctgctttctgcctttttactaggaacagcagccaggaaagagccagagaggagagagaagaggtggtgctttgtaagccttcttacttgcaagattaaatataaaacactaagagaaaaaggatcaggatacacaaaggcttagcactggtaccacaaatctaagcaaaatcagttttttgttttttttttttttgagacagcattttgctcttttgtccaggctggagtgcagtgccatgatctcggctcactgcaacctccgtctcctgggttcaagcaattcttctgcctcagcctcctgagtagctgggactacaggcacacgccaccacacccgactaattttttttgtatttttagtagagatagggtttcaccatattggccaggctggtctcgaactccttaccttgtgatccgcccgtcttggcctcccaaagtgctaggattacaggcgtgagccaccgcgcccggccaaaatcagtttttttaaaaaggtagttttggccgggtacaatggctcatgcctgtaatcccagcactttgagaggctgaggtgggtggatcgtatgaggtcgggattttgaggccagcttggccaacatggtgaaaccccatctctactaaaaaatataaaaattagccagatgtggtggtgcatgcctgtattccctgctactcgggaggctgaggcaagagaatcacttgaacctgagaggaggaggttgcagtaagctgagatcaatgcactgcactccaacctgggcgacagagcaagactccgtctcaaaaaatgaaataaaaagataggctgagtgtggtggctcatgcctgtaatcccagcactttgggaggccgaggtgggtggatcacttgaggtcaggagatcgagaccatcctggctaacatggtgaaaccccgtctctactaaaaatacaaaaattagctgggcatggtggtgcacaccttgtaatcccagctactcgggaggctgaggcatgagaatcacttgaacccagcaggcagaggctgcagtgagctgagattgtgccactgcactctagcctgggcgacagagtaaaactctcagaaagaaattaaaaaatataaaaataaaaagattgtcttcaagtcaggcacagtggctcatgcttgtaatcccagcactctgggaggctgaggtgggaggatcacttgagcccagaagttggagactagcctgggcaacaaagcgagactccatttctaaaaaagaaaagaaaagaaagagaaaaacagtataattaaaattaaaaaaaaaaaaaagataagtcttcagctctttgcttcttaagcttactaaaattcatggcctcgtgctccatggagagcagagcctgtggttgcctcaggcctcaggaggaagctcactggcagccagggcagcaaaggataagcaaacagagaggctgagataaaatgtgtgataatgtaaaaccaccaggccagggcgctggagtccagagagcttgcctgagatcctgaaatagcagggagatagtgttaagacgggaagagtgtgaacaaaggcaacactccctgccccaccagagtggaccggcctggcctgtgtcagcagggccagagggctgagctctgaactagccactcgcccttctgcccaggcccacctcctactctagactgcgtcctgccggtaactgcccagctgctcgtccacagtgccaactgtgcaccctcagcacctcctagtggcgggcagtactcagcacttcttcctgcctctgaatgcagtatccttcctcaaagtcccttctcccacttctgccagcaggcaccaaccataccactagccctaacctctccctttctcgcagtgaaggacaaagggctttcacgcctctctgggcttctctggagtggttagatctgggcagacacaccttctgcctcagataagtctttggctctggaggacagagtccagggcatagaaggaggtggcagctgtctggggcttcccagacagcaagcaggagaaaacccgtgcacagacactccatgtgcatcttcatgggtttcagttttgccttccactagatacctttacagcaggggaggattttattatttgtcccctacactttgccaactcctaacagggggtgggagactgacagggtgacccaggtcaccacgggggagatttctgctcagggagtagcggtaggaggaggcagcaagtctgagacactacttagaataaactcacagaactgcccacaggccaacacctacttgaatttcaagtaactgacttttccattcaaaaaataatcactggctagggcgcagtggctcacacctataatcccagcactttgggaggccgagacaggcgggtcacctgaggtcgggagttcgagaccagcctgaccaacaaggagaaacctcatctctactaaaaatacaaaattagctgagcatggtggtgcatgtctgtaattccagctactcgggaggccgaggcaggagaatcgcttgaacccaggaggcagcggttgcagtgagctgagattgcaccattgcactgcagcctgggcaacaaaagcaaaactctgtctcaaaacaaaacaaaacaaaacaaaacataatcactaagtgcttgcctgctgggccccagatacaaagtagtgacaaaatggaaacactcccatgctgtcctggaatctacagtctgattgggaagacagcaggcaaaccagcagatacacaatcacaaacggccagggcagccccctggaaacacaagggtcctgagagacagggagaggaggccatactaatgcaagactgacagaaagagaaggagccagcctacagagagtcgggggagcccatccaggcagataggggccacgaggcagaaagaactcacatcagaaatcccacacgagcctgcaggtgatgagggcagaagggactagggcagccaaagagagcctggactgcactgtgagtgtgtggggttccatgagagagttctggaagaatatacccttcacttcttctttttttttttttttaggtggagtttcgctcttgttgcccaggttggagtgcaatggtgcgatcttggctcactgcaacctctgcctcccgggttcaagtgattctcctgcctcagccacccgatagctgggattacaggcgcctgccaccacgcccggctaatttttgtatttttagtagagacagggtttcaccatgttggtcaggctggtcttgaactcctgacctcgggtgatccacccgccttggcctcccaaagtgctgggattgcaggcgtgagccactgcgcccggccccctgcacacccttccgttttgaaacatcatgctggaggctgtgtggccaaagtgccaattgcaacacgagcactaactcttaccatcccaggcactttctggctcaggtaacctttccactgttctcagaggtagcccatttcacaaggaggaaaacagggctctgagtggccaggtgggaaggatgaagtgagcggtcacgtccaggctatactttatggcctctcagggactcctgggtccctggtgctgttcatgaaagtgagaggtggggagggctcggctgggctagaagtaggaaatggtgagaagtggagagattccagagacagtgaggtggcaagatggacccagcttggcgtgggatgtgatgtgtggtgagggaactgaagctggaggatgctcatgcaggggctatgcttggcgtaagctgcctgaaggacagtggcttacagaagctggtgtggtgctcagtcttacctaggttgctgtcgatcttctggtgataggctcgaaggtgtgggttctttgggtaagcatcagtactcatggcagaaccagcccctctggggacagggtctaagtttagaaggaaacaccaggagagcggttaattgacattccttcaaatgctgcttcacacacccaaaacaatttcatctggaaaatgggtggaaggaacgaaggggttggttctgaggctatccagagggatgagggaggagcacagcgcaggctcatgggccagaagaagagacgcttccacggggtaggagagggttctcactttccctcagtacttgggagatcaaacaccctcaaattaagggtcacctaactcctggtgcacaagctcaggaaagacagagtcacacaagtgacaatacagaagtggaactgcaataatgcaaaactacacagtctgtggacaaagtataaaaatacaaattgttacgttacataaatggaattatgggtaatttcgtttctttctgaaatttatttctacactatctttgcacttgaaacaaatacgcaaaaaaaaaaaaaagaaatgttaaataatgcacatttgccacaagaaatcttccttgaacttttagtttcttcttttttaaaattatctttcttggcttgaatgaacttcagtttctaaacgcacacggaaaagccctgtcatcccggtttatctctttcagggaaacttcactttctagacttagcacatttcctccagcaccaaccaactgaaaccattctgcaaactgtgtcgattttttcttcagtcttttaagttaatatatactgcacaaataaaaactctctttaattccttaaaattgtgtcttgggtgcagtgtcctgtgccccttctccagggtgtgatgaggccggttttcccagcccttgcctttcaatttacactcacttcctccacttgcctttccagaatgaactgtgctgatgatgttagtctctcctgctccccgctcttcctccatctgggctctcctcagctgcatcaaccacaaccatggtgggttccagagcttccatggtgtatcgttttcttgaaggcagcacagtaagcctttggtttctagcaccaatttcaatgtacctggctattgtgggggcctatggaggaggccccaggagccctaaattcctttccagataagggatgtttctgggcctatcacttgatagaagtggaatgattcgatcaacactgtcttgcacaccttgtccatgtggctgctgctccttctgcttgggctggaggctgtattagtccctcactgatgctgtgacaaatgaccacaaacttgtcttacggttctggaggtcagaagtccaacatgggtctcactgggctgagtcggggtgtcctcagggttgcactccttctggagctcttgggaagaatctaattcctcgccttttgcagtttctacagttcacccgtgtaccttggcaggtgggcccctttctctatcttcaaggccagcagcatcttcagatctctgactctgctgctctctctcctgcttctctttccacttaaaagggacctttgtgatgacactggacccaactggacaacccaggataatctccccatcttgctgattagcaattgtaactccatctgcaactgtaattccacctttgccatataacctaacacactcacggggtctggggattaggacgtggacagctttgaggggccagtattctatttaccaaggggtttttctgcagttggctttttactgctggaacaattgagaatgacacaggcaggaaccaatgatgggcacgctcattttcttttttgagacagagtttcactcttgttgcccaggctatagtgcagtggcgtgatctcagctcactgcaacctccgcctcccagatacaagtgattctcctgtccaagcctcccaagtagcttggattagaggcatgtgccaccacatttggctaatttttttgtatttagtagagacagggtttcaccacgttattagtaaggctggtcacaaactcctgacctcaggtgattcacccagcttggcctcccaaagtgctgggattacaggcgtgtgttactgcaccaggctggccgggcaggctcattttcaatggaatgcaggccctcacttccttgttctcctctccatggagggagggagggagagaaggaggagccccaccataatgcacacccccagctccgcaagagcatgcggggtccctaaggccctttggctagcatgggtgatgccagcagctggggcccctgcccacctccccagagaggttgccactgccccccaaggaccaacgccaaacctagaggtctccccccagaattcaaatgtggctgtgcacacaggtatccacttacctgtatcatccagctttctaaggtttgggtggctggcctggtactttgcttcctgttctttacttgtacttatagcttctttcaatctttggataaaagttcacaaaaaagaaaacgtttaaaaaggaaaaacccctatgacaatgttatcagtcttttcacataatgcctgtgtgctaaaaatcaaatgcctcctctgtgccaaactccttctgaccaaagtagggatttcaacagcttctcccaggagcacagtgggccaagcagtaagcttatgaagacccctgcctcagaagtgtggcagctaagccaggtgtggtgactcatgcctgtaatcccagcattttgggaaactgaggtgggagaattgcctgagcccacgagtgtgagatctgggaaacataatgagaccttgtctttactgaaaaaaaagaaaaaaaaagcagtgtagcatcgagttaggtggccctctctcagggaaacctggattcctaggaccaggcagatgaaaagcacatggaacaaccaaaccggtactttagactacagtcagcaaacaatgacctgctgatcacatctggctcacctcctgtttttgtactgtttccccgttctttttttttttttttgagatggagtcttgctttgtcacccaggctggagtgcagtggcgtgatcttggctcactgcaacctctgcctctcgggttcaagtgattctcccgccttagtctcccgagtagctgggatattacagttataggcaggtgccaccatccccagctaatttctgtattttcagtagagatggggtttcaccatgttggccaggctggtctctaactcctgatctcaagtgatccacccacctcggcctcccaaagtgttgggattacagacatgagccactgcgcctggccccaagttatttttattatggtaaaatacacaaaacaaaatttcacctgtttttatatgaccatgagcaaagaatggccttagagatgaccatgtgcacctcagatgacaaacttagaacctcaagagtttcattcctctcattagtgcacttatattaccagaatactgtactcaactattactgtttttgttgttgttgtttgagatagggtctctctctgtcaccaagtttggagtatagtggtgcaaacactgaagtctctaactcctaggctcgtgatcctcccacctcagcctcctgggtaactgagaccacaggcactcaccaccctgcctggcttttttttttttttttttttttttaaattttttcagacagagtctcgctctgtcacctaggctggagtgcagtggcgcaatcttggctcactgcagcctctgcctcccgggttcaagtgattctcctgcctcaggctcctgagtagctgggattacaggcccccaccacacctggctattttttgtatttttagtagagacagagtttcaccatgttgggcaggctggtcacgaactcctgacctcaggtgatccgcccgccttagcctcccaaagttctgggattacaggcataagccaccatgcttggccaattcttaaattgttttttctttttgagacagagtcttgctctgttgcccaggctggagtgcagtggcgtgatctcgatttactgcaacctccatctcccgggttcaagctattcttctgcctcagcctcctgagtagctgggattacaggtgcctactcaagtgatccccctgcctcagcctccaaaagtgccaggattacagccatgcaggcatgagccactgtgtccagcctattactttttttttttttttttgagatggagtctcactctgttgcccaggctggagtgcagtggcacgatctcggctcactgcaacctctgctgaccaggtttacaccattctcctgtctcagcctcctgagtagctgggactacaggcgcccactaccacgcccggctaattttttgtatttttagtggagacggggtttcaccgtgttagccggaatggtctcgatctcctgacctcgtgatccgcccaccttggcctcccaaagtgctgggattacaggcgtgagccactgcacccggccactgtttttatattttaaattttgtcactaaaaagttgtgaaagtatgtttttttctcatcacgtaagtccctataaaatatctttgattttgctccgtggcctagtttgctgactctggctgtagacagggatagctcttgcaactcaaagtcatttagactatgcctgatgccctgctgatccccgacatcctgctgagccccctaaggtatggcaggtgcctccagctgggagctgtgcctccccaacagcctgctctcctctatctcaacagcagcctgaccacttcgccagccaatctgggaatcagggttactcgcaatttttgccctccccctgcacagcgctactcccagtaatccaggcaaaacaaacgccctcttgatctcccaccccctaagtagcccagaaacccagcctctccttctgccttgccttttttttttgagacatagtctcgctctgtcacccaggctggagtgcagtggcgtgatctccacgcactgcaagctccgcctcctgggttcacgccattctcctgcctcagcctcccaagtagctgggactacaggcgcccgccaccacgcccggctaattttttgtatttttagtacagggtttttgtattttattttgtattttgtattttagagacagggtttcactgtgttagccaggatggtctcgatctcctgacctcatgatctgcccgcctcggcctcccaaagtgctgggattacaggcttgagccaccgtgcccggcctgccttgcttttctttacctttaacaaggattatggcaatgcctctcaattcaattccctcccttccaatccttactccccatgggtgctgcgcatctttctaaagcaatactggcaagcacctcttcagttaaagtctttaatgactcccaacttgcaagagcaagtccagactcccgcaagctaagggttttgcaggcccagggctccagctatgggtagaatgcagcagagcctggtgaatggaaggatttaacactccaggatttcaccccacggaagctgtgactgaaagtctagaacacagaactggctcctctaagcaccactgtgggcagtgcattgccatgctgggagtaggaagagacacttggcttctgagtctgcctggccacctttcagcctgcacatctcaacgctggctttattctttctatgtgccatcacatatatactggtaatacataaatgaggaaaacaatggtttctttgtgaaaaatggctcccccacaaagaaagccaatttttttctttttctttttttgagacggagtctagctctgtctcccaggctggagtgcaggggcatgacctcggctcactgcaacctccacctccctggttcaagagattctcctgcttcagcctcctgagtagctgggattataggtgagcgccactacgcccggctaatttttttttttagagggagttctgctcttgttgcccaggctggggtacaatggtgcgatcttggcttactgcaacctctgcctccctggttcaagcgattctcctgcctcagcctcccaagtagctgagattacaggtgtgtgccaccttgcttggctcattttgtatttttagtagagacagggtttctccatgttggtgaggctggtctcgaactcctgacctcaggtgatccaccctccttggcctcccaaagtgctgggattacaggcgtgagccaccgtgccaggcctgatttttgtatttttagtagagacagggtttcatcatgttggctaggctggtcttgaacacctgactttgtgatccgcccacctcaacctccaaagtgctgggattataggcgtgagccaccacgctcagccaagaaagccaatttctagggagactgagaaaagtgataagacagtagaggtttaagagagggtggttcctggtcagaaaccaagtcttaaataagttagagaatttcaaattaagggtgcatatgtgacaggaacgcatgagctgtaagtggaaatgagaacaagcagcttggaaagctgtcagcaaggacaaacagggcttcccaagagacaaaacttcagagaaggccgaagggtttgtgtgataatgatgtacacaggaaatgcatgactgaacagaagtttgataggagaaacttattttaaaagcttttgaggccgaggcgggcagatcactaggtcaggagatcgagaccatcctggctaacatggtgaaaccccatctctactaaaaatacaaaaaaaatttagccgggcgtggtggcgggtgcctgtagtcccagctgcttgggaagctgaggcaggagaatggcgtgaacgtgggagacggagcttgcagtgagccgagatcacgccactgcactccagcctgggtgacagagcgagattccatctcaaaaaaaaaaaaaaaaagcttttaagtgggccaggcacagtggctcatgcctgcaatcctagcactttgggaggctgaggcgggaagatcagttgagcccaggtggttgagatcagcctgggagacaaagtgagaccttgtttctacaaaaaatacgaaaattagcagtgcatggtggcccatgcatgtagtcccagctacttgggaggcagaggtgggagggttgctggatcctgggaggtggaggatacagtgagcagagactgcaccactgcactccagcctgggcgacagagcgagacattgtcttaaaaaaaaaaaaaaaaaaaaggcaaagtttttaagtgacagtattcctgcatttatggattaaaggttttgacaggatcacaaaaattttactcacaatttattgcattttttttttttgagatggagtctctgtcgcccaggctggactgcagtggcttgatcttggctcactgcaacctccacctcccgggttcatgccattctcctgcctcagcctcccaagcagctgggactacaggtgcccaccatcacccctggctaattttttgtatttttagtagagacggggtttcaccgtgttagctaggatggtctcgatctcctgacctcgtgatccgcccaccttagcctcccaaaagtgctgggattacaggcgtgagccactgcacccagccgcccccccatttttttttttggtcgtccatgtaaatatgactacaggcctgtatcaccatgcccagctttaaaaattttttatgtttgtagagacagaatcttgctatgttgcccaggctgatcttcaactcctggccccaagtgattgtcctgccttggccttataaaatgttgggataacaggcatgagccactgtgtctggccctgctgggcccttgaaatggccaacaacttccttcatcccggcttcccctgtgcttttactgccatgtgcctgcaccaacccctccttcaattggtgggttccctcaaaaccttcaccttctgcaaaaagtcaggtcctttgtgcagccttcctctgttcccagggccaacctccctctcctctgggtccccactgcatccctgtggactgtctgcctcccccatatcttccaacagacagactgcattcctgcagcttctgctcccacagaactgcagagtgtgggtgaaagttttgctttcttgaatttactaagagatggcaagaatgctacaactgattggggctaatctaggggcaggccaggcagggtacatgactttggggaccttgacgggaacgcatcagctttaagtggaaatgagaacaagcagcttggaaagctgtcagcaaggacaaacaggacttcccaagagacaaagcccacctcactgaaataactatggctgcctcactgatggaagcctttgctgggaagcccctgagttttcatgatgctccaaaaaaagaaaactgcccctggagccacaggacttccatggctttcatagctatgttcagggatgcaggggcctccaagagccccagaagcagcctttgtgaagaggtatgtaggatgtggaagggtgtgaaagggtgctagtcacaaacttgccagcttcccactcctccaagggctcactctgctcctgagtttgtacatggaggatgtcttagaccaaaacaaatgaacatcctaccttctcctatggcaattaaatgtggccaaagattaggatataaaacatctttctgatatgtatattgaaaaaaaaacaacaaaaaacaagcaacgactagaactggagggaaatggcggatgtttaaaattagggttgagctggagaacccagaatggtgattatggctgagccaaaaaaaccaaccaaccctcataaccttagctagtgcctccccagggcactcactgaggccggcaggttcccagggccaactctgcaggtccctcctgcagtactttttttttttttttttttgagatagggtctcactctgtcacccaggctggagtagactggtacaatcatagctcattgtaggctcaacctccctgggttcaggtgatcctcccacctaagccaaaaggtcgggtccacctcagccacctcagtagctgggaccacaagcacgtaccaccatgtccggctaattttcgtgtgtgtgtgtgtgtgtgtgtgtgtgtgtgtgtgtgtgtgtgtgtggctaattttcgtgtgtgtgtgtgtgtgtgtgtctgtgtgtgtctgtgtgtgtcagagtcttgctctgtcgcccaggctggagtgcagtggcgtgatctcagctcactgttgcagtggcgtgatctcagctcactgtaagctccgcctcctgggttcacgccatacacatttctcaccctcccgagtagctgggaccacaggcgcccgccaccacacccggataatattttgtatttttagtagagacggggtttcaccgtgttagccaggatggtctcaatctcctgacctcgtgctccgttggccttggcctcccaaagtgctgggattacaggcgtgactcaccatgcccggcctttttttttttttttttttttttttttttgagacagagtctcactgttacccaggctgaggtgcagtggtgcaatctccgctcactacaacctctgcctcccaggcttaagggattctcctcctcagcctcccaagtagctggggctacaggcaggcaccaccatgcctggctgatttttgtatttttaggagacactgggtttcaccatgttggctggcctggtctcacactcctgacctcaaacgatgcacccgcctcggcctcccaaagtgctgggattacaggcctgaaccaccatgcccaacttcatttttgtgtttttctgtagagacggggttttgtcatgttgctcaggctgggatcaagtgatcctcctgcctcagtctcccaaattgctgggattacaggcatgagccaccatgcctgaacctctccataactcttgatggcttcgcctgcctgttctttctgccatcaccaccagctttgttacctacactggtttctccccagccccactctgagtttgaagtagttatctaatttcctccctgccacaccctacatcttgatctgggtggtggccacactagtgtacacaggttcacagtcactggctctccacttaagatgcacatattttactgtaccttagtgatgcattaaaaaaaacggctctgcagttaggtgtggtggctcatgcctgtaatcctagcactttgggaggccgaggtgggaggactgcttgaggccaggagttcaagaccaacctggccaacacagcaagacctcatctcttaaaaaataaataaataaaatgaaaaagaaaagctccacattacagaattaaaacaaagagagaggccaggtgtggtggctcacgcccataatcctagcactttggaaggctgaggcgggcggatcatctgagatcaagagttcgagactatcctggccaacatggagaaaccccatctctcctaaaaatacaaaaattaaccaggcatggtgacacatgcctgtaatcccagctactcaggaggctgaggcaagagaattgcttgaacctgggagacagaggtttcagtgagctgagatggtgccactgcactccagcctgggcaacagagtgagactctgtctcaaaaaaaaaaaaaaaaaaaaaaaaaaagcctggcgtggtggctcggcactctaggaggctgaggcaggtggatcacctgaggtcaggagtttgagaccagactggccaacatggtgaaaccccatctctactaaaaatacaaaaattaggccggatgtggtggctcacgcctgtaatcccagcactttggaaggcggaggcggatggatcacgaagtcaggaggtcgagaccatcctggctaacacggtgaaaccccgtctctactaaaaatacaaaaaattagccaggcatggtggcaggcgcctgtagtcccagctactcgggaggctgaggcaggagaacggcatgaacccgggaggcggagcttgcagtgagccgagatcgcaccactgcactccagcctgggtgacagagtgagactccgtctcaaaaaaaaagaattagccaggcatggtgtgggcacctgtgatcccagctacttgggaggctgaggcaggagaatcgctttaacctggaaggcagaggttgcagtgagctgagatcacgtctttgcactccagcctgggcaacaagggtgaaactccatctcaaaaaaaataaataaataaaataaaaaataaataaataaaagagagagagagagatggttatggaacctgagttatcacataatatcaagcagtttttctgggttaaatggaagaaaaaggctatcaaaccaaaagaatactatggttacaactatgaaaatactgaataaggggaaaatgaaattttctgtttttgtgttgcggtaggtaaagtatagattgtctgtaatgtggccatgttgtttttgtaataaaaacagacacagtgatctgaaatacaaacaatagtaatctacttcagcagaaactccattcctttatccttgaacatgtaacactgaagtctaccaaaatctcatgaatttttttttttttgagacggagtcttgctctgtcgcccaggctgcagtgcagtggcatgatctcagctcactgcaagctccacctcccgggttcacaccattctcctgcctcagcctcccgagtagctgggactacgggcgcccgccatcacgcccagctaattttttgtatttttaatagagacagggtttcaccatgttagccaggatggtcttgatttcctgacttggtgatccacccgcctcggcctccccaagtgctaggattataggcgtgagccaccgtgcctggcccccagtctcatgtatgattttatatttcgagccaaaacctgaggaaagcaacttctaactttatttttttgattttaattatttagctttaaatctttttttttttttttttttttttagagacagggagactctgtcactgatgctgtagtgcagtggcaccatcatagcttaactctagtctctaacacctgggctaaagcaatccttccacctcagtctcccctgtagctaggaatataggcacgtgccatcatgtctggctaatttttttttttttttagtttttatagagacgggtctttgctatgttgtctaggctggtctcaaacaatcctcctaccttagcctctgaaagcatgggattttacagataagccactgagcccagccttataattttcaaataaaaatcaatgggcgaattggattagatatgacaaatttagacataaagacttttttttttttttttcttgagacagggcctccctctgtagcccaggttggagtgcaccattacagctcactgcagccttgatctccaggcctcatgagatcctcttacctcagcctcctgaggagctgggactacaggtgtgcaccacaatgcctgggtaatttttgtaaagactgggttcccactatgttgcccaggctggtctcgagctcctgggcttaagcaatctacccaccttggcatcctgaagtgtcgggattacaggtgtgagccactgcacccagccctaaagattttttaaagcaaaaattatgtgaagtgagtcacatttgtacagattacgctgaggtgaacaccctctctttcaaagtagtggggtcacaattattggagaagctattgacagactagatgtcaatcaagtgaacatgggatcagggaagaacagttcctggtttcacaatgtttgaggacaaatatcccctgatgagtaacttaaagggttgttggatcccttcatggcactgacgtggactgaaagtcttggtcatttgcactaatccccacttctgctcctttatacccagatggtagaagatgcactcacctgttgttgggctgggaggtgagggtgccattctgttcaggtggggtctctactggtttggatttgaagtaattgaccagccccccaaacacgctcttaatgctattgatgtgtttctggctgatcttcaaatcttggtccatcttgtccaccatcttctctgtgcgctccaggactcctcgctgacgggcgagctcctggggaaaccgagaggcagtggcattatagctttctgtgactctcccccagggcagtcaaggaccacatggagcagccccttcataaactctcagtgggcacatctggagacgggtactgtcatctgtgaggggcacactaccctttccaacaacacattcctttgcctctccctccctgccctacctctacttgctttcctcatttgttcatgagacccttttcctgagaggctggctcatggcgccatgttaagatggatggcagagggtggcgcagtgattcacacccgtaatcccagcattttgggaggctgaggcgggcagatcatgaggtcaggagttcaagaccagcctggccaacatggtgaaaccccctctctactaaaaatacaaaaagtagccaggtgttgtggcgggcacctgtaatcccagctactcggggggctgaggcaggagaattgcttcaaccctgaaggcagaggttgcagtgagccaagatggtgccaatgtactccagcctgggcgacagagcaagactccgtctcggttgggggtgaggggagatggatggcaatgtgcctgtgaggttcagagtctatggcctgaactggaagcagattctctctagccctccaactctgggaaccctcacaggttgggcctggcactgccccctggactttggttcttatattcttcctttaggaagttcccatttaaggagttcccactgggccacctgagcctcctggccatggtcaaatcctcaaattctatttcaaggaccagtgtcccctctgggccctattagtgtctgactctagcccatccacaattccagctttaaaacctgttaacacgggtgaccctgtcccagggcctttgcacacaccactgtctccgcctgtaatgttttccatccagatacttacatggctcagcctctcatccctcatccaattagggtctcctttcaaaggccactctctcagagaggccttcccagacatcttccctaaaggagaattccttcttccaaccactacccctcttctccacctccttttctgttttgagatggagtcttgctctgtcacccaggctggagtgcagtggcgtgatattagctcactgcaacttctgcctcctgtgttcaagcgattctcctgcctcagtctcctgagtagctgggattccaggcgcctgccaccatgcctggctagttttttgtatttttggtagagacggggtttcaccatgttggcccggctggtctcgaaccacccgcctcggcctcccaaagtgctgggattacaggcatgagccaccgctcacagcatatgagctccacgaggcagggacttgctctgttcactgctgagtctctgcaaatctgcccaatggagacgtgagtgatgctctgtggccacagtggcagcctgatggtccctccagagctgatggttctggttgtggatatacattcacaacatcaacactaccactttcctttatttacgacaaacttgcttcagtccctagttcagaactgatctacagctgcggcccatctgtgagctgcctttccagccagaaggctctcgagcttcatttttcctgctctgtcaggcagcctctgccctcagctgccttcctctgaatctatccacccatcaccctgtggcttagcaattacactaactatgcaaatgttttttagatatattctctcttgatgcctaaaaacaaagtcaaaaaaaattttaaacatcctggaaacctgaagagcaaaatgcaactataaataaatggttgtggcttccttaaagtccttaaggaatcaatgtgtaacctgagtccttgtttaatgggtgaaatttaaaaacataatgtataggcaaaaagctaaaacactggttggttgaatttactattaaactttgtttaactcttgctggaaataaacttagaactgctgaattttacagctttcaacgtttatgtttttcactagttcacaagagatgtctgaacaaaccatcagccttttttaagtaaaaaaaagatgttttctggatagtgtcactcagtatgtcaagcaaatcttgcaagggctagttttcaaaagaaaaaagagctgctaatgtatctggcatttctgctccttccatcacctcaagtttatcatcttcatgtccacactgcggtcttctctggaataaggcagagctatacgttaggattaacagattttctccagcatctacatgtttttctgacagtccagttccagctagctttgcaggctgcagaagaagctttccagtagctggaaagacactcagagcagccaggttggggactggggaatgaagaggtggccaagactctgctgtcacattaggagggaggtcctcagcttccctgatggtgagctcctcccatcagggccaacccacgaccactcaccctcccaccctgacctcctcatctcaatttggagagctaccttccccagtatggacttattttctcttattcacaagagacacattctctcaaactcccagagtctgtgctactgttaaggaaaccagatggctgatttagatgtttagatgggagcacagagaagtctgtgagggtggcttatcttgcctgtgaggctggaaggccaggcgactgagtgctgctctggcctctggaagtttctgtttgctgaaagctagtgttcaccagaggtcatgaggccagcaagggaggagttgtttcttctgctaaaatccacccccagaaggcagaggaaatgaccggacttaatgtgcttgtgacctagttccaaccaatgaggaagaagggtttgacagagcaaacaccaaaataccaggaaagagaacactgacagtctgtaaggacaggccaggcagacacctgtgccccagccaccaccaagacaggcctcaaccgctccaggtaccgaggcaggtccacacccccctccgcagagccacggcccatcttctccaacttcccgtgggagaatgaggtccctgaacggacttgggtggctgctaggggagtgagctccgcaggtgccctcagtgtaaaggacgcacatgcaaagtgcttccttgtttcagtgattactaagcattacaggtgatgcccttcttactcccttgaaccccaacaagagttctctctttgtccacgaaacaatcccaagtctctgtcctgatggtgtttacagtctaacagagagcaagatgagtgaggttcaatctcagcttttcatttgttgacaacattgcaatgctcggaatccaagaaaggcagatgagtccttgcttcactgagcttacagtcctgtgggggaggcagaaactaaagctactgcacgcgtgcacacaaacacatacacacacagagtcacctctccctgcagactctttgtttagcttaaggtgggggtcagagaggctccctgttgaggctggaggagagactgagaagttaggcagtcagaaagttgggggtcctgtccatttggacttagttttcctaaaaacaaatcacaacgaagagttggggtggggcaagggcaccaggcagagggtgcagcttgtgcaggggcagaggaaccgtgtggggagtgagcggggctacccacaggactcggcagggaacacccacaggatgtcactaaggccttcaaagggcagcagtgaccaacagatctcaactgcaactcgcagccaacacatcttataacatcaggtgggcttccgtgaccgagacctccccaggttcctgacggaagggcatcaatactgtgtttctcatactgagctcgtaaactcaggttctgataaatgaggttcatcataagtagacggaggccaatctggagtcagtgagctgaatctagaaatctgaaatttatctttgttccatctctcccttcccaagggagtgtgcacaggcacaagccttggcagggatacgtgagcacccatggcagatgctcaaacccggggctctgactgtggcagctggagtatggggtggattcagagacaaatcgggtcttagggtgcaggaaaaaccaccaagggcaaaggcggtagtgctggtgcccctcgccgtctgtgtgcaggccaacctggggctgagcaaaaggctagctcagcagctctgggttgtccatacactccacattccaaagagaggtgtggccctagcctggttccttgtttttggaatatcctgcctgataagagtgtccttgctcaagtgagcctaagcttagaccaggtcagacagactatgctaacaatgtgatatatgatggtggccttgggctacacgttatcagcttgacctctggtggggttggagactatactcagccatgcctatgtgacagactccccaaaaaactctggacacccaggcttaagtgagggtccttggttgacaatactctgtgtgtgttgtcacgcactgcttggagaagtgttgtccacatgactccatggggagaggacaactggaagcttgtgcctggtttcccctggacgctgccctatgcacttttttcatttgatggttttaatcagcatcttttcattgtaagaaaccatcaccatacgtgtaacagttctgtgcatccttccagtgaatcagtgaagttgagggtagtcttgggaacccccaaacacctccctacaacacttcccactctaagaacacctcagaggcagaaagctgtatagcagatggccgctcagcttgtcacagcatgtttcctggtcagcaaagcaaggttccttgggacaatgtggcagctgtgagtggatgtgcccaggaaggagaagccagaagctcgaacaaccagcccatcctcagaaggcatcctgttacagccaacaagccagcaaattggcctgggatcaatggtctaattcttttttttttttgagacagggtctcactttgtcacccaggctggaatacagtggcatgacctcagctcactgcagccttgacctccctggttcaagagatcctcctacctcagccttctgagtagctggaactacaggcatgcaccgccatgcccaggtaatttttgtattttttgtagagccagggttttaccacattccccaggctgatcttgaactcctgggttcaagggatccacctgcctcagcctccccaagtgctaggattacaggtgtgagccaccacacctggccatcaatggtcaaattcaatcattgatagtttaccaaaaattaattaaaaataaatcccgaacagacctagcggtgagtatgtggtccaatgccatttctccaccagactccctcccacctgctagacacagcctgacatgtgttgggatgcattttctggtcacaggacaggcattgcaaccaaggcacacagctcaatgcattctttccacccaactctctcctcctttttcaggcaatcttctgttccctccctccttcctttccttccccaggtcacttattcatttggcaactattttgggagcgccaataacgcttaaggacattgtgctgagaagcgtgggggtagaaagttgagcaagagatgggtaagagactgctcctcttccactgctgacatttacaaatttgaggaattacttaatctagcagctgcttgtccccatccatcaacttttgctaagaactctggctgcatcagtatcaccacacgctgcctcagaggggtgactttggtctgtacggcccctcatttggagtgggctgctccaagaccagaatccctgagaatgaggatatcaccttttggcaatgtatctactctaagttccggggacaccttgatggcctctgctcctgggccaggaggggtgtcctcctctctcccacctctgaatggaatgcccagtgtgggtgactgttgtgtgctggaaagacacagagatgggtgggcccctgcacgagacggtgtggaggatgtgctggcggtggctgctgagtgcatcacgtttgaactctcaaactctgtccctttccattgatgttactgtgccagccgttccaaccctggtctaatgtttgttgctggactcccctgaaccgagatctcgggccccagaaaacctcagtggagttaagttcagctacaagaggggaagcagagtgtcctgggcaggtgagtctcctccactggagtgatgaaaaggtgtacaaaaaccatgtccaagtaggatgcaaatagactcaccaaaaggtgtaaacaacctcaatgctcatcattaggggacaggctgcataaatagaagtcatttgttcaatggaatacaacacagccaaaaagaaagcccagctcattacatactagtgtggaacaaactccattctattaagcacatgcagaccagaatgtatacaatacttcacttaaaaaaaaaaacccatttttatccacggcattatctccccaaaacactgaaggagggaaagtgcctggctgccttaggggcagagggatgatagggagggaagtgggagaagactacacccttttgtatgttttgaaattttgaaccatgtgattggaatctctcttcataaaaattaaaccttaggaaaaaaaaaagaagaaatcatgcttactaaacagggaaagagacgagtggcttacaagtctccctgtagttctacaaagcgcctaccaggtcggcctggggaaaccgccctgctcccactacttctcctctgttcttttgtggtcatagcctgtggcctgagcctttgtgagaaacaatccttgccaggtttcacagtaggagaagggcagctctctttgctagaggtgacttaactaagccattttcctgccaagctgggactgaattataatcttcccaacctaatataatttgtaaagtcctcatctttgacataaatctgtcatgtgttggcatgtttcacagtgctggggtaaccaggcacctaagttgggtgattagcagggtatgctggaatttgctggaagccacactgtgcactgagggttggaagagctcatactcctctgttcccatcccaacaccaaagggaatgaaagagtgattagagtgattcaaagacagcttggagcctgtaatccagcactgggaggccaaggtgtgcagatcatctgagctcaggaattcgagactagcctgggtaacatggcgaaagcccatctccaccaaaaataccaaaaattagtcgagtgtggtggcgtgcacctgtagtcttggctacttgggaggctgtggcaggaggatcacttgcacctggaggcagaggctgcagtgagccaagattgcaccacggcactctagcctggttgacagagtgagacccccatctcaaaaaacctcccccaaaacaaaacacaaaaacaaagacagcttggagaacactgggtgtggtggagatgtaggtcatccctgactcccagggcttctcataattgagaactgacccaatcctggaaaattccaacatgttgtctcactgacaagagcacctgtcacctgcccagtcatgaccacactgtacttctcacagcaatgcctggcctggccaagcctgatatgcctgaagtgccactctgcctcagctctcactgtccccactgcatagaaagacctttgggggcagcacggggcatgtcatcacaatctatatcaaactcaccactattacatttttgcctctcctgcgctatgagaccagaactttccctatgacctccaagggctcctaagctacctcctccatcccctgtcctctaacacacccagtctatcatgtccctcctctggacccaggagctctgttgctgggccagtgcatttgcatattttcctgtcttccctaagaacatccctcattctcactcctcttgtgtaaacctcagccttaaaagctagattcaagtttatcctctgccacaatgccctactttgaatcattgattccctacttcatttgttctcagtttacaaagatgtctccttaaatagttgttagttgaattccttgggcttgagatcctcaatcatgtgacccattcaccagggccctaaaacctcaggcaatcctctcaaatctaagccaagacttcccatttagaatggaacataggaatccagtaggtatgagatgtaagaactacaggcaaaacctccctaacaaggttaggaccgggcgcagtggctcacatctgtaatcccagcactttgggaggctgaggtgggcagatcacctaaggtcaggcgtttgagaccagcctgcccaacatggcgaaacctgtctctactaaaaatacaaaaatcagaggccaggtgtggtcgctcacgcctgtaatcccaacactttgggaggccaaggcaggtggatcatgaggtcaggagttcaagaccagccggaccaacacagtgaaaccccgtctctactaaaaatacaaaaattagctgggcatggcggcgggtgcctgtaagcccagctactcaggaggttgaggcaggagaatcgcttgacctgggaggcagaggtagcagtgagctgagatcgcgccactgaactctagcctgggagacagagcaagactccgtctcaaaaacaaaaaacaccaaaaaaacaaaaacaaaaacaaaaacaaaaaaattagccaggtgttgtagcaggtgcctctaatcccagctacttgggaggttgaggcaggagaatcatttgaactggggaggtggaggttgcagtgagccgagatcacaccatcgcactccagcctgggtgacagagtaagactttgtctcaaacaaaacaaaaataaaaaaccaacagttaaacacagggaggtgggctaggtgcagtggctcacgcctataatcccaggactttgggaggccgaggtggtggatcacgaggtcaagagatcgagaccatcctggccaacatggcaaaaccccaactctattaataccaaaattagctgggtgtggtagtgcacgccttagtcccagctactcaggaggctgaggcaggagaatcacttgaacccaggaggcggaggctgtagtgagccaagttggtgccactgcactccagtctggtgacagagcgagaatctgtctcaaaaaaaaaaaaaaaaaaccacagggaggtggatcaatgagggatacatgaacagagagaggtggggaagggaattaacccaagaaaacagcaaggggaaatgatagcgtgttgctctgtcgcccaagctggagtgcagtggtatgaacatggctcactgcaaccttgacatcctgggctcaagcggtcctcctgcctcagcctcctcagtagctgcactcacatgtgtgtgccaccatgcctggctaatttttcaaattttgtagagacgcagttacccctgctggtctcaaactcctgggctaaaatgatctgcctacctcagccttacaaattgttgggattacagaagtacaaccgcgcctggcttatacatttttttaaacctttttttttctctgtccaaacaaaactgtttcattagcaggctgaagagagactgtggtgtacaataaagaatcattctcgaccggtatggtggctcacgcctgtaatcccagccctttgggaggccaaagcgggcggactgcctgaggtcaggagttccagaccagcctggccaacggggcaaaaccctgtctccactacaaatacaaaaaaaattagccgggtgtggcggcgcacctgtagtcccagctactcgggaggctgaggcaggagaatcgtctgaatcccggaggcggaagttgcagtgagcccagatcatgccactgtacccaagcaagggcgacagagcgagattccatctcaaaaaaaaaaaaaaaagaaaaagaaaaagaccctccaggatctcggtctgttgcccatgctggagtgcagcagcacgatctcagctaactgcaacctctgcctcccgggtacaagcgattctcctacctcagcctcctgagtagctgcgactacaggcgcaccgccacacccggctagtttttttttttttttaattttagtggagacagggtttcaccatgttgcccaggcgggtctcgaactcctgagctcaggcgatccgacgcctaggcctcccaaagtgctgggattacaggcgtgagtcactgcgctcggccagaataattgttattgaaggtactactctctgaaatctaaggatgggaagaactgatgaagatgagttggagcaacaaactcttaacccgcacactatttgtctaggatttgggaagtaaaggtaagaccctggactcaatcaaacccaggctttggtcaactaggcagctgtctgggctgaagggacttcaatacctctattggttggttaggtggagatgtcaatgatgcgggaagaactcgtggaccacctgccctgatgcttcagggtatcacctgacactcgcaggcacatagtcctctctttctggctcactccggaaggaatggccaaaaccctgtgccagattttgcacaggaaataatgtcgaagaaacggactctccatttcccaaacctaggacctgctgttcagaatttttactcacctggacagaaaataatctggcgtttccccgtgagctaggcgtaagaaaaaaaaaatcaacgaagcagactaatagctaaggaagatttctggggtaaactgccctcttcaagtactccagatgcacatacctttacatagttaacagattgttaccaccatcgagtcactaaggtgcaagaatctatgctaggcaacttgagaattctcaaaagattgtgagcaaaacatttctcgtctccgtttgacagcacagagaccggcgagtccacaccagccctgccccaggctcacctcggaagaggcgaccccaaccttctcggactcgtacatgagggccagggacctgctggtgctggcggccgtggcctcagccctgcggaggacctcctgccgcaagtactgctgcctgtccgcgggcgcgtcgggcccgtcggggaggtctcgggcgtccctccaaggggccggccgggcgccttcgtcctccccgtcgtcgtcgaacggattgtagcttttagggtaagctgacatggtgccggcgcggctctcggtctgggaaacagaaggaggagccccactgccgccgccgtccagggcctcgccccgcccgccgaccccgcggtcgtcgcgcgaactccttccgcgcgtcgcgcgcaggtggccccgccctcggagccgaccatcgcgcaggtcggctggggggggcccacatccggcgcgcgcaaccgcagcctactgtccatcccctctctcccctgcagcggtgggcccgccccgcagccacgccctatctagtgtcagcaactgagaggtcacgtggcgggaaagccggatgcacctacgcctgcgccctgaggtcgggcgctcgcgggccaggagcggggagccggcgggcagcgccgcggctcgtgaggtgatggcggcggccccggcccggggaggcggaggcggaggcggaggcggcggcggctgctccggctccggctccagcgcctcgcggggcttctatttcaacacggtcctgtcactggcccgctccctggcggtgcagagaccagcatccttggagaaggtaacgtcggcgggctgggccgcgggctgacaggaggaggggctggggtgacgaagcgtggaggcgggacgagggtctgtgggaggccgaggctgggctcgccggcagcctgtgcgggagggggcgcctgagcggagggatctagcgggggaaggaggccctagtgggaggggctggtgaagagagagggaccgtgggggaagggtcggcggggcctgcagggccgctgcaggtgggtggttgtgggatgggggtgggggatgtgagctgctggcccagggagcatcttgtgacatcgcggaggtggaggctggatcgtgggcggctgtgcggagcagtgggatgagccgaggaccaggggtcaagacctggggttctgcttccgatttcacctgctttttattccgcgaccttgggaagatggctttcttgtaaaatggggatgcttttatctgctttgccggcttcaccggactgtggtgaccaggagacgaaacactgtcttgaaagtgctttgtgactgtaaaccaactgcgcagtgttattctacgaggctgggggcgttaggttgggtaaaagattgtgcgtttgcagaagggacagtggcagggaaaggagagtgaactgtcagtgggcagagaagtgaacttggaattgcttcagaagagaaaggtgaagtcatgccagagcaatcctcatcttgggagaaaggtgaaaggcaactcagtggtgtgccttgagatctggaaagagacagattttagagtgggacctgaatttgttccctgcactggcacttacttaccatgtcctcttgggtaaatttaactcttagagcctctgtatccttatctgtaaaatgaggttgttcttgagaattaaatgagttctagcataaagcatcttgcacaggtcaaggcacagagtgggtgagcagtaaatgtcaactttctttgcccacccgtgtgcgatgagactcagcacagtgtttagctctgaaaggatggaattattttcccactcaactttttggcacatggagagaggatgttttccgacaagataagacagtggtgaccggagaccagcctgctgcagttgggagtggttttgtggctgtctgctgatggatgaagctgaaaggctgttttaggcacttttggcagagtgacctggtccttggccttgtcggttctcatatttgattttatcatgcaccttcggggtgagaaggtcccggcagattggtgctaacctgacttctagctaaagagggagtacaatgcaatggaaaggacatgagtttggaaaatggaacctctgaatttaaatcctgtatcacttgctttcactagtgtgactctagacaggtcagttcccttctctgatactttgctatcttctgtcaaatacaaggtagtacttcataggagtattgtgaagagcaacaaaaaggcacgtgggtacctaatgtatgagcactgttatcattagatagtctgactaatggagtgtagtgctgttttattgaatcaaactcatgctagctagtcagcacattcgcttcttagcaggagagccaacaaatatatcttatgactgattgctggattctgggaggagagagaagagaatgcagtgaattggatgatctttaagaagctggtcctgcagctccagcagtggtagcaccctttccactcagtaactcagaaaagggcaccttgagctcaatttgcttcttcagccatgttcactagtcacgagaacattctgtaattgcaacattcttagctttgtagtaataactgcttcagttgtcaagattatattttatgatggggcacggtggctcatgcctgtaatcccagcactttgggaggctgagacaggcagatcacttgaggtcggagtttgagaccagcctggccaacatggtgaaaccctgtctctgctaaaaacccaacattagccaggtgtggtggcacgtgcctctaatcccagctacttgggaggctgaggcaggagaatcgcttgaacctgagaggcagaggttgcagtgagccaagattgcgccattgcacttcagcctgggtgacaagagcaaaactgtctcaaaaaaaaaaaaaaaagaaaaagattatattttacaaggaacacagccatagccacaggttggcagctccctaatgccacttactttaggaagtacttcagtctcattggcaacatttaccaatcacttttttggtttttttgagagggagtctcgctctgttgcccaggctggagtgcagtggtgagatctcggctcactgcaacctctgcctctcagtttcaagctatttttccactgtagcctcctgagtagctgggactacaggcgtgtgccaccaccccgggcaaattttttagtatttagtagagacggggtttagtatttagtatttagtggagacggggtttcaccctattggccaggctggtcttgaactcctgacttcaagtaatccacccgccttggtctcccaaagtgccgggattacaggcatgagccactgtgcctagctattactaatcacttctgtgaagaagagtgaatagagcagcactggggctgctgtttttacaagagcctgcttacaaagttggcctttggctggcatctgggaaataagcacttgaatgctttcctcaatcctgtaactattagtaataaagatggttcactatgcctagatcctttttacaaactatgatttatgttgaatacctgctttccttctgggaatctgatggctaggctggtggtgcataaattaaaaacttagggtgctgattctctaatggactttcctgggcacaaactgcacacatgtattgaatattttgctgctgtagcaaggagcaagcttgatgtatatcctcacaggagggagagaacataaggaagcctgtgcatgggtttctacaggcagccctgacatgcttttagtgacacttgaggtcctttcctattgctgatatccattcactgtaaaaaatttagccatgagtacaactatatacatgtgggcagtctggggacccctgaagcaccttatttcatagaggaggcttctgtaagtggctgaccccattaaatatatgtgaattcctctcatccttatctaagatcttgcgacttgattatgctagggatcattgttaatatgtagtccctggcacatgtatacatatgtaacaaacctgcatgttgtgcacatgtacccttgaacttaaagtataataaaaatatatatatataaaatatgtagtcctataatatgtgttttactacattcctccttttgaagcaattgacaaaaagcccttagcattcccaaggaaaagtttcttgttcttttttttttttttttgagacagtttcactcttgttgcccaggctggagtgcagtggcatgatctcggttcactgcaacctccacctcccgggttcaagcgattctcctgcctcagtctcctgagtagctgggactacaggcacctgccaccacacccagctaatttttgtatttttagtagagatggggtttcgccgtgttggccaggctggtctcaaactcctgacctcaggtgatccgcccacctcggcctcccaaagtgccaggattgcaggcgtgagccaccacgcccggccaagtttcttgttcttaagagtaaaggaattttagagtacgcacctgagataataaagatggagacttatagggggagatgagtatttaaaacccaatccctccccttctctcttccctcttccccttctctttgcttctatttttttctcttctttcttcctgagagattggaggactgcgtggggcttgatctagatagggttgacctggcgaaggctaagtttgcagaaccagacctcacatctcagctcagacattggtaactcaggcagccctgacatggttttagtgacacttgaggtacattaatgacataaccttccctacctttgtctctctacatgccacagttgtgtttacttactctagtcactcactctaatcccagtccatgaaaccaagcctattactgctctgtggactttacttaaaaaaaaaaattaccttaggctgggcacagtgactcacgcctgtaatcccagcactttgggaggctgaggcaggctgatcgcttgaggtcaggagtttgagaccagcctggccaacatggtgaaaccccgtctctactaaaaatacaaaaattagccaggcgtggtggcggacgcctgtaatcccagctacttgggaggctgaggccagagaatcactggaacccaggaggctgaggttgcagtaagccgagatctcaccactgcattctggcttgggcgacaaacggagactctgtctcaaaaaaaacaaaattactttcagaaaacatttattgagctcctgctgctccttggtatgtgctaggccccaggtaaatcagaagcagtgttaatttgattgctcaggtgaacagcagcaagtcagccttgctacaagtttcccgtctactcttttttttttttctctttcctttaatgaaccaatgaaataccataaatcccatctacttttttttttttatttaattagagatgggggtctcaccatcttgcccaagctggtctcaaattccagggcttaagggatcctcctgccttcgcctcccaaagtgctgggattacaggtgtgagctaccccaacctgaccaagatcccattctactctcatatttcaggtctggtgactagactcctgccatgttcccatagccaaagccaagacccttgagcatctgttctgatccatggctgagctttgagcttttcctgctaggctgtgctttagactggggtcccacccccaggattggaacccacctcagaggacactctgtctgtgaagccctttgaaccaaatcctacccagtcctcagccctctccctctgggagaaagataagaagaaaaaaataggcaagaaagaaagtgaggcttttcaacattgggatctccatatacagttggcttccagactcctccttcctgatttctatctgcccgctagtcttgttctgctttcctggttctcacctgtcttcagaatgttgctgagccacccctactaagcttcctcctggccctgcctggttaatcttcctttgtcagggaagttcagtggcctgtttgtgtctctcctctataggcctgtattaaaccagtgggccctcgatcctgggataccgagagtcatgggcagagctgcaaagtagatagcattccttgtccttctattcctctccccaccctcaggaggctttgatcagagccctttttccatgtcctaaaatgttctctttgttttcttcagttagaatgccagaatcctgaggtgtcgtagctaactattgatctggtttttgaaagaaaatagagacggagtctcaccattttgcccaggctggtctcagatttctgggctcaagtgattctcttttcttggccgcccaaagtgctgggattacaggtgtgagctgctgcacccagcccgatctgatgtttaaatggcactgcggcattagggacaggctgaaccctccttggtggacatatgtgctccataagatgagttaattctaatctgtagttgggagaatatgtggcttggtgcttagggtagtgggctttctggagttcatggttattcagtctgtactttagagtggtctgccatggagtaaaaatcatagtgttggcgtttttccagtatcatgaagccaagaatttcctatcctctttccctttgctttgtgaggctatgttaagaagagccatccgtagagcgagaggagagagataatgagggtcagcggagggtatacgcggtgccagaatcattgttattaaatcaactagaaaatattttaagaagaaattggaagaagaaaaaatctttacctgtaaccatgccatattaactattagtttgctaggctgccataacaaagtaccacagactggcttaaacaacacagatatatttcctcctcattctggaagttagaagttcaagatgaaggtgtcagcaatgttgatttcttccgaggccactttctccctctgccttcacgtagccttccctcagtgccctcctgtgtcaccagctgtttgtctccccagggggcagaaatgttctatttctcactccttactgcagattctcttttctgctgtctgtgtttgcagtttgcactcattggaggtgtggttgcctctaatctttcccaccagcagctatttccatcattgacgtcagttgctgaaatttatgcattttatcttcctgattgcttatttgtttatttatttatttactttttgagatggagtcttgctctgtcacccaggctggagtgcagtggcgtgatctctgctcactgcaagctctgcctcctgggttcatgccattctcctgcttcagcctcccgagtagctgggactacaggcgcccgccaccacgcccggctaattttttgtatttttagtagagacagggtttcactgtgttagccaggatggcttatttatatttttatttttgtatttgcttttgttgtatatgttggcatgctggagaaaagcttggcctttcatgaacattgccaagttggccagaacgctactttcatttgtgtggtaaactgacaaataaatacagagttgaggcagaaatcctcaggtctcacttgcatttgtttattgagtcctgagaggctctgtctctgctgcagaagccattctcttttcctgaatgtttttctgtgtttaaagcttatctggaagcctggattcaggataaccaacgcagccgggcacagtggctcacgcctgtaatcccagcactttgggaggctgaggcaggcacatcacctgaggtcaggagttcgagaccagcctggccaacatggtgcaaccctgtctctactaaaaatacaaaaattagcagggcgtggtggtgtgcgcctgtaagcccagctacttgggaggctaagacaggagaattgcttgaacccgggaggtggtgtggtgagctgagattgcaccacggcactccagcctgggcgacagagcaagactccgtcacacaaaaaacaacaacaacaacaaaaaaaacccaaggctatactattatgaaagcaaaagatggcaccatccgttcatatgataaatctttgggggtttgctgtgttgcaggcactgtgctaggccctggtattagaggggtggataaatagacattaaaaaaaaaatagatagggtctcactgtgttgcccaagctggtctcaaattccagggctcaagccgtctgcccacttcggcctcgcaaagtgctgggattataggcatgagccactgtgcctggcctagacatttttaaaaatagaaattacatttttttggagacagttttgctttttcactcaggctggagtgcagtggcatgatcataacttactaccaccttgaattccttggtttgagggatcctcctgcctcagcctcccaagtagttgggactacaggcacgcacattgtacctggctaagtaaaaaaagaaaaatttttttagagatggggtcttactatcttgcccaggcttagctcaaaccgtgggctcaagtgatccactcacctcagcctctcaaagtgctgagattataggcttgagtcactgtacccagcgaaaattttaaaaaattttagtaggccgggcgcggtggctcacacctgtaatcccagcactttgggaggccgaggcgggcggatcacgaggtcaggaaatccagaccatcctggctaacacggtgaaaccccgtctctactaaaaatacaaaaaattagctgggcgtggtggcctgtagtcccagctactggggaggctgaggcaggagaatggcatgaacctgggaggcggagcttgcagtgagctgagatcacgccactgcactccagcctgggtgacagagcaagacaccgtctcaaaaaaaaaaatttttttttaaatgagtatttatagtcccagagacctatggggactcctttagcatgcgccaccacagtcagctaattttttgtattttagtagagacggggttccaggctagtcttgaactcctggcctcaagtgatccacctgccttggcctcccaaagtgctggtgttaacaggcgagccaccgtgcctggcttgagtgtttagatttttgttgtgttactttagggaatgttgggctttgttctggtcggcagttgcttgtggtttgatttgatccttcataggctaggtttttcaatagtgctttcttgagatataattcacataccacaaaatttacccatttaaaatgtacagttcatcatatttagtgtattcacagagttgtccatccatcaccatgatcaattttaggtcattttcattgccctcaaaagaaaccttgctgttaccctgcagccctaccagccccatccctagacaaccactagtttactttctgtctctgtagatttattctgaacattttgtagaaatagaattctataagatgtggttttttgtggtggcttatttttatttttatttttttttgagacagagtttcgctctggagcccaggctagagtgcagtggcgcgatctcggctcactgcaagctctgcctcccaggttcacaccattcttctgcctcagactcccgagtagctgggactacaggcgcccgccactgcgcccggctaattttttgtatttttagtagaggcagggtttcatcgtgttagccggatggtcttgatctcctgaccttgttgtgatccacctgcctcggcctcccaaagtgctgggattacaggtgtgagccactgcacctgccatgatggtttttacttggcgtattttcaaggttcatccatgttgtagcatctcattacttcatttttattactaaataatatttgtatgcatataccatattttatccattcattagtaggtggatgtttggattgtttctacattttgactattataaataacgctgctatggaaattcacgtacaagtgtttctgtagacatattttcatttctcttgggtctttaactagatgtggaattgctgggccatacaataactctaggtttaacctttagaggaactccagactgttttccaaagttactacaccatttacattcccaccaacggtgtacagagggcttgttttctttacattgtcaccaacactctgtattgtctgtctttccagttatagccatcctagtggatgtgaagtgggatcttattattctgttgttgatatgcatttgcctgatggttaatgatgttgagccagcctattctatcctagaacagccactcttttggggtatttgtagatcttctttggagatatatctattcagattctttgcccaattttaaattgtagtatttttttaattaagttgtaatagttctttattttagataaaagtttcttaataagatatatgatttgcaaatattttctcccattctgtgggctttttcactttcttcatggtgttctttgaagtacaaaagttttaaattttgatgatgtccattttgtcattttttttttcttttgtcccttgtgctttttgtgttgtatctaagaaaccactgtctaatttcaaggtcacaaagacttacacctgtgttttttgttagcagttttatagtttagctcttacatttgagtttttgatccattttgagttaagattttatgtgatatgagatgggggtccagtttcattcttttgcatgtgaatatccagttgtctcagcacgatttcttggaaagactattcttttttccattgaggggtcctggaacccttgtcaaaaatcagttgactgtaagtgtgagggtttatttggtctgtatgtctttcctgatgttggctagtatactgtcttgattactttagctttgtagtaagttttgaaattgggaagaatgagtcctccaattttgtccttccttttcaagattgtttttgttattctgggtcccttgaattaccatggaaattttagggttagcatgttagtttctgcaaagaactcacctagggttttgacagggatggtgttgaatttgtaggttagtttggactgtattgctatattgtccctttttttttttttttttttttttgagatggagtctcgctctgtcacccaggctggagtgcagtggcacaatctcagctcactgcaacctccgcctcctgggttcaagcaattctcctgcctctgcctcccaggtagctgggactacaggtgtgcacaaccatgcccggctaatttttgtatttttagcagagacagggttttgccatgttggccaggctggtctcgaactcttgacctcaggtgatccacccaccctggcccctcaaagttctgggattataggcgtgagccactgtgctcggcctgtattgccatctaaacaatagtaactgttttgatctatgaacatgggatgtctttccatttatttaggttttctttacttttagcaatgttgtaatgtttcttagttttgcacttcttttgtttttattcataagtactttttctttttgatgctattttaaatgaaattgttctactggttttttttgtttttttttttgaaacagggtctcactatcactcaggctggagagcagtggtatgcagtggtattatcacagcttactatagcctggacctcccaggcttaagcagtcctcccacctcagtctctgaagtagctgggactacaggcacaagccaccatggcctggctagtttttgtagaaactgggtttcaccatgtactccaggttggtcttgggtttcaccatgtaccccaggctggtcttgaattcctgggctcaagagatccacccgcctcagcctcccaaagtgttgagattacaggcgtgagccactgcacccagcctcctggttaatttctaaaattttttttagagactcactatgttgcccagactggtctcaaactcctgggttcaagcaatcctcctgccttggcctcccaaagtgctgggattattacagttgtttttctttttacatttttatttattcatttttcttcaacttttattttaggttcatgtgcaggatgtgcaggtttgttaaatgtgtgccatggtggtttgctgcacagatcttctcatcacctgtgtattaagcccagcatccattagctattactttttttttttttttttgagatggagtcttgctctgttgcccagtctggagtgcagtggcgtgatctcggctcactgcaacctccacctcctcggttcaagtgattctcctgcctcagccttctgagtggctgggattacaggcgcgttgcaccacacccagctaatttttttgtatttttagtagagacggggtttcatcatgttggtcaggctggtctcgaactcctgatctcatgatccacccacttcggcttcccaaagtgctgggattacaggcatgagccaccgcacctggccccccacccttttttttttttttttttttttgagcctgcactattgcccatgctggaatgcactgtggtgatctcagttcactgcaatctctgcttcccaggttctagtgattctcttgcctcagcctcctgattagctgggactacagacgcttgcccccacgcctggctaatttttgtatttttagtagagatggggtttcaccatattgaccaggctgatcttgaactcctgacctaaagtgatccacccgccttggcctcccaaagtgctgggattacaggcatgggccactgtgcctgacagctatttttcctgatattctccctcccccacctcacaggccccagcgtgcgttgttccccccactgtgtgttcctgtgttctcatcattcagctcccacttataattgagaacgtgcagtatttggttttctgttcctgcgttagtgtttttctttattatttttttttaataattgagataaagttcatataacataaaattaaccatggaatagttttcttaatttgctcattgctgcgttgtagaaatacaatttattttcttttcttcttttcttttttttttttttttttttgagatagagtcttgttctgttgcccaggctggagtgcagtggcgcgatcttggctcactgcaagctctgcctcccgggttcatgccattctcctgcctcagcctcccaagtagctgggactacaggcacccgccaccaagcctgcctaatttttttgtatttttttttagtagaggcagggtttcactgtgttggccaggatggtgtctcaatctcctgacctcctgatccgcccgcctcggcctcccaaagtgttgggattacaggcgtgagccacagcgcccggctgattttcgtatcttaatcttgtgtcctgtaaccttgctgaatttgtttgttagaaggtcatgaatctgtctacagatgaccaaagagcatcttttttattttgtatttttggagacaggattctgctctgttgcccaggctggagtgcagtggcacgatcatagcttactgcagcctctaactcctaggctcaagcagtactcccacctcagcttcccaagcagctgggattacaggcacttcccaccgcgctcagctcaaaagcgcatctctaatgaaactctgatccagggtgcttgtaggatcaggtgctgttccatttacatttgtaggtccatgtgtatcatgtcacagtcacctttgtttatcatgatagctctgagtcacttcgaaaatatcagcttatattcaatattttttgtctgaggggatggtacatttgagaaagacaattacaaatggttttaacagaaaaatataccattaatacttaaatcttagtcttttgttctcagagaattttgtttctccaggaagacaattcccagaggttttaaataacaagtagtactcttttaaaaaaatcatttaattatccaacttttataatgctattattgtagctttattttgacctaaataccttacaaataccctctgttatggttgattctcatctgcaattttctgcccagtcatccagacttactttctccttgaatcttattttctccttggtttagcatttccttaccttggcagtcaaaattcacatctttgagatacctgtcttttaatatccttgggttaaagtattgccaagagttcttatcaaagtctaagtcagtcatatttgttgcctccctgtggtccattgacttaacaaccttttgaaagtggtgggtagaagccctctggatcctttttgtaaatgggaataaccctggccatcgtggtcagattttgggcttaatgactttttataatgacccactccccctaagacccctaaaaacaaacaacttgctagtttattgtaaaattctgattctgaaaagccatttgatgttatttttcttttcattttttcaaagactagagggttaatgctttatcctgcattaggactttgacctctctgtgtctgtttcatcatatgtaaaagggggatgattaataatagctacctaatgagctgttgtgaggattaaataagataatatagatgaacacatgataaatgttcaatatgtgttagctgtcattatttggagaatggcacccaccagaactgggtgtgatggtttctgtaggacccaggttcaagttttcagatgtctttctaataagagtcccagtttccaagagcattttgctccaggctttcagggccctctgtcgtttagtttctgacttgtgttatttgctagttgtattatttttattagttttgtaactcctgctggattgtaacgctcatgagggagtgactgtacattatatattacttcatttgagagttcttccatccgtccctccattcattcagtaaggcagcagatacttgttcagtgtcaactgcatgccagcactgtgcctggtactgactatatgacaattatcacagtgtagttaaaccctgctttctagtagccctgtacctcttttctttcctcctcaccttatcaaatgtctgtgaccttggccgctttagtcccattaagtagttgttaaagttctgaaatgtgtagggtgcagtggagtgatgaggaggtcacaggcctctctgcagtgagaggataagtatacaagtaactgtaagacatcaggaaggtaattatcttgagaaatacagagttctatgtgagctattgagagatatgatgggagatattacatcaagttgctggggtctggaaaatgtttgagagttttgagacagttgagatggatcttggaaggatgggttgaatttttataggggagatagggcaggttggacaaaatgtttcagatgggtcaaaaccatggaagaggccaggcagggagaaatgagaattgatacatagcggcctgggtttatgagagaagttttggggctgggagtgtgcactgagtgttcattgggcaatggggaaccattgaaggtatatgaaccagaagtggaaatattggagtaggaagagacaaaatgagaaggaagatgtagttaggaacctgttgcctcaggtgcacttaacttatctggacctagttgcctaacctgtaaaacaggaataggataacacatggcctgcctgaaagtgaacgtttgctggttgcatctgtgcaacctctcctgaccttagacctacacttcttcatatgtttgggagttgtcagtgatccttaggcctgcagttcaggtaagcatatcagtgcagcacatgaacttcggtatattctgtatttcttttctttttctttttttgtttggagatagggtcttgctttgccacccaagctggagtgtagtagtgtgatcacagctcactgcagccttaacctgctaggctcaagcgatcctctagcaatcttccctcctcggatccccgagcatctaggactacaggggcatgccaccgtgcctggctaattattaaattttttgtagagacagggtcttgccatgttgcccagcctggtcttgaactcctgggctcaagcagccctcctgcctcagccttccaaattgctgggattacaagcgtaagcccatgcctggccgtatttttttctgattctaaagttatcaatattttttatagaaaatatgggaaatacagaaaataataaagaaggaactaaatattgtctgtaattttttttttttttttttgagacggagtctcgctctgtcgcccaggctggagtgcagtggcgcagtctcggctcactacaagctctgcctcccgggttcacgccattctcctgcctcagcctcccaagtagctgggactatagacgcatgccgccacgcctggctaattttttgtatttttagtagagacggggtttcactgtggtctcgatctcctgatctcgtgatccgcccacctcggcctcccaaagtgctgggattacaggcgtgagccactgcgcccggccttttttttttttttgagacagagtcttgctctgtggcccaggctggagagtgcagtggcacaatctcggctcactgctatctccggctcctgggttcaagcaattcttgtgcctcagcctcccgagtagctgggattataggcccaggccaccacacctggctgatttttgtatttttagtagagatggagttttgccatgttggccaggatagtctcgaactcctggcctcatgtgatccgcccacctcaacctcccaaagtgctgggattacaggtgtgagccacggtgcccggcctattgcctgtaatctgattactcagtttgatacttttcttgataggcagtccagtaggctttgagttttgtttaattaccagtgaccaattacattagtttcctattactactgtaaataaattgccacagacttgttgttagaataacacgtttataattttacagttctgtagattagaaacacaacctgtgtttcactggactgaaatcaaggtgatggcagggctgtgtatctttttagagactctaggggagaactcatttccaagcctttttcatttttttttaatatgtatatattgagatggagtcttgctctgttgcccaggctggagtgcagtggcgcaatctcagctcactgcaacctctgcctcccgggttcaagcaattctcctgcctcagcatcccgagtagctgggactacaggcacctgccacggggcctgccaccatgcccggctaatttttgtatttttagtagagatggggtttcacaatgttggctaggctagtcttgaactcctaacctcaggtgatccacccacttcagcctcccaaagtgctggaattacaggtatgagccaccgcacccagccatcatttccaagccttttacagctcctagagctgcccacattccttgatttctggccccttccttcattttcaaagggagcaatggttggccaagcccccatctcacatcactctgactccctcttctgcctctctcttctccttttaatgacctttgtgattgccctgggcctatctaaataatccaggatatccctccatttcaaggttcttaatttaattagatctggaaggtctcttttgccatgtaaagtaacatattcacagcttccaggggattgagggtgtggacatctttgaggtgccattattctgcctgacatgccagtgtagtgcataaatcatggaatcattacatggatctctgagttgttctttttggtatcttcacttcacatttaaagctatgcctggcttttaaagtaatttctgaatggtcacagattatttctatttaaatgtttttagttgagtggggataggggaggaaggtctgaagtcagagtaccccagagcccctctgggcatttgaaagagaggaggccctggcagtccagaggaattgaggatggtaaaaaatgctgccttcagttctttctactgggtggggtgaccgctgcactggcagtatggctaaactgtgttgatgatgctgaattctgatcctgggatattgttagagcccaacccagagcacctggcctgagagaggaaatccattcttatgctttatgtaaaaaagaaagccttggtggcagggtgcgatggctcatgcctgtaatctcagcgctctgggaggccgaggtgggcgtatcacctgagataaggagttcgagaccagacatcttggttttggtgggttttagctggcttctttactgcagcctgttttatcagcaaggtctttatgacttgtatcttgtgttgacttcctgtctcaccctgtgacttagaatgcctgaactgcctgggaatgtagcccagtaggtctcagcctcattttacccagcccctattcaggatggagttgctctggttcacacgcctctgacaatagctgattaattttgttatttttttgtagggacagggtcttactgtgttgcccaggctggtctcaaactcctgggctcaagtgatcctcctgcctcggccttccaaagtgctgggattacaggcatgagccttgcacctggcctggatactttctagtgtggtaaagaggcaactaaagtaatctctcccatatcctgtccatcatcaagtcctcttaactcttccttcaaaacacatcctgaactggtctgtttctgtctctactcgttgattgctaccatgctaacatcttcgcctcagctgctgcaggagtctcctcagctgctgcaggagtctcctcacctgtctctgttttcactcttgtcctccaaaatccattttctgtgtatcagccagagggattcttctagacttcagttctaaacttgatgccctaaggcctctatgtgtttgttattaggatacaattcaggcttctgacctggcctgtggggccctctggggaccttctctgtctggacctgaactcctgggcctccttgcttcttcttttccactgtgctgctgcagcagcagcctttcctgatttgtcctggcttccttcttgatcagatcccaatttaaggaaccatcttagagaggccctccctgatcacattatcaaaagttgtctttcaggcactattgttggagaaataatgatgttatgccaattttgatgagttttcaagtcttcgtgctgtcttctagcacattagtttcatctgccaggtttgtagtggaatgtatcttctgtgttttagtgcagggtattgataaagtattgcataggacagagcaaagtacataggctttgatagggccagttcttccctgtgcttcagtgattgactcattaatcagcattctttgaatctcattgtctgcttttgccttccactagccactattatagtatatccaataacaatagataatgtttattgagcatttactatatgctgtgctcagtcccaactgcttcacacatttgatttttttttttgagacggagtcttgctctgtcgcccaggctggagagtgcagtggtgccatctcggctctctgcaacctccgccttccgggttcaagcaattctcctgcctcagcctcctgagtagctgggattacagccgctcgccaccatgcctggctacattttgtatttctagtagagacggggtttcaccgtattggccaagctggtctcaaacttctgacctcgtgatccgcctgcctcggcctaccaaagtgctgggattacaggcgtgagccaccgctcctggccatgcatttgattttttaaaagagtcagtgaggcattgttaatgcaggttggtttgggtaacctgttcgtggtcaaggggtggggacacccacttagactgtcctaacaccaaaatgcaaactttagccattgtgtcttaccccctctgagtatacacagttttaaccttcagctcatattactcagagtttatgtgttttgaggggcacgtgtacaattgtttcagcagctggagatgtcctgtgatcttttaactgaaaaaaaactatgacttattggttacatggactctttggggtttatggtagtggttttgtttgtttgtttgtttttgagacagagtcttgttgtgtcacccaggctggagtgcagtggcacgatcttggctcactacaacctctgtctcctgggttcaagtgatacttctgcctcagcctcccaagtagctgggacgataggtgtgcgccaccacgcctggctaatttttgtatttttagtagagatggggtttcaccatgttggccaggctggtcttgaactcctgacctcaggtgatccacctgtattggcctcccaaagggttgggattacaggtgtgagccactgcacctggcctattttttatttttatttatttaagagatagggtctcactatgttggccaggctagtctcaaactcccaactcaagttatcctcccacctcagcctcctgaatagctggtactgcaggcatatgacactgcactcagcttgctttattttgaatgtggttttctattttgtagagctgtttttgggggggtctcattttctaggtccaaaagcttctttgcatgtgtccagtggatttccatgggatcttccagttagatgaaagacggagagatgcagtgattgcattgggcatttttctgattgaatctgatcttcaggtaagtcttcatgaaattaaaagtttcttcattgtaaaagggggtgtagtgagcgtttaagtttgtatctgcttatatttacctaaagcaatagtagaagaatacatttgaacctaatcaaagtggttagtggagagggtaggacaaggtgggaatgaaacttcctaatgtaaaccttcttagaaaatttgagttttttagaattgtgtgcatatattatgttgtaaaaaaagtgtatttttgtttgtttgttattatgtgccacagagtaagttaaaatgctttgagaagtaattgtgtgccttccagggtaggtttggttttcaagctcaggtaaaatgcttatcagtcagactcaggggtattgtatttctccttccaaaaggacaaaatcattttaggtaattttgatataatatcatctttttcaaaattgcgattatgtatataaacttttagagtatgtatcagtgtatcttgttttttttttttttgagatggagtcttgctttgtcacccaggctggagtgcagtggtgcaatctcggctcactgcaacctctgcctccagggttcaagtgattctcctgcctcagcctcctgagtagctgggattacaggcaccagccaccactcctggctaatttttttgtatttttagtagagacggggtttctccatgttgggcaggctggtctcaaactcctgacctcaggtaatccgcctgcctctgcctcccaaagtgttaggattacaggcgtgaaccacgtgtgagccatcatgcctggcctcagtgtaccttttaatagggacttaaaatctagccctgtagctccaacaaaaaaatagtgtgactgttgtgtatgtgtatttttatatttaccaaagctatttgaaacaaatgattgatcattggatattgaatcttttatttatttatttatttttatcattactagatactatttctaaattccaagttaattatgctgtgttaggtaaataaagatgttagatatttgaatatttatctagaacaggttgcttccatctcctggaaattttgctctaataagcattaatattttaacagtatttgtacattggaaacaaataagaattttaattatagagcagtattttaataattaaataggttacctgatcaaggttacataaaaaaccaaaattagatacataagctacattttggcctttcttctgctatttatttatttattcttagagtgtcactctatcgcctaggctggagtgcagtggcacagtcattatttaatgcagccttgaactcctgggctcaagggattctcccatctcagcctcctgagcagctgggattataggcattggcatgattttttaattttctgtagaaatgagggtcttgctaggttgcccaggttgatctccaaccctggtctcaagtgatcctcgtgcctaggcctcccaaagtgctgggattacaggcatgtgccaccatacccagcttgcctgtttatttataaatgtgaaaagaaagaaaaccattttttttttctgtttaccatatcctacataaatataaaatgaattataaagggcaaaaaataattttaaaaaaatttataagaaactattgttgttcaaatgtggattacttgataatatctttggcaaacacgtttcttgatagatttacctgtaagtcctgaaagtgttgtacttgtattagacttcttaagatgacaacaaatagatgagcacaagtgtcattcaggttctgggtaaggactagcagggtcccaggtggcatgtgatgttgtcccttggaccatagagtttgcctgtatgtccagggcagcccaccggccttgcatatactaggagagaagcctagcatgctttgccagccccctgagaaagccctagggaccaccttggtttttacctggtgcttatattccttgcttccctccaggatgggctgtgcattgacctccttcaggtcccagcagtgggctgccatggtagcagctgtggccagaggagctgaggtggttttactcaccctgtgctgctaatgtcatcacagtttatataggaaagagccacctggagccacttcctctgcaggaggccatgtggttcaggccttatggagttttgttcctgtctgtacactaggatcctcgacagatgtcttagccagttcctttttatggtttagagaaaaaacttttgtttttgataaagttctttgtttttagttatctattatggtataacaaagtccccccagacttagtgcttaatacatcattttgtttgattcgtgaatctgcaatttagacagggctcaactgactccatttagcatcggttggggtggctcaaaagctgggggcaggaatcacctgaagtctcattcatgggtcttatcacagcatagtgtctaggttccagggcaaatgtcctgaaaaagagccaggtggaagctgcatgccttctgccatgtttttttgttgttttttgttttgttttgttttgttttgttttgtttttttgaaatggagtctctctctgtcgcccaggctggagtgcagtggtgccatctaggctcactgcaagctccgcctcctgggtttacttatgccattatcatgcctcagcctcccaagtagctgagactacaggtgcccaccaccatgcctggctaattttttgtatttttagtagagaaggggtttcaccatattggccaggatggtctcgatctcctgacctcgtgatccgcctgcctcagcctcccaaagtgctgggattacaggtgtgagccaccgcacccggccaccttctgccatgcttttatgttttaatttttttcgagacaggatttcactctcttgcgcaggctggagtgcagtggcacaatcttgacttactgcagtcttcacctcccatgctcaagcgatcctcccaccccagcctcccaagtagctgggactacaggcacgtcccactgcacccagctaatacttgtatttttagtagagacagggttttgccatgttggccagctgggtctcaaattcctgagctcaagtgattcacctgcctgggtctcccaaagtgctgggattacgggtgtgagccactatgagccactatgcctggctgcagccatgtttttaaaactaccatgtggtttgtcagcatttcaaaacatcaaatagtactcctcttctctagagcacacttcttctctggagcacatctaatccttaactggaacatctgtaaatagggaaatagctccaaaagccaatgatggaagattacgaagctatatattggtgttgattggctagttcagaaattagaggaaagtaaaatttttcactgggctaaagttggctataaagtctgatgctcaacttgagaagaacaagaggaaacatgaagtagaaaattaaaaaaaaaaaacacaaggaaaatggacaagggacatgaacagaaaaaagcatcacccagttgagatgcccgcattgtgagcttctctccatccccaggatcttattctggggctcatggatgggttttggggctctaaaccattctcactgaagacagctttgagtgtgtacacacgtgtacctcctggagaggcccagcccccagaagaggcctgagcaggctggaccctcagctccagaaggcaggtgcgaacccttccttaggctcctgtggtacaggttgataggacagcctctggactctgcagtgtgaaaacaggaatggagtgatgccatgtgaatttacatgcactttacattatccctggagaatctctgagatgattaggatgtggatatgctttgctttgggcttaatctgggctaaaaagctgccaatcacttattttattaaatctaatttattattcttcttattattttttagcacaaagattgtgtggttccttaccttcttcgacttctcaaaggtcttccaaaagtgtattgggtagaagaaagcacagctcggaaaggcagaggtaattgtatataatgttttccctgaatataagagaaaatacacatgttcagtgtctgtaggatcaagtgtttattcatactgacacatcagatgcatcttgtctccctcctggctgggaaacaactgcctgcagcattgtgggctgagcttacatccatgtgttggccacagcccatggatgagttggggagaaggtaggcctgggtaggccagctttccattgcattcttctgagagtgagcaagaacgttgagaccttcaagaaccttttctcatgtctcattggccagaattgggtcatctgcccgtccccaaatcagtcactgttacccttagaatttataggctcactcctggagtgaggtcagttttccagattatattgctgctgctcaaaaagggtgagatggaggttggagacccaacagcaatgttcactgtaaatagtttcatcactttgtttctaagttccagttaaactttgcacctttagaaacggaataaattggctggtatggtggctcactcctgtaattctagcactctgggaggccgaggtgggcagattgtttgaactcaggagtttaagactagtctgggtcggccgggcgtggtggctcatacctgtaatcccagcactttgggaggccgaggcgggtgtatcacgaggtcaggagttcaagaccagcctggccaatatggtgaaactctatctctactaaaagtacaaaaattagccgggcatggtggtgtgtgcctgtagtcccagctactcgggaggctgaggcagaagaattgcttgaacccaggaggcagaggttgcagtgagccgagatatgctactgcactccagcctgggcgacagcacgagactccgtctcaaaaaaaaaaaaaaaaaaaaacaaaaacaaaccaaaactagtctgggcaacatgtcccagtctgctaaagatgggttttgctgttctcattaacattctgggccccgcaacaccaccgccacaggcatgaacgcatgcacagaggtcaccagctctaactctgtgctaccactgccattggtgcaaatgtgcacacagaccccagcggccgtgcaccactgctactgccaatgcccacatagaggcaggcagccccaggcctcctagcaccctgcctcagccaatgagcatgcaccccattgcactgctggtgctgctgtcacaagcaaataggctgccactatccgacagagtgctttggctggcactacccttcagagtgttgtggctgtggcccaagaacacctcaacccctccagtgctgcatgttctcaacctcagagagccagagaacaaagctgagtgcccaataccagccccccagtgttggaggacatagcccaggagtgctgagctgagccttagtcccccaaaaatctgtcagaaatgaagccagttgactgaacccaatcaaacccccaaagacatcaaagaagataaaagcaccacccccaaaaaaatccatccaaaggacagcagcttcaaagattgaaagaacattagccaatgaagataagaaagagccagcacaggaactctggcatctccaaaagccagtgtcttcttgctgctaagttgactgcactagttccccagcagtggttcttaaccaagccaaaatgacagaaatagaattcagaatatggataggaacgaagatcatcaacattcaggagaaagttgaaacccaatccaaagactgtaaaggatacaataaaacgatataggagatgtaagatgaaatggccattttaagaaaaaaccggccgggcacagtggctcacacctgtaatctctgcactttgggaggccaaggtgggtagatcacttgaggtcaggagttcgagaccagcttggccaacatggtgaaaccccatctctactaaaaatacaaaaaattagccaggtgtggtggcaggttcctataatcccagctacttgcgtggctgaggcaggagaatcgcttgaacctgggaggtagaggttgcagtgagctgagatcatgccactgcacttcagcctgggtaacagagtgagactccgtctcaaaaagaaaacaaccaaactgagctgatggagctgaaaaactcacttcaagaatttcggctgggcgcagtggctcatacctgtaatcccaacactttgggaggccaaggcaggtggatcacaaggtcaggagttcaagaccagccttgccaaggtgatgaaaccccatctttaccaaaaatacaaaaatcggctgggtgtggtggcgcacgcctgtaaatcccagctacttgggaggctgagacaggagaatcgcttgaacccgggaggcagaggcaacagtgagccgagatcgcgccactgcactccagcctgggcaacagagcaagactccatctcaaaaaaaaaaaaaaaaagaatttcaaaataaacaacagaattgaccaaactgaggaaagaatcccagagctcaaagaccagctctccaaaataactcagacaaaaataaagaaaataaagaatgaacacctctgagaaatatgggattatgtagagaccaaatatacaactcattggtgtccctgaaagatagggagagagaaaataagcaacttggaaaacgtatttcaggatattatccatgagtattttcccaatctcactagagaggccaaaattcaaattcaggaaatgcagagaacccctatgaaatactacacaagaagaccatccccaaggcacatagtcatcagattctccaaggtctaaatgaaagaaaaaaaatgttaaaggcagctagagagaagggacaggtcaccttcaaagggagtcccaccaggctaacagcagaccttttagcagaaactctacaagccagaagagaatggaggcctacattcagcctttttgttttgttttgtttttgtttttgtttttgtttttgtttttgtttttgtttgtgttttgagaaagagtctcactccatcactcaggctggagtgcagtggtgcgatcttgggtcactacaacctccgcctcccaggttcaagcaattctcatgcctcagcctcctgagtaactggggactacaggcacacaccaccatgcccagctaatttttgtatttttagtagagacagggttttgccatgttgactaggctggtcttgaactcctggcctcaagtgacccccactcctcagcctcacaaaggtgctgggattgcaggcatgagcctctgggcctggctcatattcagcattgttaaagaaaagaatttgcaacgaagaatttcatatccggtcaaactaagctttatgagtgaaggagaaataagatctttttgagacaagcacatgctaagggatttctttaccaccacctgccttacagggtcttgaagggaatgctaaacatggaagggaaagattattaccaaccactacagaaacacacctaagggctgggcacagtagctcacacctgtaatcccagcactttgggagtctaaggcggatggaacacctgaggtcaggagtttgagaccaggctggccaacatggtgaaaccccgtttccactaaaaagacaaaaaattagctgagcatggtggcagatgcctgtagtcccagctactcaggaggctgaggcaggagaatcacttgaacccaggaggtggaggttacagtgagccacagtcgcatcactgcactccagcctgggcaacaggaatgaaactctgtctcaaaaaaagaacaaacaacaacaataacaaaacacacctaagtacctagactagtgacactataaagcaaccacacaaacaagcctacataataaccagctaacaatatggtgacaggaacagagccacacatatcaatattatgaatgtaaatggactaaatatccctttaaaagacacattgtggcaaattggataaagaagcaagacccaatggtatgctgtctttaagagaccaatcccacatacagtgacacccatacattcaaagtaaaaggatgaaaaaaatctgccaagcaaatggaaaatggaaaaaagagcagggattgctattctgatttcagacaaaatagacttccaaccaacgaagatcacaaaagacaaagaaaggcattacataatggtaaaaggcttgattcagcaagatttgactatatccaacacgggagcaaatttatacatatcgaacacggaagcaaccacattcataaagcaagttcttagagacctatgaagaggcttaggtaaccacataataactgggacacttcaacaccccactgacagtgttagacagatcatcagggcagaaaactgttaaagatattcaggatttaaactcgacacttgaccaaatggacctaatagatatctacagaacactccactcgaaagcagcagaatatacattcttctcatctgcacatgcaacatactctaaaatcaaccacactataagacataaaacaagcctcagcaaattcagaaaaactgaactcatagggccacagcacaataaaaatagaattaaatactaagaaaatcactgaaagcatataattacatgaaaattaaataacctgctcctgaatgaccttcgggtaaatgatgaaattaaggcagaaatcaagaaattatttgaaattaatgagaatgaagatacaacataccagaatctctgggacacagctaaggcagaattaagagggaagtttatagcatgaatgctgacgttgaaaagttagatctcaaattaacaacctaacatcacaactagaggaactaaagaaataagaacaaactaaccccaaagctagcagaagataagaaataactaaaaccaaagctgagctgaaggaaatgagatatgaaaaccatacagaagatcaacaaatccaggagttggttttttgaataaaaaaaaaaagatcactagctagacttacaaagaaaaaaagagaaaaggtccaaatagacacaaccagaaattgataaaggggacattaccagtgactccacagaaataataataataaaaaaacccaacccagagagacaaacacctctatgcctacaagccagaaaacctagaagaaatggataaattcctggacatatacaacctaccaagactaaacccagaagaaattgaatccctgaacagacaaataacaagttccgaaattgagtcagtagtaaaaagtctgccagctgaagaaagcctaggaccagatggattcacagctgaattctaccagatgcataaagaagagctggtaccactcctactgaaactattacaaaaaattaaggaggagggactcctccctaattctatgagggtagcatcatgctgataccaaaacctggcagagacacaacaaaaaaagaaaacttcaggccaatagatgaacatagatgcaaacatcctcaacaaaatactaggtaactgaatctagcagcacatcaaaatgctaatccaccaggtcaagtaggctttatccctgggatacaggatcgatacaatgtatgcaaatcaattaatgtgattcatggcagaaacagaactaaaaacaaaaaccatgtgattatcttaatagatacagaagaggcttttcataaaattcaatatcccttcatgttaaaaatcctcaacaggccaggcgtggtggctcacgcctgtaatcccagcactttgggaggccgaggtgggcggattacgaggtcaggagattgagaccatcctggccaacatggtgaaatcctgtctctcctgaaatacaaaaaattagccaggcatggtggcaggcatctgtagtcccagctactcgggaggctgaggcaggagaatcgcttgaacccgggaggcagaggttgcagtgagccgagatcacgccaccgcactccaatctggcaacagagcaagactctgtctcaaaaaaaaaccccaaaaaaatccacaacaaactctaggcattgaaggaacatacttcaaagtaataatagccatctatgacaaacccatagccatcattatactgtatggtcaaaagctcgaagcattccccttgaaaaccagaacaagacaaagatgccctctctcacctctcctatccagcatagttctggaagtcctggccagagcaatcaggcaagagaaagaaataaaaggcatccagataggaagagaggaagtcaaacgatctcttttcatagattatatgattttatacctagaaaaccctatagtctctgcccaaagccccttgatctgataaacaacttcagcaaagtttcaggatacaaaatcaatgtacaaaaatcagaagcattcctatacaccaacaacatccaagctgagagccaaatcaagaacacagtcccattcacaatattcacaaaaataataaaataccagtcgggcatagtggctcacgactgtaatcccagcactttgggaggccgaggcaggtggatcacttgaggtcaggagttcgacaccagcctggccaacatggtgaaacccatctctgctaaaaacacaaaaattagctgggcatggtagtgcacgcctgtaatcccagctacttgggaggctgaggcaggagaatcgcttgaacctgggaggcggaggttgcagtgagccgcgattgtgccactgccctccagcctgggcgacagagtgagactccatctcaaaaaaaagaaaagataaaataccttggaatacagctaaccagggaggtgaaaaatctctatagcaagaattacaaaatactgctgaaagaaatcagagcttacacaaacaaatggaaaaacatcccatgctcatagataggaagaatcaatattgttaacatggccatactacccagagcaatttatggattcagtgctattcctatcaaactaccaatgacattcttcacagaattagaaaaaaactattttaaaatttttatggaaccaaaaaagagcctgaataactaaggtagtctgaaaaagagtaaagctggagacatcacattacccaacttcaaacttcacctctactacagggctacagtaaccaaaacagcatggtactggtaaaaaaaatagcacatagacaaatagaatagagagcccagaaataatgctgcacacctggaaccatctgatcttcaacagagtcaacaaaacaagtaatggggaaaggactccctgctcaataaatggcgctaggataactggctagctatattcggaagattggaactagaccccttacttacaccttatacaaaaatcaactgaagatggattaaagatctagatgtaaaaccttaaactataaacaccctggaagatactaggaaataccactctggacatagaccctggcaaagatttaatggcaaaaatttaatgacaaagatgccaaaagcaattgcagcaaaaacaaaaattgacaaatgggacctaattaaactaaagagcttctgcacagtaaaataaactgtcaagagagtaaacagccaccctactgaatgaaagaaaatatttgcaaactatgcaaaggtctaaagtccagaatctatgaggaacttaaatttacaaacaaaaaaaaaaccccgttaaaaggtgagccaaggacgaatagatacttctcaaaagaagacatacaagtggccaaaaatatatgaaaaatatgctcatcatctgatgctaataatcagagaaatgcaaatcaaaattgcaatgagataccatctcacaccagtcagaatggctattattaaaaagtcaagaaataacagatgctggtgaggttgtagagaaaagggaacacttacacactgctggtgtgaatgtaaattagttcagccattgtggaatgcagtttggcaatttctgaaagaatttaaaacaggattaccatttgacccagcaatcccattattgggtatatactcaaaggaatgtaaatcattctactgtaaagatgcatgcgtaagtatgtttattacagcagtattcacaataacaaagataaggaatcaacctaaatgcccatcagtggaagactggataaagaaaatgtcgtatgtgtaccgtggagtactgtgtagccataaaaaaagaaaaagattatgtccttttattttttattttattttatctttttttgagacgatctcgctctgtcacccagcttggagtgcagtggtgcgatctctgctcactgcaaccctcgcctcccaggttcgagcgattctcctgtctcagcctcccaagtagctgggattataggcatgtgccactacacccggctaatttttatatttatagtggagatggagttttgccgtgttggctaggctggtctcgaactcctggcctcaagttatttgcctgcctcagcctcccaaagtgctgggattacaagtgtgaggccaccatacctggccaagatcacgtcttttgtagcaacatggatggagctggagaccgttatgggagaattagcacagcaacaggaaaccaaacgctgcatgttctcacttgtaagtgggagctaaacttcgagtacatatgaacacagaagggaacagcagacactggggcctacttaagagtggagaataggaggaaggtgaggatgggaaaactactttctgggtactatgcttattacggggatgatgaaataatctgtacaccaaacccccgtaacatgcagtttacctgtataacaaaactgcgtatgtacccctgaacctgaaataaaaattaaaaaacattctgtttgtgccagtattcctcttaacctttgggttttcatcatttctggtaacatgcctaaaactgacagatcccaaattatgcatgtacctgcaatttgttaggattttgtttgttttttgtttttttgagacagtctcactctgtctgcactccaagctgtagtgcagtggcctgacctcggttcactgcaacctccacctcctgggttcaagcaattctcgtgcctcagcctcccaagtacctgggattacaggcatgcatcaccatgcctggctaatttttgtattttcggtagagatagtattttgccatgttggctgggctggtcttgaactcctggcctcaagtgatctgcctgctttggcctcctaaagtgctaggactataggcatgagccactgcacccagtctgtcctgcaatttgatggactacaaattaaatagagcatcattactaaaaggtcaaattttaggccgggcatgggcacattcaagtttgagaacagcctagagctgcactttaaaattttaagtgctggagtagaaatgtaagtcttctgtcatgtactatgaatatagctattaaatagtggatactcttttttccttgattcaacattcaatattcaaaattgatttttttttttttttttgagatggcgtctcattctgtcacccaggctggagtacagtggtgcgatctcggctcactggaacctccacttcctggcttcgagctattctcctgtctcagcctcccaagtggctgggattacaggtgtgcgccaccacacccagctaatttttgtatttttagtagagacggggtttcaccatgttggccaggctggtcttgaactcgacctcaggtgatccgtctgccttggccccccaaaagtgctgggattacagacttgagccacttcgcccagccgagtgttttgtgtgtgtgtgtgtgtgtgtgtgtgtgtgtgtgtgtgtgtgtgtgtgatttatcacatttacttagggaataaaaaattgaatctgtcatgttgagaggctttgttatctcacactagctattggctcaggaaacatttaagtttattgaaccaaaacatttacttaaaggaaaggtaagggtgtttctcagcaaactcattgggcccatagctgttcttttgagactcgtctcaaggagggcagctgctgtaaactggtcccttggcaggtcatggtgagagggaacatattgaattggatggccagaggtgtgacccagtatctggttcctggttatctgatttatgtttttacatcttccaggtgccctcccggttgcagagagcttcagcttctgcttggtaactctgctgtctgatgtggcctatagggatccttcacttagggatgaggtaagcatgtgttggttgatttggtatgcatttctattagattgaatagagtcccaaagtgatgaaaagattttaaaaacgtgaaatgtgattgaattgtttgttgatatttatctatttcatcctgttgacagcagacctaagacatgcttaggtctttcactactctttaggatctcgagtcttatcttattaaacttttctttttttttttttcttttttctaatgaagggcaggggctgcagagacatgagcagcactatccctttcagcttttcagaaagtcctttaaggtaggcggcagaaaaaggcagaggcagctcatttttcttgctctttgttggggattgaagtcattcatagaagatcattttcttttctttttttgaggcagtcttgctctgtcatccaggctggagtgcagtggtgcaatcttggctcactgcaacctctgccgtccacctcaagccagcctccctcctaagactcccaagtagctgagactataggcgtgcaccatcatgccagctaatttgttttgtattttttgtagagacaaggtttcgccatgttgcccaggctggtcttgaactccgggcctcaagtgatccttctgcctcgacctcccagagtgctgggattataggtgtgagccactgtgcccagctagaagagaatcttctaggtagctgaagcttttatctttaagggcacagactttctttagattttgttaattttgatagaaatgttacaaacatgtatttcatactttcctgttctttaaacaaagaatgtaatcatacaactttttcttaaatttatcgcttagaaagttagtttttgtatgctgctgttcctaggttcttccaaacagtgcctagttgcttgtctgcattctaaatgttcccagttagtgatgtattttgactaatttagattcttcatttatttgtaggttggctaaagaaatacttaaatatgttagaataatgtgtttttattaaaaagttggacattaagggcttttttctatgaataaaatttatcagaataaagaggtcaacaccaaaggtgataacatgactttaacatataaaatggaaaaagtggctgggtgcggtggctcaggcttgtaatcctagcactttgggatgctgaggcgggtggatcacctgaggtcaggagtttgagaccagcctggccaacatgaagaaaccccatctctactaaaaatataaaaattagccgggcgtggtggcaggagcctgtaatcctagctactcgggaggctgaggcatgagaatcacttgaacctgggaggcagaggttgcagtgagctgagatcatgccattgcactccagcctggataacagagtgagactcggtctcaaaataaataaataaaatggaaaaactattgcttttcaagcttttgtagattattcagcattacttaatattaggaaaatgtaagagatttgacttggttatgaacaagtcatgtcacaccaacttcattttttctttgcctgggttttctaagaagaatggttgagagaaatgaagttgctgcattctagtggatcttcataaatgctttggacaagcacctttcctgacatcctggaccagttatatgggctgagggccaaatggtttggagggtttgcagaactgcctgaaggactgtcccaaagggtgatcagtgaggtatcggcctagcaggaccctcctgtcattggagcaaaacaagctagtgctgtgaatgaagatctggaaagcaagttgatttcatttggagaaggcacaaagctgggaatcacagatttgtacagtgagctaaagctaataccatgagtttttgtaggggtagatgaaagataaaaaataccaactacgttagtagagattacatagttcaggagaagcaggtgcgaaagaagacttaggtatcttcctcatctataagcttattgtcatggatggtggctcacgcctgtaatcccaacattctgggaggctgaggcaggaggatcacttgagcccgggaatttgagactagcttgggcagcatagcaaaacctatccctacaaaaataaaaataaaaattagctgggcatagtgacacatgcctgtaatcccagctacttaggaggctgaggcaggaggattgcttgagtccaggagtttgaggctacagtgagctatcattgaacccctgcactgttcttggctcactatatcctcggcctcctgggctcaagtgaccctcacacgtcagcctcctgaccacaggcacgcaccaccacacctggctaatttttgtatgttttgtagagacagggttttgctactttgcccaggcaggtctgaactcctgagctcaactgatccacccgcttcagcctcccaaagtgctgggattggctgggcacagtggctcatgcctataatcccagtaccttgggaggccgaggtgggtggatcgatcacctgaggttgggagtttgagaccagactaaccaacatggagaaaccccgtctctactaaaaataaaaaattagccaggcgtggtggtgcatgcctgcaatcccagctgctaaggaggctgaggcaggagaatcgcttgaacccaggaggcggaggttgtggtgagccgagacatgccattgcactgcagcctgggcaacaagagtgaaaccgcgcctcaaaacaaacaaacaaacaaaagtgctgggattataggcataagccacccttccaggaacaaaaaaaaatttcttaacttaaataattatggactgggcgcagtggctcacgcctataatctcagcactttgcgaggccaaggcaggtggatcacctgaggtcaggagttcgagaccagcccggctaacatggtgaaaccctgtctgtactaaaaatacaaaaaattagccaggcatggtggcatgcacctgtaatcttagctactcaggagactgagtcaggagaatcgcttgaacctgggaggtggaggttgcagtaagccaagatcatgccactgcactccagcctgggcaacaagagcgaaacttcgtctcaaacaaataaaaaaaatttaaaaattatgtataagctcattgagatgagcttcacataagcagtgtgaagtggctgcagaaaagctaatgtcacatacatagaagtgtagaatctgtgatgagtttggtgagtatgctgggtgagttccagcatcccagatgttaatgtattttattctgagcactacacttccagacagaaaactggactaccgtaaaatcagaagctggcaattagcattacaaaggatttatgatcatgaagaatacggttgaaaagcgctagggcgtttacccatgaaaagagaagatttggggacccatcacctgtttacagaatatgttaatagaggaaaaagcagccccaagggctggtaggtacaagccccaggaggacaacattggcccagtattgggaggaactcggaaccagcccagagagtgagggttttgtccctggaaagtcagctggttggccacttggcacagtcgttgtggagggatgtatcatatatggggttggttaagataatgtctgaagtgccttctaattctgacttagtttcgtgatatttacctaattttgtttatgttttttttttcttgtttccttgactgttacagattttagaggtgcttttgcaggttttgcatgtcctcttggggatgtgccaggccttggagattcaagacaaaggtacgagtatccttaaggtttttcttaaaatggttttgtggttactctttcccttgcttttctccagtcttttctgttgttgggtacctaatatatatgatgggagaaaaccttcctattttagtttgatttgttgtgtgttagtatcctcagaggccacatggggtcatgtgcattgctctgctacatagacgctgggtcaccttggacaagtaacttcacccttctgggccccagtttcttcacctgtaacatctgtgggtagattagttgacttccaaaggtcattttttctgtgttgtgaggctaccaatatgctcctaagaggaataaatgtataaggtacttgataatatggcctagctattttattgatttgggtgtgccatgaatagatgaagaccttccaagcagggcagctgggtgtattgaagtcatagtctgaagttgttaatgacaggttgaagatatcacttgtcagcccttggggtggaccccattattgtggcttattgtgaaccttcacagttattagtgggtgggttgtgaaatcttagtcaatgttacaagttagtacttactatatgactctatcaggatactttcttatattgtaacgttttcacttgatcttctagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtgggcctgggctactggggaaagagcagaggagaaagaccctgttaagctcccctgcgaagaaaatccctcttctttgtagttggagtaaacttaagtaacgtgaaatgtttcactagaattctctttaatacaaagacttgtcttgtccctcttaagatgttggggggaagggcttatagagtgcacatataaactggccataaaaatataaaacaatgaggtgtaaaaagccacaaaaggcctctaaaaaaaaagccttatcgccattatgttcccatactctgagcaagacttactctcttatccataaacactgtgttaaaaaaaaaaaaaccactcctttaaaacatgaaaatatggccaaacatacagactcctagttaagcctgctcccactaactgctgtccaataagttgaaaatatactgtttaaacacaaaaaaaattcatttaaactgccgctactatagattacacatatgacacactgcctccctttcaccgtttcgccctaaacatctgcttcttaaatctaagtgattatactcaataaatagtgtaaaaaccaaaactctaggcctttgcggcctctgatttgctctggtcccctggctcccgcctttataaactcttaacctgtttcttctcattcctttgtcgccaccaaacatcaaataccctacaggtggtgttgaggctagtccccaacataagatttataagtgatttcatagtcataaagtatatgtttcatagcagttgggtgccaaatgctattttgcctggaagacagttggtgcccttaagaagtatataattgactcatggagaaaagacaaaaacacaaaacactgaggacaattcagctcagtaatcaagtgtcaaatatacggctaaacacaaagaatttagtgatatagcatgtagtagagaatgctgtagctgtgatgggctttaggaaggaaatgaggcttcaaccagaacttgaagtacaaacattgggctggcagagaggaccttgtctaagacaaatctgatggaggtctcactggtcttttctgatatgtaactgtggttgtgtgtttcaggtcagccctgaacgcggcatgccccctcccagttcccctggaggatctgcctttcactactttgaaggtgggcttcacctttccgaagaatattttgacgtaatacttggagaacaggctcacagtgacttctcgtgatattaaggatgctgatactaactctgttgtcatggatggacctagagtgccaagcttttaggaagcatttattttctgttttcatttaagtttcttaaaatttaattttcaaatattttatatatagagaaaagtacatttaattttcaaatattttatttagagagaaaagtacagaaaataacttacagacccctatatacctgccatcagaatttttgcactttaacttgtaaaagttcttttcaggtggaagtactaatggtggatatttcttttctttttctgagatagagtctggctctgttgcccaggttggagcgcagtggtgtagtctcggctcactgcaggccctgcctcctgggttcaagcaattctcttgcctcagcctcccaagtagctgggattacaggcacacaccagcatgctcagctaatttttgtatttttagtagagacagggtttcaccatggtggccaggcttgtcttgaactcctgacctcaagtgatccacccatttcttccttccagagtgctaggattacatgcatgagccaccacacctggctggacatttttttttaatgacattaagtatgtagataatattaaagaatgtagtaatactactgttactacttttttttttttttttttttttttttttttttttttttggagagagagtctcactctgccacccaggctggagtgcagcggcatgatcatggctcaccgcagcttcaaccttctgggctcaagtgatcctcccacctcagcctcccaagtagctaggactataggcaccctccacaacgcccactaacttgtgtattttttgtagagatggggttttgccatgttgcccaggctggtccggaactcctaggctcaagggaacgcctgccttggtctctcaaagtgctaggattacagccgtgaaccaccatacccagcccattactactttttatagagctctgctgttcacaaagtacttttacataatttactgaattggattcatgtgactaccctgtgccatgtcagacacatgttaaaattatttctaccttacttgatggaagtaagacccagattaagggacagcaaatggggaaggcagaattccatgcttcagtatagtctctccttttttgaataatgctatttgttaaaagagcatgtctcaagacagtttcgagagatgtgaggggaattttgaaggaaaaagggaatatctgggcttacataaatgtaggaagctttccatctcttagatctgtgagaatgtaacaggttacattctatatatgtgttagaatataagagctaatttcagccactcagaatcgcacctcttagagacaactccttgtttaagtatagaatgtattcctccaggctctgaaaatctcactgccacctgcctgcctttggggcattttaggatggccatgatgtgcccttggaggcttcccttttcctggtaaacagctcattgtccaccctctgtggtgagggctcctctccatgaccgctgccccactttgagcacatccagtaagtggcagatgggagcacactaatgtggctgactgcgagatccccacgtatcactccatcagacttggctgccgcccactttgcctgtagtggtgacgagacaagcgagccctgctctctgaaatgcctcactgtaggacagacagcagcagaccctgtgccttctgagtttcctctcaaactacctgttttacttggactttttcttttttttgagttggggtcctgctctgtcacccaggctggagtgcaggggtgcagtcataatgatcctctggccttgccctttcaagtagctgggacttcaggtatacaacaccacatactaagacttttcttacagccggtccttctatctcccttcccaggccctcttccaaactgctgtaagaatttagtttttaagaattgtttttaggccaggagatgtggctcacgcctgtaatcacagcaccttgggaggcccatgtaggaggattgcttgagcctaggagtttgagactagcctgggcaacatagtgagacccttaaaaactaaataaaataaaaaataaataagaattatttttaatagcgcaaatttgatcacttcttttcctgcttaaaaactttcaggttgggcacagtggctgacacctgtaatcccagcactttgggacaggtggatcacttgagactaggagttcgagaccagcctggccaacatggcaaaacccgatctctactaaaaatacaaaaattagccgggtgcagtggctcacacctataatcccagctactcaggagactgagacatgagaatcacttgaacctgggagacgcaggttgcggtgagcagacatcgtgacactgcactgcagcctgggcaacagagtgagactcttgtctcacaggaaaaaaaaaaaagaagtttcaatgacaccccctgcgtaaatcccaaatgttaggtccctagttcctgcagcccctgtcgtttgccatcatctgtgtcctctgtggggttcagccacacaggacttagcccatatttcatggtgtctttctgagaagtgcccgataatcacaaccttcccttctccctcatctaccctttttaatccggctgtttctccctcccttctttccttacttgttccctctttcagtggccatttcttatgttggcctcttggcgtctcagctcccagtggtattgttgcccatcctttctgctgtaagttgctggtttgcgtcctctttagacagattggcagtgtgctgccagctgtgagataccagctttgacacaactggagctaaactaaactctttgagtctgttctctagtgcttgaaaaagtcataaaatttagtattcacttctttatgaattgatactgtcttatgaaaatattacaaattcatctgtttttcaatcatagttttttgtttgtttgttttgatttgtttttttttttttttttttttgagacgcagtctcctactgtcaccagaatggagtgcagtggtgcaatcttggctcactgcaacctcagcctcccgggcttaagcagttttcctgcctcagcctcccaagtagctgggattacaggcacgtgccaccacgcccagctaatttttgtatttttagtagggacagcgtttcaccatgtttgccaggatggtctcaatctcttgaccttgtgatccacccgcctcggcctcccaaagtactgggattacaggcgtgagccaccacacctggcctcatagttttctattatagtttctaaataatggattttcaaacaattatatgcttttgggttcctatttactatatttctattttaatttaaaataattttatttatgtagagacagggtctcgtcgtgttgcccaggctggtctcaaactcctgggatgaggcgatcttcccacctcagcctcccaaagtgctgggattacatgtgtgagccactgcattgggtctgggtttatatttattaaatgtcaaatgactgaatgactttatttttgttgatttttttccttcttttttttttattgtggtaaaatacacataacataaaatttgctatgtcattttttttttttaatacaggattttactctgttacccagactggagtgcagtgacaaattcatagctccactgtagcctcgacctcccaggctcaagcaaccctcctgctccagcttcctgagtagctgggactataggcccatggtgctgtatccggctaatttttattttttgtagagacaggatctccctatattgcccaggctggtcttgaattcctggactcaagcaatcctcccacctcagccttcgaaaactctgggtttataggcatgagccaccatgcttggccttaattattttaaagtgtatagtttagtagtattgaatacatttataatattgtgcaactatcactacaattcatctcaaaaactcttttcatctcgtgaaactgaaactatacatcaattattccccatttccccttcccccagtcactgatagctaccattctacctctatgtatgatttaagttcctctaataagtgggatcgtacagtatttgtcttttagtgacaggtgtatttcacttagttgctctgactttgaaacttctagtagtgtgcatttttttttctaattttggtgagaaaatatctctgaggccctgtggaccccaagctttcatatctcttcacctttaaaaaggtgtatttctgctgggcatggtggctcacgcctgtaatcccagcactttgggaggccgagacaggtggatcacttgaggtcaggagttcgagactagcctggccaacatggcgaaacgccatctctactaaaaatacgaaaattacctaggtgtggcgacgggcatctgttattccagctactcggaaggctgaggcaggagaattgcttgaacctgggaggcagaggttgcagtgagctgagatcacactgctgcactccagcctgggcaacagagcgagactctgtctcaaaaaaataaaaataaaaataaaaaagatacaattcttttttcacttcccacatactaagttatattgtctaagatggaaatattaggaccatcatatctgagtctttgacctgaaagacacaggtgaggggcatcagtccccaaggatttgcaatctaccctgtagttgttaatttaaaaacatgcagagaattgggatataaataaaggcaaaatctgcacctttgttggttattgggggagtcagcttgaggaagtaccctagttgcctgtcaccacggctgagtttccagctttatctcccaccagcctcctgcttgcccgatgggactgccctagagcctgagtactacttttcaaccatcagctccagcttctcagtctctccccttttcaacggtgtcacatataaggagtttaacattccattggaaatgcttcgggaactcttaaacctggtaagcaaagaactgatggatgaacagaccatggatatgtcagtaaaattgctagtggtgaaacttgtatttttaaaagaaaaactcagagtaccagtatttcaaagtacaatttaatagtcataaacttgcagattaatgaaggaagtagagtaacattcatggaatcattgtatactggtttctcatttcattcttgagcaaccatgttggggaggcacccatgcatccccatttggaggtcaggaaatcggtgtcaaacacgtcatggatatgtaggccagcagctgggctgcatccagtccagggattctgactccaagtccagtgcttttcctgggcttgacttcctctaaggggtggctctatttgggttaataacaaaacctgactttttcatatttgggtacctttggatgacattgagggtgataccagagaaaacaccagggccattgttcgattccttaaatggccagagctttggtcagattcagggaccctggttggacgccgtggctcatgccagtaatcccaactttgggaggccaaagtgggcggatcacttgaggtcaggagttcgagactagcctggccaacatggtgaaatcccatctctactaaaaaacacaaaactttagctgtacatggtagtggatccctgtaatcccagctactcaggaggcagagttaggaggatcgcttgaaccttggaggtggaggttgcagtagtcaacatcgcagcactgcactccagcctgggcaacagagtgagactccatctcaaaaaaaattacaaaataaagatccaggggccctgaagttgttacaatcaagctaggatggttcaagacagatttgaataggtacgggtgatgatgtcatcaaggccagactctcaagattgggcttgctgtcttggaaatgagaacaatttggatagcatggagcatgtgctgaggagtggccacctccctgctgtgtggagtgtgaatagaaatccctcagagaatggcttcaggctgaagatgtaagaagacattacaacataggtaataattaatgaggatggaaccataatgaattactaaataggctaggatgtttttgaagttgctgtcaagaaggaaaactacctaaactgcttctcagtgtcagtgccccagatagaatggtggcctggtagagccatgaccttcacagatggctgttcccagtaccatgtcagaaattctaactgaagactgactgtttcacatcctttcttggggtattattttttgcagtatattttaacttttaactttcttcaagtttaggttttcttttttttttttttttttttgagatggagtctcgccctgtcgcccaagctggagtgcagtggcacgatctcggctcactgcaagctccgcctcccaggttcacgccattctcctccctcagcctcctgagtagctgggactccaggtgaccaccaccacgcccggctaagtttttgtatttttagtagaaacagggtttcaccttgttagccaggatggtctcgatctcctgacctcattatccgcctgcctcggcctcctaaagtgctgggattacaggcgtgagccaccacggctggcctaggttttcttttaggcggtttttcatttcttttcctaggatgtttatcattatctatacattttggaaatgactttcatcaaatactacaattgtggatgtgggcagttttttttttttttttgtggttctgcagttgacagaacaattcattcctacactaaatactgtacagataactggtgaaaataattgcttctattgaaaatttaaaatatgagctctagtttgagtacctaagcagttgtagaagagccagtgcacctggcccggagaggaaggaggtgccatgagctccaaggactggctgtgagggtgtccttgatgtctgggaggggattgcaagaggatgtcacacaactgtgcctgttaaccatgagtgggtgaaatggcagcaaggcctgaggtctgcacatcctggaaacagaaatctcaggtcaacaaatctgagggagtttggcctttttcctttgtttttatgtcattgctatctaaggtagaaaagcagtcccaagtgacttcagaattaaaggcattttgtgcatatagtttgatacatagccataatttgtatttattggcctttatctgcatcacatttttcaccatgtgagtttgtcatgggttttcggtagaaggagctagcattcctgtctctgtgtatgtcagttgcttcatgaggttctgtttccttggtaggtgaagaagatcgttgaggaggctgttctcaaatctttggatgccattgtagccagtgtgatggaggtatgtcgcttctgagggcattaccatgagatcagcctgacttaaacgtgtgtagagaaagcaggaagagtttgagcgggggctggagtggaaggggttttgcagtgttttcactttccttgttcatgtggtaacaatccacctgccgcggagggcttggtctgtggtaggtaccgttgcatgctcttttaaatacgtcacctcagggtgcctctgactggtggcattacagacagaagatagagttttagtgagaactcactaacgtgcccacatcacatagttactgtgggagctgggagtctggcctgggtctctcctactcttttatcttcctcactcctttggtgcttccaaagctgctcctctgggctcagagctacacttttctaggcgtatgcaagtcctggtttttaagtgtaaggggtgcgtaactagggaactttttttttttttttgagatggagtctcgctctgtcgcccaggctggagtgcagtggcgcaatctcggctcactgcaagctctgcctcccaggttcacgccattctcctacctccgcttcctaagtagctgggactacaggcaccctccaccacacccagctaactttttttgtattttttagtagagactgggttttaccgtgttagccaggatggtctcaatctcctgacctcgtgatctgcctgcctctgcctcccaaagtgctgggattacaggcgtgagccaccatgcccggctggaactcttgtctttaatgtatttggaaccaaggcctacagcattatttatgaaatcattacattggtgctgggaggtctcaaaaatctcggggaacatttgggtcaggcccctcttgagggttaggatgcagacaggttgtcatttgccaggctaattattaccatgggtatgtccctgacccagattccttattgaagcctggtgttccttctctcacctgattttaagacacacagtgcctgataccactgtacctggggctcaggtatgaagcagggaaggaactaccagggcccttcatgtgctgtagaccatgtctcttcctgcttcgtacccctgccaacgagctattgcagatgtgagatgtatgtgctggccgtggtttggtctgggttggttcttggttaagtaacagagttcttataactccccaagttgcatctgggcagttcctaccttgtctccaaccctttttcaggttgtcgttctgcccattggcctgagctttaactctctcactcactcactatagactgagcttgtggtctcagagacctttggttttccatcataagtgtttgatcatttgtgactgagggcagaccaggaggaccagggcgagagctgggctgggcagttagacaagtggagacttagtgggcctgcactccacctctgggaccctccttctcattgaaccagggcagtttctggtattttttgttttgtaatttgttctttagcataaacatccatttgaagaaacagtttcatagctaaaaaaaaaaaagtttcttgtaatcttgacctagagtctgcaatatattactcagtatccataatcagtgtaataaccactaccaattattacatgcttattatgtgccagaactttactcactcactccttgaatctcacaacaatccccagtttacatatggggaaactgaggcttagctcaggaactttatttacatagctcgtgagtgatggagctgggctgtgggcttgtaagatggttggtctccaaggctccaaagtttaacactcgtgttgtctggactcccagagtcaaagccctgaactgctttaacctctcccagtctcatttctccatttctgccctgtgaggaccaccagacgttgtctgtaaagccatcattgcagtgctgtcaaccacagctcttcctgtcagtgtcctcctgggaattggcatgactctcacactctccacatgattctttttttctccacctgctcactcaccctctgtcaacctcacactgcatgccctatcccactctggccaacttctggcgccttaaagatttgctatatttgcagaccacttttatacttgtcaagaattataatattagctgggcatggtggtacatgcctgtagtccctgctactcaggaggctgaggcaggaggatcacttgagcccaggagttcaaggctgcagtgagctgtgatcataccactgcattccagcctggggtacagagtgagaccctatctctaaaaaaaaaaatgaaaaaaacgagttatgataaaccataattttccatcctactcaactaggagtatatagaagttaaggactgttatctttttttttttttttttgagacggagtctcactctgtcacccaggctggagtgcagtggcgtgatcttggctcactgcaagctccgcctcccaggtcaaagcaattctgcctcagcctccttagtagctgggattacaggtgcacgccaccacgcccggctaattttttgtatttttagaagagacagggtgtcaccatgttggacaggctggtcttgaactcctgaactcctgatctcgtgatccacccgccttggcctcccaaagtgctgggattacaggcgagagccactgcacccagcctttttttttttttgagacagagttttgttcttgttgcccaggctggagtgcaatggcgcgatctctgctcaccacaacctctgcctttcaggttcaagcaattctcctgcctcagcctcccaagtagctgggattacagtcatgtaccaccacgcccagctaattttgtatttttagtagagacagggtttctccatgttggtcaggctggtctcaaactcccgacctcaggtgatccaccctccttggcctccccaaatgctgggattacaggcgtgagccaccacacccgggctggactattatctttcttaactcattagaccttgtgtgaatttttttttttttttcagaagaagaatagtgctacatttcaaatagattcctaaagaataatttaaaatgagttttaattacaaaacataagttgtatctgaaggtgtcctggctgtaatttgtatccttgggatgatggacagtgtggatcccttactctggtggcctttgtcagtcttcctccttcaccacttcccatgtccctgtctgggccaatgatggccaaagatggtgagcttcagccacagcaaggaggttcttcctactagggtgcagatggctgctcccccgcaggcatctctggactgcatgagcctcctgttttccttggtctgatgcttaagaggatgaagacagtagagtgtccaagtgatgagtcatgataaacagttgcttcatttagaatgctaagtcacgaatcaccattccgctgggccttgctgtgaaggcaaagggtgggcagaagggcatttctgttctatagtcatgtgtgtctgccttccctgcaggccaaccccagtgctgatctctactacacttccttcagtgaccctctctacctgaccatgttcaagatgctgcgtgacactctgtactacatgaagggtgaggacagtttgcccatgtgtttgtgagtacagcaagactggctcccaggccactgtcgcatgctagtggttgcagactggtactcactttctgctggggccactgaaaaacacatatgagcaaagtggtcatgttactgaaattttgggaaaaaagcaaatttaaaaaatctgtccatgatcctgcaaccccggtaccatcgatgatggctcctttgctgagtttatttcctaaggtgtttatctaaaatgtgcatgttatattgtcctaaggacagatacagttttacatatccatttagatagtttaaaaaattaaaaaagaggccaggcacagtggcttatgcgtataatcccagcactttgggaggacaaggtgggctgatcacttaaggtcaggagttcgagaccagccttgccaaacagggtgaaaccctgtctctactaaaaatacaaaagaaattagccaggcgcagtggcatgcacctgtaatcccagctacacaggaggctgaggcaggagaatcgcttgaacttgggaggcggaggttgcagtgagcccagatcgtgccactgcactccagcctatgtgacagagtaagactccatctcaaaaacattaaaaaaaagaaaatgaagtacttgtaatacatgtaatctgttaatgtagaggtactagctttttttttcagacagagtctttccctgtcgcccaggctggagtgcattggcatgatctggggtcactgcaacttctgcctcccaggctcaagcaattctctcgtgcctcagcctcccaagtagctgggattacaggcatgtgccaccacgtctgcctaatttttgtatttttagtagagatggggttttaccatgttggccaggctggtcttgaactcctggcctcaaatgatccacccaccttggcctcccaaagtgctgggattacaggtgttagccactgcacccaacctgagacaatagcttaatagttaacatgcacacacaacaatttagcattttcttctagtccctctttcatgaattttgtttttcccagaagtgaggaaacaatcttttatgcattttacaaaatgtttttcctatgctctcccctcacactgttgagtgttcttcgtaagcttaagttttgatgagcacataatattttgtcaggaaggtataccaaaatttagtaaccactttcctaatctgattctgaacattcctcagaagctgagtcatctgggccacggcaagggttgaaactccctaagaaggggcatcagggattacccctgccctccccaccacccctgctgtgtgttgctggctgccttggctgggctgacttgtgcgtgcatcatggtggttctcctgaattttccaggccctggggatgagagtttgaaaagtctctcaaactcagggtgagtgctctgaagatccagataattctcttctcaaggctgcaaccagtttttgcccttatctgacaacctttttctttctttttttttttttttttgagatgggagtctcgctctgtcgcccacgctggaatgcagtggcacgatcttggctcactgcaagctccgcctcccgggttgacgccattctcctgcctcagcctcccgagtagctgggactacaggcgcccaccaccacgcccggctaattttttgtatttttattagagatggggtttcaccgtgttagccaggatggtctcgatctcctgacctcatgatctgcccgcctcggcctcccaagttgctgagattacaggcgtgagccaccgcgcctggccctgacaacctctttcttaaaagaaaaaaaaatcacagaagtatctcatattgtcagtggaagtagttccagcaacgatacttcccaatttatatgtttcatgtattcaggttttagtacgttgactgcttaaaacaaagcatggctgtaacatccctgggaaatgatcatttcctctgattgccaggttgtgtgcacgtggaggacagctgtgcaattcctatccaacttctttccagtgggcattctaggacccacagtggccagtagcaaatgctacttttctggggtttttgttaaaaggggaagactgtagccgctgctagcactgcctgtgttctactgtagttttgttcccagctgtgatgccacactctttcctacagacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgagacagactgccttgcctctcatgtgagctccaggcatgacccagaggctttcttgccacaagtttccccaaactacttctagaacacttggctctgttaccagcacaggcagttgcagtaggcctcctgggcacgtgcagagtggagcattagcccctgctgtgctctgcacgtctggtgtcctgtcctgcatggagggcactggacctgggaggatggggatgcccgtggcctcagggcctgtgtatgctctctgctgcatcttgctggttctttaggcttttctgtggtgacatggaagctcagtgccttcaggtgaagtgtttttctgggggaggagtagaatgggaagttttctgtggaatgaacactgcggggacaagggggcttagggccagcggagaagagagagagagtgtcacacactgtgtgacctctcagtatgaataagccctgcctaaagtatgtctctggggttttattaaattctgtgcttacttggtggataagtgtgttagaaagactggcctgtgctgatcactcatctcctcttctggttttgaattaaggtgcagaaaacctttgcatcaagctatctgagaagctgcagtccaagacgtccagcaaagtcattattgctcacttgcccctgctgatctgctgtctgcaggtcagtctccctgaacccagagaggctcagatcccacctgtagggcctccctcttgtcacgctgttgctgttcaggctgtggtgggcacaccagcagcggagaccctgccggttctgtctttaggagctttaaccagtgcgtgctgtgcacagttcatcactgagtgtgggctgccccctgcaggatgccagggctttctgtcagtggcatatgggtgcagctggcttcagttctccgttgttgtgaggctgggggccattcccaaggcctgtgggggaaggactgtggacatgtgccatggggccacgcaaggggatgtctcctgacacccacagtgctagctctgctctgccgagactcttaaccttgtcacaatcccactgactccacacctgccattgtttaaaaattatattttgtccctttcttctttagtatgcttccaaaagagatgagcacactttaacaatctatatcccctggccaggtacggttgctcactcctgtaatcccgatactttgggaggcagaggtgggaggatcgcttgagcccaacctgggcaacatagtgagactccgtctgcacaaaaaatttaaaaaattagaattagttagggatgatggtgtgtgcctacagtcccagctactcaggaggctgaggtgggaggattgcttaagcccagtaagtcaaggctgcagtaagccatgatcgtgccactgcactccagcctgggcgacagcgagaccctgtctcaaaaacaaaacaaaaaaatagtagttgatgtcccctataggtggaggagagtcagcaccatcgcttccatctttttatgtcctgggcaggtggcctgtgggagctttgaccttcgaagttttgggtcagacttgggtactgaagggttgagcacctccctgctcagggcctactcagatggtcccataccacaggccatgtgacaggttgatggtgtgttgcagggtttgggccgcctgtgcgagaggttcccggtggtggtgcactctgtgacaccgtccttgcgagacttcctggtcatcccgtccccagttctggtgaagctctacaagtaccacagtcagtaccacacaggtaataacagactatgtgcccttcaggccctgagaaaggggctctgtgactgtgtgtgagcctcacacaggtttcatgactgtacctgggtgcattccttcgccacacctttccttctgtctttccctttgcgtcccctccaagctccaggcctttcttccccggccttctctcatcctgtattcctgttacaccaaaggccccttcaagtcctgttttctttttgacatctttcactgtggaagtctgaaatgcaaatcctgtgtgccccaaacacttagccaggggcccagtccctgctacccctgcgagaatggattatgatgtttccacatatgatgaaacaataattaacattaattaattaaacacctgctgtgtgctagtgtctctgatgtagtatcaccctcttacccacagtctcatgaaggtggctgtttttatcttccccttcagatgaagacttaaagtcagagcagtttaaagatttagccaggcgtgatggcgctcacctgtagtcctagctactcaggaggctgaagttgtaggatggcttgagcccaggaggttgaggatgcagtgagctgtgatagcgccactgcattccggcctgggtgacagagcaagaccctatctcaaaaacaaacaaaaaacaagacttccctgaaccccgtagtggggagggttctctcaggctctaaggcccctgctcccgcaagcatccctaaccctcaccaggctttgtacatattagtgaggtaactccaagcacagggccatgcctcagtcgccctcagagctgcctttggtggttggtcatcagtacttttgaacagttgattgagaaattggtagttttctgtatttatcactttctaacttgaatattcttccttttgatttaaacatattatttcctgttgctcttagactcttctctttctgaaatatttggtcagatgtttttagagtgatcattttgcttttataaatgatcagcatattatcttggtttttgaattacaaagaaggtgatggaaaatgataggcctaactaggtatatatttgaattttttactttcagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgggaagctgggcaagtggcgagtagacagcagtgctccagacaagcgggttattacaaaataagagacatttatacttcttttttgagattgagtctcgctctgttgcccaggctggaatgcagtggcacaatctcggctcactgctacctctgcctcctgggttcaagctattttcctgcctcagcctcccccgagtagctgggattacaggcgcccaccaccacgcccagctaatttttgtatttttagtagagatggggttgcaccacgttggccaggctggtctcgaactcctgacctcaggtgatccacctgccttggtctcccaaagtgctgggattacaggtgtgagccactgcacccaccccatttatacatttttttttatacagtcttgcactgttgcctggggcgggagtgcaatggcgcaatctcagctcacagcaacctctgcctcctgggttcatgcaattctcctgcctcagcctcccaggtagctgggattacaggcacacaccaccattcttggctaattttttatatttttagtagagatgggatttcactatgttggccagactggtctcaaacttgtgacctcgtgatccgcctgcctcagcctcccaaagtgctgggattacaagcgtgagccaccgtgcctggctgcatttatacttttttaaagcttgtttctgattattttaaacctacacttgatctataaagaggaattatttcttgttacttcttttcttttcctgatcataaacataataagaggcctggtgtggtggctcaagcctgtaatcccagctacttgggaggccgaggcaggtggatcatgaggtcaggagttcgagaccagcctggccaatatggtgaaaccctgtctctactacaaatacaaaaaattagccgggcgtggtggcacgtgcctgtaatcccagctactcgggaggctgaggcaggagaatcacttgaacccgggaggcggaggttgcggtgagccgagattgtaccattgcactccagcctgggcaacaagagcaaaactccgtctcaaaaaaaaaaagaaattcttccttttttttttttgagacagagtcttgctttgtcgcccaggctggagtgcagtggcgcgatctcagctcactgcaagctccgcctcctgggttcacgccattctcctgcctcagcctctggagtagctgggactacaggtgcccgccaccatgcccagctaatttttttgtattttttttttttttttagtagagatggggtttcaccatgttagccaggatgatcttgatctcctgaccttgtgatccgcccacctgtgcctcccaaagtgctgggattacaggtgtgagccaccgtgcctggctaagaaattcttactagagaaaaattgtaatgtatagaaaagtaaaaagagaaggattatccattagctcaacatccagagtaacgtatcatcatattttctttaccttgttttctgtggaatgtttaatataaatgtgaggttttaaaatatgattaggtaccccttgctgcccagactcctgcactgtggactcttgttcttccaacttgagagctacatacagtctgatttccatgcaaatacttctttccctggattctggttccttgcccttagaagctaaatcaagatggcagcttgtctgtcagactcaaactgttttccaaactctggcccaggagccaaacagatgtggagagctaggacatcttacaagattttatgtttttaggggctttaaatttttccccttttctctgtaacgtaaatgtttctccttaccatgaaaaccttggtatataattgtgatgtttactatgctatcttgggaccgtttgtctttggaatcagtcactgtgaccttaagaaacagtacaagggattgaaattggaattagggtgagcatgatattccaaaggaaactgttctgggcaaaataatgaaattattgtttccgactgagacatttatcaagtgggcaaaatctggagtaattctttgaattcattctgtgttatgacctccaatttggggggaagaaaattcagagcagttctttaaactttgtaggcctaaggaaggaaaaattaaaaaacaaaaaacctatcttggtttgatgcctcagtgccacatgggttttcttgctcctcaggtgcctgaaggctggattgacggtggacccagtgattgtggaggcgttcttggccagcctgtccaaccggctctacatctctcaggagagcgacaagtacgcccctattcctgtctctcagaggcagcccattgttctcagcaggctcgtgtggggcacctggcattgtgcgtatgcatgcctctgtccttatctccttgtctcagagcataggcatgtatcagggttgtcacaagatttaaggtgaagcccaccttggattgtacttcctggaccactgtgtggaagtcgagaaagatctttgtcatccagactagtgcctggggcttatgtttctgcccgtggttaaaatcctgggctgtcagtttcagatgaacactgcatcaagactgttatgaaattaaggtctagatcgtagtctctgggtactgtttcactactgcatgctggagggactgttgctagggcgcttctgttcttccttctgtagggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatgtaagggaggccagagccagaacaccactaaccctgtgcaagctacgttaaactcttgactataagggatgtacaaatacagattaaatataccttgcagatgagctaaatgctgacaacggttttaatgcggagtagtaagaatagtgtaagatgctgtgagtgctggggaaaaagaggtttaatttcttgtcagtgtattataacagaagatttgaatctaagccatgtcccttttagcttttaatttgaggtttgattaaagctttagaaatggatgatctttgggctgatagtctttgggctgttgtgccccaggattccagagctttctctctaggtgatgacaggaggggcctcatgagggcatcctgcatggtgacagtgcatcttgctctctcccagcaatacatctatcaggaagtgtggaacctcttccagcagatcagtgtgaaggccagctccgttgtatactcagccaccaaagattacaaggaccacggctataggtaactggacctcattgtcacttttttatcatgacagtatttaacttactttaaaaatgtgaggtttgtgaatttgtctcttaaataaactcttcttgcaagaaaactatatgctacagatcagtgcacacataaggggggaagtgaaaacccaatgtggcccccacctggaggtgaccactgagcatctcagcgcacgaggtctcagctcctttctctccttctgattgggcccatgctgcacatgcagctgacctgcttttttatggggcagcacatcagccacaccatgaatgatcctgcgcaggttgcctttagaggttgtggagcgtcctatcctatagtagaaccaagatttaaccagccagtctctagcttggatgttagggtgttttccagttttcccactaataaatgcagcattgacagcctaacagctacatatctctgagcatctttgatgctttctgtgggttagattcagagaagtaggattttgggtccaaggaagtaggcgttaaacgtccttgaacatttgatacttgtataaagtctgaccagttttccctgacagattgagagatgcttcttggctattccttaccctcctctaggaatgccttgaggacagggacatgttcatccgtgtttggaagagagggaaggggagaggtgaagtcagatgaggacaggagggtggggagggaagaagagagcccctttgcaggcgttactcttcttgacctccgggctcctcccttctgactgtgaagtccaggccttcctctggattctctccatgtcagtttagtgggtgggagtgcagctgtggagccatgccatgtagctgcatgacctcagaaaatgctgaacctctgtgcctcagtttcctcatctgccaaatgagaacctgcctgcagttgggaatgagattgcatatgtgaaagctcccaatcaatagagctgtctctcgcatcgatactacttcattgccttcttgctgccaccgtcatgagcccaggctactagaacagcctgaagactggattggggatggggtcaggctctcctttccttccttcctctgtcccattctctgccatggaacctgcacacaggccaacacattgcttccttgcgcctatgtgactgctgggccctttctccaggagtgtccccagctgcctcgccagctgcctccccggtttcctttgcttccacccctcctaggtgttctgccatgccttaccctgtgtctgtagcacctgccagtcttcatccttccagttcttcagttctggctcagcttgcctctccttccataaagccttttctcatattgtcaccaaaaatgatttgtcgtcttcctcaccagtggaagcatttactgccctttgtttgcccttgacctaccaggtattacttaactgcagtgccttttgccgtggctgccgttgctctgggatttcttagtggagcagacgacatgcttagtgcttcacgtggtgtttcactcttcccgtgatcctacgaagagaaattatcatccttgttttacttaggaagaaactgaggctcaaagacttaaagagacttacccagggtcgtgccgcttggacatgacagagtctggcagtctccagggccacagaagcctggttggcctcagtggtttcaggtttctggccaaaggggcaatgtcagcttcacatccggggtttacattgggccagccaagatcctgaggcaggaccctggaacacttgctgagcattggatgtgaaaaaatactgacatcagctccaaggtggaggcagcgttagggagaagctggtcatgaggtgaaagttctgtgggtggtaaatgatgctttaaggctctttgtgatttgtaggggggaagcaagatccaacctggaatgcctgggcatgggccctttcattttcagccctgagggaagtgtcctgagaccctcacaggtacccagtgttgcagatgcctagaacttagtctcctggaggtccttactacatttcaggagagaggattgcagtcatttctgcatcagttggctttattctacaggttgtttttcacgaagatgacatgttcttctccacttgagagttctttggtttacagacactgggaggagtgtggtaaggcaggctgggcctggcccgctcagctcgcctcacccctgcagtgccgtcccttggggacggttgagggcctggcagtggctgttatttcactccttcttcttcaggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggtaggaaggaggatggctatgccttccccatcagtgtcctatccctgctggccaaggcttagtcttcaggcaccatcttggttggaatatggcactttctttgtgaatgatttaaatgtgcctggaatgcaagtaagaaggggtggggttctttctcaaggatgctggtggggatcaggggagagggcagttttctcactgggttatatccagctcataaaagctgcccgacccatcctagggtggtgacatgacaacagtctagcctcagctccccacgggcacctctctctgtccttgcctttatcatgaagcccaggggtggtagctgggcctaggaggactttaagggcccatcatcagaacacagtggcaacatgagaagggccagatttcacctaatctcaggcctcccaaggaagacaggtctactgagataaacgtcatgtcttgaatccccaaatacattcatggtggggccgaggcaggtgaggcctcttccttcgtaactccccagtagcatgtcacgtgggcactagtcgctctaccatgttaggaataacccttaaaattttaaggaaattgaatatttgaacagaagagttttagtaaagcaattttatttttgcgtagaggggtgtcttttgggctagctgttataagagcatatttgaataaagggcacgagaatttttatttttgactcaagttttgtttttgtattttttttattggctggggttgggtcatataatttaaactaattttggttggctaaacatttgatttttttagatagggtgggtatgtaaaagaaagtggagagaaaggggaagggggtgtttgtaatgagctagaaagtttttttttttaaataaggaaaggaatatgagttggtgttgataacacttggtactgaggcgtgtttaggcatttaataaaggcaaaaaggaaaaaaaagaaaaagtcgggggtactataaattaaaaaataaaagattgatcagattatttaaagaaaaaccccaatgtatcccacaaccatatctctacttccaccctgttttgtcatttcctctctcttccatttcttccttccccttcccccagacagttattgttcacctactctgtgccagctactgtcctaggtcaggggtcagcccactttttctgtaaagggccagagtgtaaatattttacgctttgcaggccatacagcttctgttgtaactgctcaactcaactcttctgtggtcacctgtctatgaacgaacaggcgtgactgtgctcctataaaattgtatttgcaagaacaggtgttgggttggatttggttcatgggccatagtttaccagcccttgctctagatgagggtgttacagaagtgaacgagacagacagggtcctctctgcctgtggcgctgagtgggagagtgaaacagggcagggtggtgaggggcactttagattgggctggttgagaaggcttctctgaagagtggcatttgagatgacaactgcatgaaggagtccccctgtgaaagtctcagccaagagagagtggccgatgcaagcagggatcctaagactcttgtccctaattcagccttgctatgccgggccctccgacagtcatgtggctgactaacttcccaagtctcccagtggggtacacagctgggaccacctcagtgcacaggagagaagtgtgtcccgcgtgtctagcgggaccttaggcatcaggataagagtggggtactgatgatacaaggtggtgctgagcacctgagaaagcagaggctgtaacctgtctgaggggcgtttcaggagcctgctctcccctggaaattggacctcagtgccccaccttgtggaggacaaggagctataattataaattaaactaaggtctgtgggttgttctccatcatcacgcatcccttaggctatcggtttcccagaggggaccaggcagggccacccttgtggcccccagcccagggaaaacagcttggcattctttttaaattttcaaaaaaatttttgtgagtacatagtaggtgtatatgtttacagcttggcattctgtccccaccactgaggtgctgtgtggccttggcaagctactgagacctcccatgaatcgtcccagaagttagtgcatgcgaagcactgagcacagtgcctggccgcagtgtatgctcaaggtcttcagctgctgttattatagattaagagcataaatcaagtcggcttaggccagtgcttccagaatttttactaatcagtgtgtactgaagattagctacatttgtgtgtctagccagagagtctatcttttattaagtaaccccccaaatttccctaacttgggaagaatatatgtttattttagaaaagatacagaagcctataaatagtaaagtaaaaagcacttatcccttgactcagatatataatcattactaacactttgacagatttcttcctagcttttttatgcatatgtatttattacataattgggattgaatcatagcatagtcttaaatcttgatttttttttcatttgacatgtgctgtgggctctttccatggtgactaaatgcttttcagaaagttgtattttaaatagctgtgtcatatctaattatgcagaagtaccatgatttatgtaatcatttatgtaaccatggtttatttttcacatttgttttcattttttgctattaaaattatgctggatgagcatctctctgcctctctctgcatatctctcatcatttctcttagattaagacattccaggtttacataacactatgttgtatcttgtgttttttttttttaataaaagaaacacatactcgttaatgacaataattctgttcttttctaggcttctagcagtgcagggaacttgggagtactcattcctgtaatagctgtggtgagtattcattaattgaatgataaaaactgcagatactgtgttcatgctttaagtgttgcctggtgacgcacagtaaattccttagaaaggtgcagtgttgaggcccctatgcctctagatgtgactgctgcagccatcaccagcttttccatgacagccccataggtgtgtccaccatggcacatccttcactccctttctccatgacctgcccgaaccccctcaaccaattgacaagggcacttgctttggttccctgccgggtggctcccaggtcctaaatctgactccactttcatcctgtgtctcatgcccttgtgactgatgctgggccagctccctgcttccatcccttccttggctccttcccacaagtgcaggcctggaagcctcttgtcggcgctcaggcctcggagctatggccccagtctccttcaggggacgttgttggcatggcgggcacagtccctgcctcctgtgtggcaccatcgtgttggagagcctgtttccatcctgtcctgtcccagcttgggtccgcttcttcccaaatgacttgtagaagttgtttttccctttcttcgtcactcctagctgcaagtcctaagcccagcacctatgttccagtatttattttcattccatattctctcccttccatttaaccaaccttctaggccatcccttgtgtctgccttacagtgccttccctcctcctcaccccatagtagtttgagtcttgagcacttgcatgtgtccccttcaccttgtacaccagaggggtgggcctggtggcagaactgctagggcagcctagggacgtggaggtcaggcagacaggtggcattgcaggcacagagaggcacctctcctggtctcattgaagtcgttcccctgctcacaccatctgagtgttcatcattattcccaacctggggacttctagggtgtccagttttggctggccgaggtagatgaaaaatagtaactgactggtttgccattatttatctttagtagtaaaatgtcatatgtcgcatgttatttatttatttttattttttattatattgtattttattttttatttttgagacagattctcactctgtcacccaggctggaatgcagtggtgcgaccttggctaactgcagtctccacctcctgggttcaagcagttgtcatgcctcagtctcccgagtacctgggattacaagcacgccctaccacgcatggctaatttttgtatttttagtagagatggggtttcaccatgttggccaggctggtctcgaactcctggcctcaagtgatccacccgccttggcctcccaaagtgctggtattacaggtatgagctgccgcgcccggcctgccatggtatttttcatggacacccccattggttgatttatttttatttttattgtttttgagacagggtctcattctggcacctagattggagtgcagtggcagagtatcagcccactgcagcctggacctctggagctcaagcaatcttcccacctcagccttccaagtagctgggactacaggtgcacatcaccattctcagctactttttctatttttttgtagagatagggttttgccatgttgcccaggcttgtctcgaacttctgagctcaagtgatctgccccacttcagcctcccttagtgctgggattacaggcgtgaaccaccatgcctggccccattggttgatttttcaaaacagaaattttcccactgtgtagctaatgttgagtagtgtatgcttgtgtgtttaaagtgctgttgtatgtgggccttttatgtggcctggagggaaaagtaaggggcatgaagcccaagccactctgttggcagcaggctctgcaggagagcaagttttaggcagatagggaggatgcttagggcaacactaaaatcagtgagttccaggatctttgaccatcagaacttgatgacctgtattcttgtgaactttcaaatatgttgagcagttgtcatttagagcttaatatatgcatagtggaaatctgtcgggcactttgcactttagggaagcagtgagtggtgaggttggttgaaattacacaaatttgagggtcacagggttccaggttggactcctggtcctacatgtgggatcgtgtgtgagcctgcgcctctccgggctgctggggtgggtggtacaggcagaactgttatctgtgatagcttagcacatgctcatttaaatactcccctgatgtgacctcttacatgagaagaataagtgtatttttagtgaaagttaatggttatattatggaggaggaaacaaatatttgattttattgctcaacaaagagcacagagatcatgggtccttgcatttactttatggttaccccttggaccttctggaagaaactaatttccagaggtggttttttttgttgtgtgtgtgtgtgtgtgtgtgtgtgtgtgtgtgtgtgtgtgtttgttttttttaaatttttttatttttatttttatttttgagacagagtctcactctgtcacccagactggagtgcagtggcgtgattttggctcactgcaacttccatctcctgggttcaagctattctcctgcctcagccttccaagcagctggaattacaggtgtgcaccaccatgcacggctaatttttgtatttttagtagaaatcagtttttgccatgttcaccaggctggtctcaaactcctggtttcaagtgatccacctgcctcagcctcccaaagtgctgggattacaggtgtgagccaccactcctggcctacttattttattttttaaaagaaagatatactctattttgtatatagagtatattctgtgacctttgatgacacagtgtctcagattactctgttgaatggaagtaccagtggatttggggcaggaagcctgggttttggccctaatgcagctgttctcagtgactttgagggagttgctaggaagctgggtcatacaatctctgaggctccttcctggctagatttggtgatctttgtaccgcaactttgtgaataatatttcttcagagatatcattgattaaattacttcagttgttacttagcttgttagttaaacgttttgaatggtatctaatgcttagagacttagttgttccactgtcatataatagtgatttaataagatgcacctccttctggaaaaacattcatgtatttcactgagagcaagtttacttgtgtcaccagtcacttttgtggccttggaaggtttacttattttctcagtgcctgcaaaaccaggtgtgtgtggattaacatgttttaggtcacagagaaccttttcgaaaactgtgcactctctgtccatggaaatccttattactctcaagattttgcatgtaacctcaggaagttaaatggaagcaatctacccaaggctccccagttaagaaggcctggcttatgtactctcttagattgagaataatgtgacaacctttcctagttcttgctaaaaccaagcagtgatctaaatgctttccagaccaggcatggtggcttacacctgtaatcccaacactttgggaggccaaggtgggcagatcacctgaggtcaggagttcgagaccagcctgtccaacatggtgaaacctcatctctgctaaaaatacaaaaattagccaagcgtggtggcacgtgcctgtagtcccagctactcgggaggcttaggcaggagaattgcttgaacccaggaggcggaggttgcagtgagccaggattgtgccattgcactccagcctgggcaacagagcgagactccgtctcaaaaaaataaaataaatgaataaataaataaataaataaatgctttctagacattaatttgattaatcctcacagcaatccctcaaggtaagtgctgctggtctccccattttacagatgaggatactgaggcacagaacctgctactagagtttcatagctactagatggcagagccaggattcaaaccaggcagcctggctcagagcctgtgttctgaatgagtactctcctgctttgagtaacagatgggctagtttctgtaagaggggatctgagagattctgagtgggtgtacatgaacaaaaggcattgaaacgggggtgtctggatgctcaagagtgtggaggactccacaccggctgtagcagagagggcgctgggtgagcagaagtgaccactgcctttctgggtatgggacagacatggcaaaggactaaaagggttttttgagattattacatttagaaatgagaagagccaaaaggaagctgcagcaagatgagaaatataggacaggcaccagaaaagaagagtggtgaagcaggttggagaatgacagaaaagaagagtggtgaagcagtttggagaatgacagaaaagaagaggggtgaagcagattggagaatgaattgaaggagtgggccatccgcagcatcagggttcaccaggaagccgagaggatggcttggggcaattcatccagcccctgcaccatctgctctcagcagagtaaggaggcagagcccagtgtgggaagtcaggaagggagcaggggaaagcagggctgcagggtccccctgcctgggtgtggattcaggcctcaggcagaggccttcccttctgtgagctgaaattgcttctgcagctgtaaaaaggaggggtaacagtgccagccccctagggattgagggtaaggagactctgtgagataacccacaggcatgcctacaaagggcagtgacgttccccttccgtccctactcccttttaccactcttcttactggtattggtctcatggggtcagaagcctgtgacaggactccttgtgtggtccctggagtccagccaacctgcacttgaacccagccccactacttcagcatcttggacaggtttcagaactcttccaacccttgtcttcctcatctgccaggctgtgggggttacagttagacacctgcacacacagcacctgtgaccgtcagtcatcccctcactgaaagagcactggcactcttgcgtgctgaacagcctctgtggatttcacttgtcttacccagggattgaaggatccagaaacatattcctcaggtgtcatctgctctgtcaaaccagacccactgcaggaccaggtatgagggatgaaagctgcagcagcctggcatagactgtgggagccctggggcttgtgtgccacttagcaccccacagttctggggtactgcacagaccctccccaggattcagcacacacctgtcctgtcctgagaacatgccctgctgtggcacattgtggtgctcaagtgacttcctctcagcctttatcatacctggagttatccaggaatttggatttggcttttgatatttgagcttcaaaaaatagagaattataacagatacacagtaaatgtggctacatttatttatctctagtatgggagacatggcacacactgtcctccaggtcacagggaggcaacagcaggagggactgatggcattcatcatggatttgaaaggtcaggctttgagaaaattaagccctaacattagcccagggcacccctcatatgtcttgaggtggcttcttccctggacatcaagaatggtgctagttgtgtaccctccttgggagaggtaaggaattagtcacaccactcatttctgtgcttggtattcagatgaggggcctggtggagaaaggcttgagtgacagagtcaggtgtgcaaggatggggtcaccggagcgggaggtgcttaggacgcgctgctcaggtttgctgtgaagagtggggaggtgagaccctctaggtaacagcagacacactacagttacagtgacttctatgagcttacagcatgggctattgtgcagaattgattccaacaagcctctcttcttggtcgtttctaagctcctctcatatgggcctcgaattcagattggtagcgtaaactacgtaaatgatgccagaacatctctgttctcgttgttggaatggaaacaaaatgagggtgcccccaaggcacttcagacacctagacctccacctctaggacctgctggggttggccactcttcccatgaagagcaggcagctggtgcgatgctcgtagatgaggaaaagaaaggggcggtcgacagtgaagcggacttgggtggacagcggcatgaaccccaccgtggtcacagtggtggcttgggtgccttcctcgttcactgtgatcgtgccttggtgcttgaactgtttggaaaggaaagttgtcagattctggaggtcagcacacagagggctagagttcccagcacaatctcatatcattcagggaaaggatccaaagacaacatgtaaggtggaaatcacagctggtcagagtcactcttgaaaatatctgtcaccacctgtcaggggcagccgttgcacttagaggccggctaggttcatgttccctcttggcagtgcctgtggtctgagggtcgtgggggctggtgcaggacagccaccccagctccagctccccacactgctgcgcacttctccgggatggggaactgggtctgctgcactgtttggactggtgttctctctcttttgctgagcgcccgattggtttaagttaagtatgtgtatagtgcggtgtttaatggctctttcatgatttggctgggggtagctatttcccagaccgcagcacatgtctcccctgtctctggtgtcagcgggagtggggctcaccccatggctgctcttgggatcccccctgcccagtaagtgtctgccaggtgccgtgctctccagctggcatccatgaaactaggcattctgtgtatcccacccaggccgaagagcagactcagcaccccaagctgggacatgagattggggggtgggtaggaagggcaagtggaggtggggctgtgctgaggcagaccctggggacgggtcgggggtggacaagggagtggttaccaggtcgatggcgatcctttggtctgagatgcctgccatgttgccatttttgtcaaacagcatcctgatccccatcaacttcagggactccactagattgtagttcttctccagcttgaatttcggcagaagcacttctcgagttctagacagaaaaggaaaggggggcccagttttattgaaccacaagttacaaaagaatcatgattttccctttaaagggccacgggttatatttatcacagaattgatatagcacttattaaaatttatattccgggactgtcagttgaggattttaggaagcacactcctttgtaattccgctactgaaaactgaggtgtgttttctgttgcatgattatttccttgagactgtatggttcgtttcctatcttcaaggttagcagcagaacttttcctggtttatggtttaaaaaggcatctaaaataattctctggtttggtttcccaattttaggcatttggttttttttttgtaattaaggagtcgaatatctggtagtgtacttttaaaaagaacctttcctgtatatactagacaatgctgaatattctcaatctttgcctcaacttactcaatccctaagggggcggatagcaacagtagtgcctgtggagttagtctggcactttgcaggggataaagagatttaaggtgcaatcccagctggatgggcaggaaggcttgatcttcttcactcttttacctagctcataccttgcaccaagtaagatctcaattaaaagtcaaatgggccaggcacagcggctcacgcctgttaatcccagcactttggaaggccaaggcaggaggactgcttgaggccaggagttcaagaccagcctgggcaacacagcgagacctcatctctaccaaaaaaagtttaattagctgggcatgaaggtgcacgcctgtagtctcaactattcaggaggctgaggtgagaggatcacttaagttcaggaggttgaggctgcagtgagccatgatgatgccactgcactccagcctgggtgacagaacaagaccctgtctcaaaaaaaaaaaaaaaaaaaagatgcagtccctttctcaagagctgccgggctgcagggaggaatggaaggaggcaggtacagaagggacgttgttaaggaaaaattcacagagcatgatgactggctacccgggcaaataccttcctctgagagcctacttttctcagtttggttgcatatgtttgtattcttgtcctataaggaggttcaaaccagaatcacttcttcatatgggcctagccagtatccagtaagacagaaataagacctctccattctttctgccatgacccaataataatctcaataagtacttaacacctgcagttttaactacaaagtaacgaataataatagaggaaatcatgaatgatgtgtcctcggtaggctaagaggaccttggaatttcctgggcagggaagagttgagccaatctttttttgagtgcctcctaggttccaagtactgggaggggcgctcagcatcgctgattctgttattttctcaagtgacccggggaagtaatggaattatacccattttagggatgatgaagctgggactcgaagccacaaagcaagcaccaagctgtctctaagtcatctgcctctaacttctgaaactggcccctagagggcagatgtgtcccttatgaatgctctctaatcatctcttatctcaagcaacaaattggggctgaattaacagagtggccctgtatggaagttcttgggtacttgtacataattctccctttttaaaaaaatgatccattttccagtattcccagacacccccagcatctgggagctcaaaagaacaaacacacagtgtgaaatacctgtttgtcatgcttttttgccatctctccaccacccggggtgtcagttgcgcttcgagggtcttcatcccagacatcttgtgtgggaccacaattagcatgctgatgccccccacgtattccagctggaggatgtcgcagtccagctcctggtcatttgctgcgaggaagttccccttggtctgcatcatggaaaccttaactacctctctctcattcagccggaagttgtggttgtgtgtcatttccactgggaatttattcacccaggatcctgtaaaggccacaggaagaggctgttatgagaaggttcctttagggaaatcgtctcacccttgagagtgaatctgatttccctggaggcctcattcagatagcctgcagagccgaccccacagtctcttgattcctgaggcctgatttgggcagaaatttgcatttctaacaagagaggttaacgagaggttacccggactggaatagtttctggagtagggtctgatacgaactagttgtttgaccatggtaaggcacctaactcgcttctatttcttcatctgtcacatctgtcaaatgagtaactttgagctctttccagcttttattactgttattattatttggtttttgagaccaggtctcactgtgtcatgcaggctggagtgcggcgatgccatcatagctcactgcagcctcacactcccaggctcaaggaatccttctgcctcagcctccctccccagtagcttggactacaagcacatgccacgcctggctattttttctttctgtctttttttttttttttttaattgtagatggggtcttgctatgttacctaggctggtctcaaacccttggcctcaagcaatcctcctgcctcagccttccaaagcactgggattataggcatgagccaccctgccagcctcagctctgtcttgatggccttcatccctcacactgtgattctgtagtgactaacaagacatttgggtgatgccatgttgcccttaggatcaccactgtagatatggggacagtgctgtgtatccaggaataagcccatgtctatgttagctctaagatgtgagtaactaatagtaatgggtgactagtagttgagaactggccatgtgccgggcattcttctcagcacctttcctgtattatctcatttctgctcctagcaacatgcaagttgtgtgcgttttgttatccctcttttacatatgaggaaacagaggcacaaagaagtgaagtaacttgttcaaggtttctagctggtgggtagagcagccaggatgagatgagcaggaggtgtcttggaggttgaagtaccagacagctcctgcctgcctgtgagtgaagctcgattcccttctccctgagtctgcctcacccagggtttctcaacctcagcatttttgacatttgggccacataatagtttgtggcaatgtgggctgccctgtgcatggtagggtgtttagcaacatccccagcctcccccttctagataccagtaatgcttactccaaccccccaggttgtgacaaccaaaagtgtcttcagaccttggggacaaaattgctcttttgggaatcacggccctttcagtttggatggagctgtcccatgtctcttgggattctttccttctgacttcctcatgagagcctgcctctgtttattgtgctttacaaagtgattatcacattaaaattagaacaaaattagtaatggagatgattccatatgaaattaagtgaaattaaaattacacttctagacactcgtcccctttgagaagcatccatgaatgattgggtactcctagcatttgatcccttgtgatgcccggcattgagtgactattctcatgatggggaaaggaagcagaagcatttgcacgtgtgtttacactgtggtatgacacgggttactgtgtttaggagattgtcaactgaccatgcctgatcatttctccacctccatgcaggcagggatggctcactgctgtacttctctgcctgtccctgaaccctcagccagggctaatgcagaggctctttggtgtacttggggggctccaacagaccagtaggttggaggactttgatgctgccaaaaatgcttctgccagcctgttctaaagtcagtcctaaacataggttatttgctagtagaagtaaaataaatgtcactaacaatatcatatgtttatcatattgtactagtattgtaatctacagtttcattccctcaaattcgctgagctcttgtcatgtgccactctgttgcattgccatcgcttatggttcttccctcggccctgtcagagtgggtgtcatctctgtgataaagataaggaaactgagtcatagagatgttgaatgacttgtctgaggtcacacaaacgagaagtggtgaaaccagcgcttagactcttgtttgctcaattccaaaacttgtactaataacctgtaatgaaaaggatatgtgtgttcatcatgtacatgtggtctctgtgtgtgtgtctgccgcaagcctgttagaactcagcctttgattccacccacaggaggccagcattgtgccatgccttggggtggaaacctgggtgtcagagtgaccctgcttggcctatccagcagaatgcctgccttgtagagctgcaggggcctcagccaaggcacagagcaggtgtgtggacagatcaggaggggctctggccccctttccctgaacagaagccaggagctggggggggtctccttccttcgcctgggctgctataaaaccacgggagctaactagcagaaagcactggcctccaagtactgccctttgcaggtacctggtagtccttggtggcaaagagaagtggttgtgtgtcaccgcaattagtcctgaagccgaaccattcctcgtgtttccccttccacactctcagcttagagagtaaagtagaggtttcttctggtctggtccaggtgaggatatttgaaaagagaggtttggattttacaaatccatgcttatttattcctaggattccaggggtcctatgtgtgtgtgatgggtgtggggtgacctccttaaaaagtgcccttgtgctcagcccagaacagttgctggggaaatagtaatttatttctccatcccacctgcccagtagttcaaaagtatcctgaaaagcacttgtaggtgtcaatgtcagctgctcaagctgaatagttcacaggtgcatttctttagccttttgtctatattcctgcttattgataattgggaaaggaaaagagaaaactcaaatccaggctggccaaatgctaaaacagtttttgtattatttcttccaatttaacagattgctagggttggcctccctgggttcagctttggctctgccccttaataactgggtgcccttggagcatcgttttacttcttttttttttttttttgagatggagtctcactctgtcgtccaggctagagtgcagtggcacagtctcggctcactgcaatctctgccttccaggttcaagtgattctcctgcctcagcctcccaagtagctgggagtacaggcacccaccgccaggcccagctaatttttgtatttttagtagagccaggttttcaccatgttggtctgttggtcaggctgatctcgaactcctgacctcaagtgatctgcctgcctcggcctcccaaagtgctgggattacaggcgtgagccaccgcgcccagcccatccttttacttcatgtgttggtggcttcctctgtaaaatggggatgctaataacagtgatgacctcacaaggctgtgttaaagcacagagttagggctcagtaagtgtcagatgctactgtcacttcagcttggccttccctgtccccgttccagagtcaatcttgtgtctagttttcctggataaattatagctacagtacagttcttggcattcaatctacccacatacaaaaatagtatgttgtgggtttgctgtgagaactgtaaaggtgcctcttacctttgaagtagatgcagttgagaatcatcatctgggtagcagggtctatattctccagagcatcttttatgaggcccttggtgagcttcatgatgtggttgttggtttttgatatgaaggcagggtctgagaagtcagctatctgggcctcagcaaagtaatactctcttactttagttttgaagtcaagcaggattggaaactgcttctggatataaaggtcattgactgaccgcagtgtgtacccaaaattcctcctgaagaggcgatgagtcagcttacggaagagattatgaatggtcgtgatttcatacttgctgctggcattaacaaagtctttaaaatgcaaaatcgagtgcacttgttcatgggtctctcccttcagacctaaggaaatcatacccatcgcagtagaaatgccaacgggtgctatgaagatgttatcgaaagtgttgacctggtctttcagcactcggtagaggttgaaagcgaacttggcgttgaggatgttaagacgctggatccggctcttgccatgaaaaagctggaggatgttcccagcactcacatcagagtctgtcggggaaactgacagactgtcgacgatgtcgatgtagtcgtcgtcttcactgaatatcttctccaggtccagatagtcgtcgtcctcctccccctctggaatccagtcgttggtgacggtgttttccttgtggaagtcggcagggagaagaggcatgctcaggtttttgttatttaactgctcccactggggatctgcagactgagcagtttcccctcctttctctagctgatccagcgggcctttgctcccaccccacgcagatgttatgatgaggaaaatgagaagtgcgtttaatgagtgtttcattttggcggagctaaagctgggagggaaaacagaacacagtgaaaggcggcctggctgatccacaccccgctgcagcatccacatggcaggttccctgtggctttgacccaggaagaggccctcacagcattagttcttaactgttttaggatcatggactttaagagaatctgatgtagatagacacccaacctttgatgtgggactcataaacctcaatgaaggatctgtgggccccttgatgaaaatcccttctttaaaggtttgcaaaactaaccttctagaatcctgggagctcaggcatcccagggaggagtttgtttttctccagacaccttgtccaccacctccagacagtgtttagttaccagagacaaagttcccaccaggggctcatggaccagtcaggggacagatgggacagacgtgcagtaaagcgaaggctctcaaaataatgctgccagagcacatgggggtacggaaaggggtgtggctctaccctgtgtggtaggagtggaagtgcccagagagtcagggaaacctcactaagagctgggcttgagtgggcacctggggctggtgattggagagtacctagaagggatgtgcattagtgggactcagccatgcctgtgtgactcacaccattccacctttgcaatggagatgctgttgaaaaatgtccatgggccaggctttctgaaaacatattctaaagatacttgaaatttgtgcaatctttggggttgtttaattcgttgtttttttgttgttgttgttgtaattggcttttgttgtttttattttttgaaatggagtctcactctgtcacccaggctggagtgcagtggcgcgatctcggcttactgcaacttcggcctcctggactcaagcaattctcttgcctcagcctcccaagtagctgggactacaggtgcacaccactacgcctggttaatttttgtattttgtttagtagagatggggttttgctctgttggccaggctggtctcaaactcctgacctcaggtgatccacccacctcagccccccaaagtgctgggattacaggcataagccaccacgcctgacctggggttgtttaatttgcaaaagatttggaacttgtctagtgctgagaccccctcagggcgtagtgaggtgatgtggtggcagccccagaggtgatatcacttgctgcaggtatacttttttctcctttgtatctcttagacaatagctcccactgctgtcaggagcaactaaatcttctgtgttactgcttctaacacagggttagaaacaagagataaagtctgtgtgagggtgatgtcagcaagctcttactcaagacctgaggggcactccctttatttaagtaaacaagataagcttttagcacagaggcattatggcaatcctgtctttatttgttcctctgactcgttcagaggaggatctgacttggcctgtcaaatctgttttgactgccaaatcctttgtctttctcttgcttacttcctggttattaactgcactctggttagatgagctttgatgattccatgttttgccaggacagtgaccataggtgtttataatgctgactcagacaggtaatacatggtcccaacttctaatcaccccagaaagaactgccggccaggcgctgtggcttacgcctataatcccaacactgggagaccaaggcaggaagatcacttgagcccaggagctcaagaccagtgtgggcaacatagcaagacctcatctctgtgaaaaattaaataaataggctgggtgcggtggctcaggtcagtaatcccagcactttgggaggccgaggtgggcggatcatctgaggtcgggagttcgagaccagcctggccaacatggagaaaccctgtctctacaaaaaatacaaaaaaattagccggcgtggtggcgcatgcctgtaatcccagatacttaggaggctgaggcaggagattcgtttgaattcaggaggcagaggttgtggtgagccaagatcgcaccattgcactccagcctgggcaaaaagagcgaaactccgtctcaaaaaaaaaaaaaagaaaagaaaaataattagcctggtgtgatggcacacgcctgtggtcccatctacttgagaggctgaagtaggaggatcacttgagtctgcagtgagccgtgatcacgccactactgcactccaacctgggggatagagtgagtccttatctcaaaaaacagaaaacaaaaaaaaaacaaaaaaaaactgccttttgttaagcttattttgtgtctgtgaccatttcctattagatagatatttgaggcccagaatatctgctgccagttgaggccaggtaagagttactggctgctcttgttaagcaaatatttgaactcagtaggcctgaagatggggtaactgttcggatactctgcttgaaatgctgtcagtgtggttaatgttgataatggcctctgttggatgcctgacacgctgtataaggcacttcgtgtaacttagtttcatcctcccaacattttatatatcaggagactgagcctttcgtcactgtcactaataagtggcagtggctagattcgaaccaagttggttaagcctctaagccccacatcaagcgctcagccttgttcgctctggagtaccaggatgcttccagactccctggccgtgcagagcagcttcctagctgttttcccagtgccagtcccattccttgggtcttccccttataatactgttgaaatagtaagttcaaagtttgttttagtcacaactaagaaagacttttgaattgcacattttggagcaggaaagtcacattgtttctgactcaaaatgcctgttgccttttccaggtccccatctcagcacctgcctcaggctgcagtgccactagtttacacacgggaaaacagtttctagaaacgatttctttttatttttattttgagacggcggggtctcactctgtcacccaggctggagtgcagtggcacaatattggttcactgccacctgttcctctcaggctcaagagaccctcccacctcagccttttgaagtagctgggaccacaggtgtgtgccaccaaacccagttaattttttgtgtttttggtaaagatggggttttaccatgttgcccagacaggtctcaaactcctgagctcaggcaattctcctgccttggcctcccaaagtgctggaattacaggtatgagttaccatgctcagcctctagaaatgatttctaatgtatgtagctgcaaatagaactgggcccagtttctgaatggcactttgagtaacttagcttcatcctcccagcattttacatatcaggagactgtgtatcaatagcaacacacttttaaaagtcaggaacaaagaaagtaagcagctggtagaaggctccttgcccaactacacttcaagtgtcctcctcttatcacttcttggccttttggctaagatcaagaagaagaagaccaggcataggggctcacacctgtaatcttagcatcttgggaggccaaggcaggaggatcgcttgagcccaggagttcaagaccagctggagcaacatagcaagacctcatctctattttaaaaaagaaagccaaaagaagaaggaacaaagggggaaaatgttttcttctcagataaaaataaggttaaagaacaaaacaaaaaccaacttgaataaataagcattcaggaaaacgtatctgaggccagatagagtggcagagtaaagacatgcatgttttatcccggtattcagaagttatatttggaaacttcttataccctgttcccacattatctgataaaaagccaaaaatagttttcgtcattcccttaccagaggaaggagaaaatatctctgatatcttttatggattgaaattaaagatctgaaggtaaatcttcctgatgttttgctatttagtataacaaacattgtagaagacgtttaaaaactatcactaggttgtgattaaatccagattactgtttgaagagaaacaatatattttaaagataaatcattcaaaagtttgttttgctttttttttttcctgggaacttcatattgtgctttcttgctaattgccagagctgggttggccttttcagtcacgcatcagagcataacacttgataaaccgtcatccctcctggtgtatggtctccaggcccaacagagcaggcagaatgggagagaagtaactgcctaaagtttggaaaactttttattttgaagtaagttcaaacttccaaaaatgttgaaagaatagtgtagtagaacaactcctgtatacccgtaccgagatttaccaggtttaaaattttggaacctttgccctgtcattatctgtgtgtgtgtgtacgtacgtgtgtgttctcacaggcatgcacatacacattttttcttctagaccatttgagagtaggtctcctatatcttgttcctctaacattttttcttttttcttctttttttttttttttttgacggagtctaactctgttgtccaggctggagtgcagtggcacgatctccgctcactgcaacctctgcctcccgggtttaagcgattctcctgcctcagcctcctgagtagctgggattacaggcgcgtgccaccacgcccagctaatttttgtatttttagtagagacttggcttcaccatgttggtcaggctggtcttgaactcctgacctcgtgatccacccgcctcggcctcccaaagtgttgggattacaggcgtgagccactgcacccggcccctctaacctttaatactaatacttcagggaaaatacccaagagcaaggatattctcatacataatcacaggacagttatccaattcgattaatttaatataagtacaatattttcatctattccacagctcctattctaagtttgtcaactctcccaacaatggaactgacacaattttataataggcacactgaaaaatgaaaccatttcccacttctaaaacagtgtagaaagcttctgaattcttagtttgctagaaaaatgaaccagttgcctatccgtaaacaccaaaaataatttataatcagcagaaacattagaaacccaacttacctctgtgtttctgagaagtggcgcttcagagatgaaagcagccaaggtcatcagtgggattttgatgtgaactttggtgctgggctgttgctgcatattttccaaagtaaataagtcccaatccaaacaccaggcaaccagcttggtcagcacaaaccccctcagctgtgcctttgataactgtagagtggcttgcagctcctcatctccagttcttagagctgacactttgagtatatgacggttactgtgttagcatgcacacatagccttggtgcaggagcagcccctcttgaggtcaccacataaacaaggcgctcttcaggcctctggggaccaggctgcattgagggtagctgaaagtagagaccatgcatctgcctccaactgtgtcctctcttctgggatgatcacagcatctgccctccacctgctctccaggactgatgtggctggctcagctactaggcgggtgtccctgtccttccaagagctcgttcctcagtgaaaggtggaggagagaggacaaaattagtggcttacagaataaggggattgtggcatggacctttcttcagtcaagggttgctgtgtttgttgccagtaggtgcagcccagcactcctgtctgttgtgggacagataggactattactgagcagtgcctcccaaattcagggccacttaggcattcgtggggatctctgaggctgtgatacattttgtgtttatgggtgtttgtttgtttgtttgtttgttttgagacagagtttcgcgctgctgcccatgctggagtgcagtggtgcgatctcagctcactgcaacctctgtctcccaagttcaagcgttctcctgcctcagcctcctgagtggctgagattacaggcgcacaccaccatgtccaactaattttttgtatttttagtagagacggggtttcactatgttggccaggctggtgttgaactcctggagtgaagtgatcctcccgtctcggcctcccaaagtgctgggattacatgcgtgagccaccacgcctggccctatgtgttttttgagacagggtctcactctgttacccaggctggagtgcagtggcgtgatcttggctcactgcagcctcaacctcccgagctgaagcaatcctcctcacctcagccctgcaagtagctgggaatacaggtgcacaccaccatgtctagctaacttttgacttttttgtagagacagggtctcactatgttgcctaggctggtcttgaactcttgggctcaagtgatcctcctgcttcagccttgcaaagtgctgggattacaggcatgagtcactgtgcccggccttatgataatttgttttttaatttgtgttttaaattttatgatctaaaaagttttaagaatattctggattgtctggaagatcagcttatcacagagactgctcctcaagagcatgtttgggagtgtcggcacccagagtctatctgaagagagaatgtgactcctaggagaatctgcgggtgtgcaaggggcccatgggggtgtctgtgcattgctccgtttgagaaattccagagtgtaaaggtccattgtgttcaggacacagaccggtggttgtgtctgagtctgattttgcactctagcttttgtcagagctgtcttcttagagccttcatctgtcacatacaatactgagtcttcagcgtggcaccacaggcagaggctgctgtctgtgcccacactcctcgtgggcccacctccctcattctctgtcttgttctcacacatgcaaagcccggccccagcacagccctggcacttgctattctttctgcccaggacaccatccctgcagaccagcaggtggccgctgctctcactgttcgctcttggtttcaccgaggcgtcaccagccaccctggctgaaattgccccttggcctccagctctcagtattctgctctctgaaatgagggtgacagttacacctactgcatgaggttgttgtgaaaattaaatgagatacattaatttatctcattaattaaatgagaaaattaaatgaggttaatgaatgtgtggaaagcacatagagtggtgcctggcattcagaaaatgttagtcctcatcatttcatggtattacatatttattcacagaaatggtctgggaggggacacagcattcatttttcattctatgtacttctttgtttgacctttttctatgtgtatgtattacttttgttatttttaaagccagtaccggccaggtgtggtggctcacacctgtaatcccagcactttgagaggccaaggcgggtggatcacttgaggtcaggagttcaagaccagcctgaccaacatggtaaaaccccgtccctactaaaaatacaaaaattagctgggtgtggtggcacacatctgtagtcccagctactcgggaggctgaggcaggacaatcgcttgaacctgggaggtgaaggttgcagtgagccgagttcatgccactgtactccagcctgggtgacagagtgagactctgtctaaataaataaataaataaataaataaataaataaagccaacatatttcctgtctatttggatttctgatcatgtaacccactattggaaaaatttgatttcagtccctcttgacattgacatttttcagtcattttcccatttagtggtaacagcttgtgtatggcttttttttttttgagacagagtctcgctctgtcgcccaggctggagtgcagtggcgcaatctcagctcactgcaagctccgcctcctgggttcacgccattctcctgcctcagcctccctagtagctgggactacaggtgcccaccaccacgtctggctaatgttttgtatttttagtagagacgggtttcaccatgctggccaggctggtcttgaactcctaacctcatgatccgcccgcatcggcctcccaaagtgctgggattacaggcgtgagccaccacagcttgtgtatggctttaaccccactgtagagcagtacctcctgtcacacatactccattgttcttttgcagtttcaaggtttgtcttatggctagatattttttccaacttggaaaaaaatttttttagttagaaaaaagcggggtctcactatgttggccaagttggtcttgaacgtctggcttcaagcagtcttcccaccttggcctcccaaagagctgggaagacaggcgtgaactacctcatccagacttttccatcttttaacatgaaattctaaaaatatacagaggggtcaggcacggtggctcatgcctatcatcccagcactttgggaggctgaggcaggaggatcactaaagtttggaaaactttttcttttgaaataacttcaaactttcaaaaaagttgaaagaatagtgtagtagaacaactcctgtatacccgtacccagatttaccaggtttaaaattttggaacctttgccctgtcactgtgtgtgtctctgtgtccagcttgtgtgtgtgtgtgtgtgtgtgtgtgtgtgtgtgtgtgtgtgtgtgtgtgtgtccgtgtccagcttgggcaacatagcaaaaccgatctctctctctctctttttttttttttttttttgagacggagtttttgctctgttgcccaggctggagtgcagtggctcaatcttagcttgctgcaacctctgcctcctgggttcaagcgattctcctgcctcagcctcccaagtagctgggattacaggcgcctgccatcatgcctggctaatttttgtgtttttagtagagacagggttttaccatgttgcccaggctggtcttgaactcctgacctcagatgatctgcccgcctcagcctcccaaagtgctaggattacaggcatgagccactgctcccggctagcaaaacccatctctaccaaaaaaaaaaaaactgggccatgatgctgcacacctgtagtcccatctgctcaggaggctgaggcagaaggatcacttgagtatgtacagtgagctatgattgtaccccctactccagtgtggtcgacagagtgagaccctgtctctaaaaaaaatatgtatacatacacagagaaattggaataattgaatactaaatatccatacacccacaacctaggtagaatagttaatatttttccatatccacttaaagacatcactcacttctgccctgggcactagcaccagtgtttcttccatggacgggtctctgccctgtgctgtgctaccatcactcctgggaagatcacaagcctcacatatatcacatgtctagtccaagtcagattactctatgacttcaaacatgtattttatgggtttttaatttttatctggtcagggtttcatgtgtcgcatttgactgttatatctctttagaatcctttatctatttcagtcttcccacttcccccctgaccttgatttttttttttttttgaaatggcgtctcgctctgtcgcccaggctgcagtgcagtggcgcaatcttggctcactgcaacctcggcctcctggtttcaagcgattctcctgcttcagcctcccgagtacctgggactacaggtgtgtgccaccacgcctggctaattttttgtatttttagtagagatggggttttaccgtgttagccaggctgatctcgatctcctgacctcctgatctgcctgtcttggcctcccaaagtgctgggattacaggcgtgagccaccacacctggcctgaccttgatacttcttaggagtgagcagatctcctttctggagactagagcagtctcagccaagacagtggccagcaggctcggagaagtcagagagcagggagaacccacagagccactttcaagccaacgtcctcaagagggagccaagaagttcacagggtcaggagtaggatcccaaatcaaagatagagtccacttacttcctcttttctgtgtcaaaaccactttgaacttcccagccacgtggagctactgttctcattgagagggaagcattctagaagcgcaaccctttccataaccaccaaagtctagttctctttagaaggtaccagaacctcttagccacataggccttgaattctgtagtctggaaaccccttcatatctccaccatcacttgggaccttatcctgggaggccggtcacttcagagacagtcagtcccacagttgcgtgttcttactgtcactgtccttggccactagctgaactggaagccccttgtcaactgtccttttgtggccacatcctgtgtggctctagatttcctgccctgtgtcgcttccgtctgctgctgccctccacacagccctctccaaagtgccccacctcctcagcacctacccagagcctgccctgcacccccaggtcttggcccactcttcccaaggacacagtgccctggcggctctcaagcagaggtgtggagccttcttccacacaggttgccaagccctggaccggcacctgcaccctccctttgattgtaaaaggaacatgttgatggaagagctccaggaaatatagacattaaagaagaagagtgaaatccctagcaacccagaaataatcttaacatgtggctgctttttcccatctttgttctatatgtatatatttagattttttaaaatctatatcatattatttatacgttttggatttttttctcttgacatattgtgagttctacatgtgtcaccaaatagtcttagaaaatatgattcttggctgagtgtggtggctcacgcctgtaattccaacacttggggaggccaacacgggaggatctcttgaacctaggagtttaataccaccctgggcaacatagtgagagcctttctctacaaaaaaatgtaaaaagtcagtaaggtgtctgtttgtatgaaaaaaagaaaaacaataattaagccgggcattggccaccaccccatctgggaagtgagtaagtagcacctctgtctggccgccgcaccgtctgggaattgaggaacacctttgcctagctgccgtgcagccctgcaagtgtgaagtggcagctttgcgtgtgatctttctcccctccccaagtttgcatttttgacattaaagtttacttttaaattaaaatttttgaattggaaataataataataataataataataataataataataataattaggccaggtgtggtggctcacacctgtaatcccaggactttaggaggctgaggcgggcagatcacttgaggtcaggagtttgagaccagcctggccaacatggtgaaaccgcatctctactaaaaatacaaaaattagctgagcatagtggtgcatgcccgtagtcccagctactcaggaggctgaggcaggagaattgctttaacctgggaggcaaaggttgcagtgagctgaggttgtgcctcggcactccagcctgggcgacagagcaagactccatctcaaaaagtataaataaaataataattagctggacatggtggagcacacctgtcctccctgctactgggaaggctgaggtgggaggatcacttgagcctgggagatcgaggtcagtgctgcagtgatgattgtgccactgcactccagcctgggtaacagagtgagaccctatctcaaaaataattaatttattatactttttttttttttgagacagagtcttgctctgtcgcccaggctagagtgcagtagcgccatcttggctcactgcaagctcaacctcccaggttcacgccattctcctgcctcagcctcctgagtagctgggactataggcgcctgccaccacgcccggctaatgtttttgtattttttagtagagacagggtttcaccctgttagccagaatggtcttgatctcctgacctcgtgatccacctgcctcggcctcccaaagtgctgggattacaggcaagagccactgtgcccggccaatttattatacttttaatataccattacttatttaaatgtccctttcaggtagacatctagtgtgtttctatttattttgctgttgcaacatttttgtgcctaaatcagctttttaacattttttggatagatttctcagggatgggattttgggtgaaatatgtggggatatttagaatttctgatgcatattaccaaattgctttcaaagaagtgttgtgacagtttacagtcctgcctgctgtgcatgatgtgtcacagcccatcccattgtgccctccttgcctcaagagatggtgtcttcatctctcccacctctctcccggcccagtgcctggcccataccaggtgctcataagtgtttgggggtagcaaagcccccgcttaccacaggctcaacatcactgatgggagctcaacatccactggggggtccgtaaggatcagcctgtccagctgggcatcgtgcacaagttaaaccttttggttttttgagatggagtttcgcccttgttgcccaggctggagtgcaatggtgcgatcttggctcactgcaacctctgtctcctgggttcaagcagttctcctgcctcaatctcccgagtagctgggattacaggtgcctgccaccacgcccagctaattttttgtatttttagtagagatggggtttcaccatgttggccaggctggtcttgaactcctgacctcaggtgatctgcccacctcggcctcccaaagtgttgggattacaggcgtgagccaccgtgcttggccaagtttagccatttataccactgatgagtctctccctgcctccccccagcatttggagcaggaacacaaggacaatagcccctcacctgcacccaagcaactctgctttacctgttacatatatggggattctgccgaagattactgtttggaaaatttgtgctgcctggcccatgagagttcttgtgctctccctgcctccccagtggcatcccttcctcaagctctggctcgcatccattgtttgcctttcctgagcatttgttaccctccacagtgccaggcttaggacctaatgctcttgtggctggacaggctgccttctcttctttcctggctaagttttcctcaaatgttaactctgagacccatgacactttctctgggaactccaccccactgtaactgttgctcacctgcctccaaactagacaggaagtccttcaagtgcaggaacagggctttttcctccctggcacagcacctggtgcacactagggactcagtaaatgagtggatggacaatgcttattggcagaatcatcactgctcagtgtgccttttcctacccagtctgagtttctgagaatgctcttagagaatgaatctgtggttgattttacacctacagggcttagggtttcctcagcaaataacctcctttctccctctcttcttggcacatcagctcacccgacgactgccacccatcaaagaagctaagcctcggttacagaagctcttccgagacttctggctgtattccgttctgatgggattcgctgtggagggctcaggtagggggatcatctctctcccagtgaagacggagtgcagagtgaaggtaaaggtgaggtcagagcccacgtaattatgaatgtgagcatgtttaaatgagtccacatgcagctgcttctttctgcaagtattagcaagtgttactgtccccagatgtagtttagggtgctgagaatgccatacaccttaggaaaagtctgtccaagtcaggtaacagacttcgtttctgtgcctagtttttgggataattgtctcaaaggacccatgactatagaaattgtcagtcaacctcactgcagtgctttccgaccaaggtgatttcctcatttatgttcactttattgcaggactctggccagaagaatggtacgagggggtctgtgaaatagccactaagtcccccttgctcacctttcccagcaaggagccactgcggtccgtcctccagtataactcagccatgaagaatgacacggtcacccccgtaaggattcacatctcatttttaccatgctctctgtgccaattagggcagatcttttcactgtcattattaacacatgttgccagccactgggacctgtttgtcctgggggatgccccatgagccctcggatgtttctctccctccaggctgagctgagtgagctccgcagcactatcatcaacctgctggacccccctcccgaggtgtccgcactcatcaacaagctggacttcgccatgtccacctacctcctctctgtgtaccggctggagtacatgaggtacacgtgccttcaccaccatgcacatgcacatccacatttgagcagggttttcatttttgtgccctcgtaagcatgagacttttttcaacttctcccaagacatgcaaactttctgaaaaaccaagcaaaaacaccctctacttttctcgtatgcccctccttcatgaccaccagacaccacgtatagtaacacctcccagtatctaagctccgcatcatcttctctctgataggaaacaggcttctgagcagttgcagtcagtgttgtgaactcagcccacggactgagcgaggcccttctgaggacccagcctcgctgagtgcgtgtctaggacactcactgagctgtttcccaggaccatggttgagtacaaacagcaaatgcgacatggggtggggccggctccaaaacagtcctgcatgtggcccgatgctcaggacacatctgtggccacagcagtcctaacagtggtagtgacacttaggatctacagctgttatcatgttgacctcagaagtaagcttggattgagtgtctgtgctgtaccaggtactgtgctgcattacacatgtttacgcactccccgacatgcttgtgaggtaggcagtgctatacagacccactgtgctgaggcctcaggcgccctgggacagcagctgagtacattggctacaaaatgatgattcctgttgtcaagaaaaggtcaaattacactcagcttaagtcgggagggatgcaaataagtcgtagaataatttctttcccaaatgatttgaaaaagaaagtgttcctgagagaaaggctatttggaaaacactattttagcctttcattgttgccaccaaccctctagtaaaatagtccttgaaagctcaatacataaaagaaaggcagagtgctttggttgcatgggaatgcaccctaccctcctgctcagtctcctcctccctgccctcagcccggggctccacacacagccaaatgtggaaatcagtgacgcattctccccaagtcccacagagccaagggagtgttgactttgttcttttttcattgtaagtgtcttttattttggctggatgtggtggctcacacctgtaaccccagcactttaggaggccaaggcgagtggatcacctgaggccagtagttcgagaccagcctggccaacgtggtgaaaccccatctctactaaaaatacaaaaattagccagatgtggtggcgggtgcctatagtcccagctactcaggaggctgaggcaggagaatggcatgaacccaggaggtggagcttgtagtgagctgagatcgcgccactgcactccagcctgggcgacagagcgagactccgtctcaaaaaaaaaaaaagaaaaaaagaacattgcacaaaaatggctaggcacggccggttgcagtggctcactcctgtcatcccaacactttgggaggccgaggcaggcagatcctgaggtcaggagttcgagaccagtctgaccaacatggtgaaaccccgtctctactaaaaatataaaaattagctggatgtggtggtgcatgcctgtagtcccagctactgaggaggctgaggcaggagaattgcttgacccaggaggtggaggttgcagtgagccaagatggtgccactgcactgcagcctgggcgacagagtgagactctgtctcaaaaaaacaaatggctaatcccagcattttgaggggtgggaggatcacttgagcccggaagttttgagcttctgcaacagagcaagaacttgtctctaaccccccccccccccaaaaaaaaaagcaaaaaaacctagccagttgtggtggcacatgcctgtagtcccagctactcaggagactgaggcaagggggttgcttaagcctaggaggttgaggctgcagtgagctatgatcaaaccactgcactctagcctgggcaaaagaccctgtcttataaaaacaaaacatttatacaaaatcttgcaaaataagtagagagagaaaaaacactgacctcactgtcatcccctatagcctgttagtatagctgtttgtagtcttttttctaaacaatgtattttcaaagaaaaaacagccaaaacaaaacaagccagacccaaacagagcaaaaacatggctttcatcccagcatgtacggctagaagaggtatctccagaccctctcaacctcatgtggtttgaaggcagagctacctctgcctttcccatgagtatgcccctgagtagttttctcaggttctcaggacgggctcttaactggcagaggaagactctaagacgcagcccatagcagctcctgtgagcccaccttccacctcgggctgcctaccaggcccttgagagcactctgttagcatagagaggcaacctcaaagcctttattcaggaacctggctcaggttcccagccactgggtattgagagagctttaaaaccacaaagtggagaatttgggaaatcaagttaaaggtgtgtgcacgtgcacactcgaatgcgtgtgctgaaagtcacctggcctgccctcctgaggcttaactcttgacaggttggtgcagaggccaaaagacatggcctgccgagccgctgctgccttagtggagcccctggaactctgaacagcccttcacagcacccatgggacaagtgcatgcgctttttcctttttctccctttccccctgaggttaaagatattttttttaccataaaagaaaaatgtacagagtgcataaaacaaaaaagagaagagaaaacactggaatagtacagaagatactaaagatgaaaaaatacaggtatcacttttgtagacgtgaatacttcatttctactatcctactgttaatggcctcttaattttcctctagaaattttctgtgcataggcaagcatgcatagcctacacatacacatgcaaagacagacctttaggaaacctgtaagtggggtcatgctggacatgtgttccctgcaccttccttttttctgttaatagtatgtctcagactttttttgtaacagctcacatagagagctgcctctcgtttggtggctgcatgatgtgtcatcgaatgggtatgctttggcttatctgcccagtctcctgttggtgagcattcagagtctttccattttggataatgcagtcagtgctgttaggagaatccttgtgcatgtaaccctgaagatatatcctaatggtggggctgctggagtgaaaaatatgggaatgtataatagatggtgcacctcaccctccaaaaagtccacctcagtgtgcacccttatgaatgacagagggcaaatgttcttcacatccttaccacttatgggcagtgtcaaatctgtgatagggagggcccagatttttcaaaatttatttaaagctgttttcttcttagggtactgcgttcaacagatcctgatcgcttccaggtaatgttctgctactttgaggataaagctattcagaaagacaaatctggtaagctcattattatggtgctttcatgatgaattgagctttaatagggtaaaaaggcgtactacttcctcttttctgtctacatgtagaaaatgttttatgaagttaaatattgcatgagaaagatcagtataaaacatatagccttcaaatatacgccttaatggttctactgctggtgcaagggccccgaacagaaggatggtcattctagcccactatctatgctcaagtgtgctccagcactcatctagagggaccagggctcctcggatgggcactgatggacctgcagcaacttgctgttgccagagagcagtcatggtttttaaacgtcaggagcaggaaacagtagtttgtgcctgtagtcccaagttacttgggaggctgagtgggaggatcgcttgagcccaggagttcaagattgcagtgagctatgatcatgccacttgcttccagatgcaacttgtcgtcagaccctgagtgcacagagggcctcagctgttaccagccctagcccaggagaccaactcctgggaagacagagaaatggtggaaactgtaggaaggcataaaaatgttacaatgatcaaaaccctatgaagacaaagctaagataagaataaaaaggagagatggaaactgggaaggttaccaggagaccctctggattgatggaagtgtcctctagattgtttgggtagtggtcccgtgagtgtgtacagttgttaagtcatggaattgagcacataagacctgtggattttattatatgcaaattataccttaatttttttaaattgcaaaaggctaatattagttttacaaaagtgtatttagccaataaaaagatattaaaatagagacaacaaaggaaaaagttaaatgctgcgtataagcactttttggccagttttagtgtaagggcactaagaagtctgatttataaggtgtttaaaatcaaaaatttaaaatatgctgaaatgttagacctaagttttaattaaatgcttagaataatttgataatttttgtaattatgatgaaatcatgtttaaatatgcaagggaattggggagaatccacaaattttgattaactgtatgaataaattctttgaggcatgcttattgataaattcttgagattgacaaatttagtattaatgaagtacaactaacagtgtgtagtcctttccgcaccagaagcctttgataggttggtgaatctatcaacttgttcttgcttatggagaaattatttccgatacttcttgtaccattttttcttttgttgaaaaatcaggctgggcacagtggctcacagctgtaatcccagcactttgggaagctgaggcaggtagatcacctgaggtcaggagtttgagaccagcctggccaacatggtgaaaccccgtctctactaaaaataaaaaaattggctgggtgcggtgactcacacttgtaatcccagcactttgagaggccgaggcaggcagatcacaaggtcaggagatcaagaccgtcctggctaacacggtgaaaccctgtctctactaaaaatacaaaaaattagccgggcgtggtggcctgcgcctgtagtcccagctactcgggaggctgagacaggagaatggcatgaacccgggaggtggagcttgcagtgagtggagttcacgcaactgtactccagccttggtgacagagtgagactctgtctcaaaaataaataaataagccgagcgtggtggtgcacgcctgtagtcccagctgctggggaggctgaggcaggagaattgcttgaacctgggagacggaggttgaggtgagccgagatcgtgcctcagcactccatcctgggtgacagagagactctgtctcaaaaaaaaaaaaaaaaaaaaagaaaagaaaagaaaaagaaaaatcaacgcttcaagaaatgttttttaaaaatcaccccaggccaggtgcagtggcttacgcctgtaatcccaatactttgggaggccaacccaagtggattacttgaggccaggagtttaagaccagcctgggctacatagcaataccccatctgtacaaaaaatataattagctgggcatggtggaacatgcctgtcgtcctagctagtctgggggctgaggcagggggatcccttgagcccagttcaaggttgaagtgagccaggatcgcaccactgcactccagcctaggtgacggagcaagaccctgtctcttaaaaaacaaacaaacaaaaaaatgccccaggggctctgagatactgcttcaggtaagactcttctagtaagtcctttgtggagcacttcacactgctgtacaacagtcaggaagtcaggtgcatgaatttatttttgcagctgggagccagtggagttggcaaggaaagactgtgagggttctggaagctcccccttctggcagtaaggaggggattggagtgagcaaggagcccatttgaggccagggatgggaggtgcaggcaggcagtttctacagagaagcctcttccagaggggatgtagacacagggcggggtgggggccacattcagagagtctcacacacatgccccaggaccagttggggctataagagagatgctgtcaagctctggctgaactgttcattgatctgttcccctcatccgtccaccttgcatttgtccatgtagtagcagattttgtgctaagttttgtgctagaccaggggtgtccaattttttggcttccttgagccacattggaagaaaaagaattgtcttgggccacacataaaacatactaacactaacgatagctaatgagcaaaaaaaaaaaaaaaaaagaaaagaaagaaaaatcacacacaaaaaatcttataatattttaagacatttaagacacagaatctcatgtttttttttttttttttttttttttgagacagagtcttgctctgttgcccaagctggagtgcagtggaacgatctcagctgactgcaagctccgcctcccaggttcatgccattctcctgcctcagcctcccaagtagctgggactacaggcgcccaccaccacgcctggctaattttttgtatttttagtagagacggggtttcactgtgttagccagaatggtctcgatctcctgacctcgtgatccgcccgcctcggcctcccaaagtgcagggattacaggcatgagccactgcgcccggcccagaatctcataatgtttaagtttacaaatttgtgttgggccacattgaaagccatcctgggctgtgtgtggactgcagattggaaaagcttgtgctagacaattggcccaccctgcgattctttggttctaggagagagactaagcaacaacaaaattgaaactgccaacctctagaagaattaagcacctagcacattattcagacaagacctgaggagacaaaaaaaggaagaaaaaggctgggtgcggtagctcacgcctgtaatcccagcactctgggaggctgaagtgggtggatcacttgatgtcaggagttcgagaccagcctggccaacatgatgaaaccccatctctactaaaaatacaaaaattagccaggtgcggtggcgtgtgcctgtagtcctggctacttgggaggccaaggcaggagaatcacttgaacctgggaggcagaggttgcagtgagctgagatcacaccacacactccagcctgggagacagagtgaaactccatctcaaaaaaaaaaaggaaggagaacctagcagattttgccagccttctagagaatattcataaaccgaatcagatccctttctgaagtgagatgtctcattcgcccttctctctgagctctgtttttctgttcctgtgacatcagaggacgttaaattgttccgggggactgattgttcctcctcaccttaattcaaaataaagcgattttcatttttgcagtacattgtactcttccacatggtttcaaactgattatttttgttctgagcgtggcacttagccagtaaatgtacagctattgagtgtatatccctcttatatttttcctctaaaacatgaaagataagaaggaaatgtctttggagacatatattattcttgaattttcagaacctaccaggaggagagggtatatgaaatatctagcagccccactaaagtggggacttctgcctcctctctgcaggtataagatgagcctctgttatgttctcagctgcacaggaacgtgagggcaggagcctgctgctcacctgcccaccatcctgtgagtcagttcaccagtaatccagagctaaactaaggggttaagaggagagtggcctttttaaagtaaaaatcttacttaccttagggccgggtgtggtagctcacacctgtaatctcagcactttgggagccgaggtgggcagatcacttgaggtcaggagtttgagaccagcctggccaacatgatgaaacccatctctactaaaaatacaaaaattagctgggtgtgatggcaggtgactgtaatcccagctacttgggaagctgaggcaggagaatcacttgaacctgggaggcagaggttggagtgagccaagatcacaccactgcgctccagcctgggcaacagagcaagactacgtctcaaaaaaaaaattttttttaatctccttagatgctactacatgacattgattggcatctgatgtctatctgattatcaggaatttacagtttcagtttccaaagaactatatgaaaaaactattatactaggccaggtgtggtggctcacgcctgtaatcccagcactttgggaggccaaggcgggtggatcatttgagatcaggagtttgagaccagcctgaccaacacggagaaaccccatctctactgaaaatacaaaattagccctgcatggtggcgcatgcctgtaatcccacctactcgggaggctgagacaggagaattgcttgaatctgggaatgcaacccgtcggaggttgcagtgagctgagatcgcaccactgcgctccagcctgggcgatgagcgaaactctgtctcaaaaaattaaaaaaaaaaaaaaaagctattatactaaacacatggcccaaaataagatttcacccacccaacccagcctcttaagaaagcagcctctcactacccttgagcatctgtccaggtcacactgataacttttcaaattgctgcggtcccacttacccttataacagatagctatgaaaggcctctttatgtctcaggcttcatgctgggtgtgaggtgccaagctgatagcacctgccttgtctctctgcctggaggcagagggcagacccagcatgtagtcatgcaaattaaaaacactggatagagaaacagcattatggagtgtgaattggcattttattacagtttcttcatctgcactgtgatgatcactgtgttctgttgctttttttctttttcttttcttttttttttttttatgtgacagtgtgtcgctctgtcacccagcctagagtgcagtggcacaatctcagctccctgcaacctctacctcccaggctcaagtgattctcatgccccagcctcccaagtagctggaattaacaggtgtgcaccaccgtgcccagctaatttttgtatttttagtagagacggggtttcaccatgttggccaggctggtctcaaactcctgacctcaagtgatccacccgcctcagcctcccaaaatgctgggattacaggcatgagccactgtgcccagcccattctgttgccttttacagcctacttggcacctctgtaacaatgagcatatccggtgctcagatcttggtttctaaatagtattctccaataaaaggaaccagggctccatggagaaatggttgattctagggaggcctgtacaggatgagcctggggcaccttgttacaccagaaagtaaggacacgccaagaaagaagaagaaaagacaagacatggggcctgtccgaatgacacaggagccaacctgaaagagctccgagtggccaaagctggaatgatttgaatagaataaatggtattggattataacccaacgaataaacatccacggttctgtaatgattagactaccgaataaataaaaaatggggaaaaaggctgaaccttccttacagaattccagttactattaataaaaatagaagaggctgggcacggtggctcatgcctgtaatcctagcattttgggaggccaaggcaggaggattgcttgagcccaggagttcaagaccagcctaggcaacaaagcgataccctgtccctaaaaaataaatttttgttttgtttgagatggagtctcgctctgtcacccaggctggagtgcagtggcatgatctcagctcactgcaacctctgtctcctggggtcaagcgattctcctgcctcagcctcccaagtagctgggattacagtggcacgctaccatgcctggctaatttttgtatttttagtaaagatggggtttcaccatgttggccaggctggtctcgaactcctgacctcgtgatccacccacctcggcctctcaaagtgctgggattatgggcgtgagccaccatgcctggccaacattttttaaaaagtagaaagaattgagggaaatagaaaattcctatgacaaccacagtaactactgcaggcagaattcactcgtggatgccaaagtgaaggggcaaaatcttaaaagacatgatctctgcataacttcaaagtatcttccccaaaatatcaatcgctgtggtggctgtaattctcattcacaaatttccttcaggaggtagcatttaattccttggctctgagtgtgggctgtccttagtgacttgcttctaaagaatagagaaagggactgggcatagtggctcacgcctgtaatcctagcactttaggaggccgaggcagaaggattgcttgacccaggagttcaagaccagcctgggctacatagtgagactcccagtctctacaaaaaataatcaattagctgagcatggtgttgtacatctgtaatcccagccaccagggaggctgaggtgggaggatcccttgagcctgggagatcaaggttgcagctgagctatgatctcaccattgcactccagactgggcaacaaagtgagaccctgtctcaaaaaaaatagaaaaagggaaaaacggtaactcaaaccaagggatcaaggttagcttcaccagtaataagagatactgttatcacataccacttacgtgatgcagaaagagcacatccaggccggacacggtggctcacgcctgtaatcccagcactttgggaggccgaggcgggcggatcacgatgtcaggagatcaagaccatcctggccaacgtggtgaaaccctgtctctactaaaaatacaaaaaattagccgggcgtggtggtgggcacctgtagtctcagctgctcaggaggctgaggcaggagaatggcgtgaacccaggaggcggaggttgcagtgagccaagatcgcgccaccacactccagcctgggcaacagaacgagattcaatctcaaaaaaaagagaaagaaaaaagaaagggcacatccactctatggagttctccctcaaatcctgtaaccctagtcttatcatggacaagcatcagacaaacctaaattaggggacattcaacaaaataactgttcttcaaaagtgtcaaagtcacaaaagacattgacagactgaggagtcaccacatattggacaggagtaggagacacagattaaatgccacctggtgtcctgggttggatgctggaacagaagcggggcatgtgtgggagacctgggaaatccagacgaagtctgaagtttaggtaataggattatatcaatatctgactcagttttgacacatcagcctggttactgcagatgttaaaatccagggaagctaggtgaagggtatatgggagctctgtgctgtctttgccactctctgtaagtctaaaatcatttcaaaagaaaatgattgaaagttgctaggattctctctctgttgctgcaccttatccatggaaaccttctcgtttcagggatgatgcagtgtgtgattgcagtcgcggacaaagtattcgatgccttcctgaacatgatggcggataaagtaagcctctccagcatgaatgcgtgtctgtctgctggaggcatctggggcactgcggtacctgtttcttttgcatctctaggccaagaccaaggagaacgaggaggagctggagcggcacgctcagttcctgttggtgaacttcaaccacatccacaagaggataaggagggtggcagacaagtatctatctggtctggtggataagtaagctcattttcctgctaatgttttgtgtgtatgtatataaacttctgtgatttcaaatgctgggaaaaatcatccttatattattaatctaggaaaaaatggagtcagaatgaaaactcctaagggtgatgcagcctccctccaatgtctgtgagtttcctgcagagtctgaattttggtgcagaaacttctgttcattctgagctatcgatgttacttacagcacatttgctgggtgccacatccctgtgtctctcagtcccacccactctggcatgacctggtgcaccatcttctagcccagggcccagccagaggtcccctggtaggatcagtatctttgggcttctcaggaacaaaagcccacacagacccttctgtgctgtatactctttgttctgggagccaaaacagaccctgttgggacatgtccccacactgatgagaactctcacaggtgggctggaccagcttctccaaggtgagaaggccagaggcagcaaaacacccacatggaggctgcctgcagctccccagaggtatccagtggttctggagcctgttgcagatactgtgtgcctggtccaggcagcagcgccaccacaggtggtcaggagccagccaggggtcacgagaacgagtccagcacacacgtggcgtgtgtctgagctgggcttcctgagcagtgggccactggtgggtcacagctgtgcagagacacctctccttcagccctggggccatcggagcccatggcctgtcttaccccagggtgtcaggtagatactgttgttttctccattatgtgagaaataatggagaaccctggtcagaaactaagaggattgctttggaaagtgaggggtgtcctggccagtgcataaccaaggcagttggtgtcaggtttgtctggccctaagaagtggggctggcaggggcctggggagcctttctgaccaggcgttgctcaccttactgcaatgagcctgaggaggccaggcatcctgctgcaagggcctcccgacctcctccttcagctggcctgaagcagatatgggctcgggctggcagctgagggggctcctagaagcagaccttccttggaggtttggctcttggtcctgagagctggctcttggtgcaggtttccccacttgctctggagcgggactgtgctgaagaccatgctggacatcctgcagaccctgtcactgtcactgagcgctgtgagtgtccccaggagacctagggcccaaacaccacccgctctaccaccaccccgccggccctgtccgccctgtgttgtggcatgcttctctgacaataagcctgaacataattaatgctacaggtgtcgagttgggggtgagggggcccaaatccacctggtgttttgcaataagttgcatcaagtatggaggcctgtcacagacagacaggtggtgggtaggggtggcccatgtggttgctagtggcaacttggggaaggcagtttggaagagggagtcttgctgtgcttgcaggatattcacaaggatcagccttactatgacatccccgacgccccctaccggatcacggttcctgacacgtacgaagcccgtgaggtaggcccgacacgatcccctgcactaagggccatctttaccacaattccctgagtatttccacgagatggtcaacctgcatgagctcacccagtccccagcaatttgaggtgtgggtggtgctggccccatcccccagtgaggagaccaagccattgccaggctccaccgagtgcaaggggagctggctgcccccaggtcgctctgtcttccaagcccagctcccccacctcagccatgttgactcagctgtgttctcggtttagctgccaaagaggtcttcagctaccagccagtttatagcctctcgagtctgcgtcgcacaagcatgattttcaggtggacttcacttctctgaggtgcactgacattttgttattgtggtaataggggatcatgcctttgacttgtgctatccaatggggaaactggcagaataaatcactccaaaagaggaggatgtactgggtctctcctctccccaactcggtctcagagccctcactgtggcaagactgcaactcagctcacagctccttcagcctgggctgagtcatgtcctacctctggacctctgccagaccagctgtcaatggggagtttcccacagagtggtgtggcaccgaagaggattttgccacgcagagcctgcccttccatccagtcccagacccaggacacaagttgcacagtgtccctgtgacatgttattcttgtagattctgccacaaaccttgtgcaggaattacatacagatcatagtgtgtgtgggcttcctggccccaggggccttgaggttcaaacttagtggctgtgctagtctcttgggcttctgtagcaaaagacaatagactgggcagcttgaaaggtcttgacagacattgattgtcttacagttctgagggccgaagtgtaaaatcaaagtgttggcagagctggtttctgtggagacctctctccttggcttgtgaatggcagccttctccctgtgtctttacgtgttcttccctctgtgcacaccctcctccctgccccagtatttctgtgtgtccagatttcctctgcacacacgtaaggaaggatactggccagattggatcaggacctaccctatcagccttttaattgaatcacctctttaaagccctatctccaaatgagttccactctgaggtactggtaccagttaaggcgcagcatagggatttggggagacatagttcagcccatgacagtcactacggcagctcagatgaactgacctcgggttgttgagaagcagcttcaccctcttccagagcattgtgaaggacttcgctgcacgctgtgggatgatcctccaggaggccatgaagtgggcacctaccgtcaccaagtcccacctgcaggtacttgaaaccatcaaaaggcaattgccataagctccttcaaactcccaaaaaagctttacagagacatgaagaactcaaaatccaaatagcactagtgtgaatggagactggaagcatcagtctagggcctgagaataatagatgcctcagaggctgctctgtgtgttaggagcgcctgtggggccagtgctggccagggcacaaggagggcatctgacggctcacaccaggtgaggtgccaggtctgtggcaagacttgggggctgctcacgagaggaagggcttgtgtggtggatgtgggaggctgccagatggcagcatctctaagtgccaagtgcattgctggcacctgtgcccaaaggcaggggcctgaccaaggctggtggagcagaggcagagttggggacttgtgtcccattaaagctccacataagctgcacatgtaggtgcatgggagtctttcagacaaaaacactggtttggaaactcagatggccacgaagtaaaccatgtaatgccacagggtgtgagaggaaagaattgccttaaaaggaatcaaagatgagaaaaatacctctggaaggaatctgtgttagcagagagtgggtgtgctgagaggaactcttgtgaggtttaccctggcagcactttaaagatgaaacaggctcaaaagtgtttctggttgtggagtccaggaaggatagagcagccagctccaagagccctgagagctgtgtggaaacgcagtggcaagaaactatttccctttgttcatttacagcaaaagggcctcaggtcccaaggctgtctgtcgtctgaagaggggaggccccctctaatgcctagaaagtttaagtggacaaaaaaagcagctgatagagctttttactttctcacgcaggtctggcctaagaaggaaatggaaaatgaaaaggcttgaagcggtcttgatttttccaccaggtgtccccttggcgtgccccaggcctgccctttcacttcccctgcagtgtgcttattccccaccctccgtgcccagcctcagccttccccgaatctgccctctcctccacccaccagagtagtctggttttaatagggtatctggtcagtgtacttcccttttaaacttgattattagtcactcttcatcgtcatagtgtccaaggatgggtttctggagctccaggagtcccccaaaaccattgagacaattctgcatgtatatactcctgtacatttcttcttaagggaattagttggttcacgcctgtaaacagggcctgcatctgttccaggcttgcccccaccctcgagacccttgtccttggtactcctgcaggctgagccccctgtggtccccagagcaggaggcctccctcacacccctgggctctgccaggtatcccattgcccagcacccttctcccactgggtggccaggtggacacaggtgttgttcttcgttcctgctgtccagttcacccacaccaggctgctggtatgctgcagtagagaaccgaggctccacaccacacagcctgcctgttgaccgcaaggccaaggctttgtagcttatttgcctggtggctaccacagcagatgctcagcaaggatgtgctgaaagaataaatggccctctcccattgacggtgcaacaccgcagtgactgcatgacagccgctcggggaattggccttgtcctcagtcaaatgagcagtagctggtcatagaggggctttgacttactgacagtcccacagctagttagggaggggcagacccaggacagaaacccagtgtttggtccatttgcccacaccttaatttataaagttttattttcccctttaaatgaaatagcaaggccaggcacagtggctcatgcctgtaatcctgacattttgggatgctgaggcgggaggatcacttgagcccaggaattcaagccaacctgagcaatatagtgagacaccatctctacaaaaaaaattgcaaaattagccaggcatagtggcgtgcccctatagtcccagctacttgggaagctgaggcgggaggatggcttgagtctaagaggtcgaggctgcaatgagccatgatcgtgccaccacactccagcctgggtgacagagcgagaccctgcctctaaaaaaatcagataaataactgaaaccccatgtgtttttcctatttcaggaatatctgaacaaacatcagaactgggtatcgggactgtcccagcacacggggctggccatggccactgagagcatccttcactttgctggctacaacaagcagaacacaactcttggggtatgtgcgagccttctgaagagcagtgaccccttagaccataggagccacagtgcaggggaaggcttagagctcggctgtcgcttttcatgacgcacatgagtacatgcagggtgctgtggatgtctgttgacaatggtagtggtgcaagccgcaccttggcccaaagaagaggtggccattgaaatgagtgtttccttattgtgcttttttttttttaaatttatggatttatggggatcagtgcttgatatgtcagtgatcagattttgatttgaatgtccccatctgagaggatggaaacagagctccgcctgacacgggcagcgcgatgccacagttgcacttatctggagcgtatactggactcctgaacagttctgttttctgcaggtgctgaaccgcacatgaatgccttcagcttcttgttctgctagagattaatctagaggacagagggttcacacagcaatactttctgagttaaattagagctaagagttaaaaaggattaaagcaggcagttccacctggccatgtgactggggctggtcagagattttgttggttaatgtgaatctagagcctggccatgtgtgcttcccaactctctccaaatggagcatgggatgggatatgtggaggtgcagaggctgtgtacccaggaggaagggtgacaggcctcccttgggataccggcgggagagaggggcctgagtgccctctggcttttgtggggcctgaggatgtgccagagaatgctggtgtcttctcgcctcattttgctatcagggcactctcctcgaggtcactgcactatctctaaagacaccagtctagcagacatggttgagctgggtccagcctgcacctgcagggccacccgccctgggcctcctactctgacggggcaccaggtatcagtgccctgacctggacgtctctgccactgggtggccacagaggccagaggcggaactcatagactgtaagtgtttatgatagtcataagccttttcctttttgggggtggtaggagcaaagctttattacataaaatagaatatgtgttctcatttgtaagccttttctagactctagccagctgacttgtgaaagatctgttttgcctaaaatattttgttctttttccccagaaaatttgatgtaagttaggttttctctaagttattttttttaatttttaaaaattaattctggggccaggcacggtggctcatgcctgtaatcccagcactttgggaggccaaggcgggcggatcacgaggtcagtggatcgagaccatcctggccaacacggtgaaaccccgtctctactaaaaatacaaaaaattagccgggcatggtggcaggcgcctgtagtcccagctacttgggaggctgaggcaggagaatggtgtgaacccgggaggcggagcttgcagtgagccgagatcccgccactgcactccagcctgggcaacagagcaagactccatctcaaaaaaaaaaaaaaaaaaattcttttttttttttttttttttgatgaaaccccatctctagtaaaaatacaaaaattagccaggcgtggtgacatgcacctgtaatcccagctactcgggaggctgaggcaggagaatcacttgaaccagggaggtggaggctgcagtgagccgagatcgcattgggcagtgaggagtgatggtggaagggagggagccggcctgcactgcccaccaggtgctgtttgccatgccaggacattgtgtgtgtcattacgttgaacgtgtaacaacattgtgagagggttatgcccactttacagatgagcacattgaggctcagagacattgacttcccaaggtctcacagctgattagtatcagagccaagctctaactcagtcctgcttggtgccaaagaccgcattgtttccagaaaatgtaaagcagtttcacgtaatttatttttttaaataaaccagtttaataatttcatgagagaaatcatgtatttttgttcttgtttatattttgatgttccccaacatctgtattttcttctcctggtcctctttctccacaccatgtcccctcaaaaaaaaatccctctaaactcaaaacagttgagaagctcactttccccattagtactgatgctaaagggaaatgcgaaaggaggtccttttcaatgcatgctgtactctgcagtgaccgtggatgaacaggaactgaaaggtgtggcacagcagccagcctgggttaggaagccaggtcactgaggccctggggctgggaggctgaggctgaagcagagagagtggctggaggggtggagtgggtgggcggtagttttcaaatatttttctcccattctgtgggttgcctttgtattcaaggtgtacccttttctgtctcttcccattagactgaagagcagccagcagatgtttaagagcctgctggccttggctctccccttcagcccctttacggtctgtaagtgacatttataagctgcacacgcaactctcaaggagacggctgtgaatgctttcatggcgtttccatcacaggtgacattgctctcacaatctagtgattctttttcttgcaaaggcctatttaccagtagcagaaactgccttccagagacttttttttttaatttcttatggaacatatcaaactgctgggtattctaaaatattttgctttattaacttgccagcagtgaagatttttattaatagtaacccccagacccgagtgtgactgcttcattgggtttaggcttagccatggtaaacacgaggaaaggatagtgctgccatagtctacaataatggttatctgtctgtaggcaactcagctgagcgagcgcccggcctgtgtgaagaaagactactccaacttcatggcatccctgaatctgcgcaaccgctacgcgggcgaggtgcttctcttgtccttgcgccctagggcctttaacgtgtcctcttgttttgaggcctgttggccgcttcctagtggaaaatgaacaaagcgtcccggtgatgtggaattaacatattttaggaggatttaaagagcacattttaggaggattcttggcacattccagagtgttaatgaccagttacttgttttttccacaagagggtaactctgtgtacactttggctacactgaatgaaggtttttaatttttttggcttttttttacagcagtaacaaacacttacatgccataggctcttgggcactcggtaagatgtatgtattattattccagttttatagataaacggaggttcccaagattaagtaacttgccaaagtcgcacaagtggagtggggtctggaaccacatcttccaactccacatcgtgggctttcacccaccacaccacagtttattccagcctcaccagtgccatcacatctgtgggcctccatttcctgctccataaactcagaagctaatctataccatttctttttgtttgtttgtttttgtttttgtttttgagacagagtctcgttctgttgcccaggctggagtgcagtggcacaatcttggctcactgcaagctctgcctcctgggttcacgccattctcctgcctcagcctcccgagtagctgggactacaggcacccaccaccacgcccggctaattttttgtatttttagtggagacggggtttcactgtgttagccaggacggtcttgatctcctgacctcatgatctgcccgcctcggcctcccaaactgctgggattacaggcgtgagccaccgcgcccagcctagtctatgccatttctaagctccctggtgactctgaaagtctatcagtggcctggtctgagtgggagttcactccttcttagcactctgtcacttgtatgttcttctctctggaaaaaaaagttatatttgtctttaaaaatagataggttggccaagcacagtggctcacgccagtaatcccagcactttgggaggctgagacaggaggatcacctgagcccaggagttcgaggatgcagtgaactatgatcgcaccactgcactccagcctgggcaacagagcaagactctgtctcaaagaaaaaattattaataatagtaaggagggctgggtgtggccgctcacgcctgtaatcccagcacttagggaggccaaggtgggcggattatttgaggtcaggagttcaagaccagcctggccaacatggtgaaaccctgtctctactaaaatagaaaaattagccaggcgtggtggcgcatgcctgtaatccagctacttgggaggctgaggtgggaggatcacttgaacccaggaggcggaggttgcactgagtcgagatcacgccactgcactccaacctgagcatcagagcgagactccctctctcaaaaaataataatgaggctgatattgttgtttgagtcattaattgagtttgaggaaatgtatttatccagctcacattcatgcagtcccaccatgggtcagaccccgggctcactgctgggtacaatgatgagggacaaggttcccacccttggggaacatctgcagtggtggcactgccaacatgcatttctagaggagctgttctttaaaaaaaaaaaaagctgtgatcagtggtagcatcattgaaatgagcctgtctctctgcatgcatgagctccactttggggcagcgaggcacccaccagtgccaccacaagtgtggtctggtggcttccagaaccttacccacattgcctggattatatgcttagttgctgatgagaatgtttttgcaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaaggtaactcactgaagcactgtggaattctgggctcgtttctaaatgaatgctggccttgatgacccatagccagctggagtactggccggagaaagagcaggagctcccccagtagaggagtatctctcatgagtggaaagtcaataaaaggccatcactggccccagctggtcaactcttgttggcccagggaagctgttttggggttcagctgttgttggaggcctctgactgacgtgtgtttggttccagattgtgacccgcagctccttcatcatctgtgctggggtcccctccggatgttcaatgagcatggcatggagacggccctggcctgctgggagtggctgctggctggcaaggatggagtggaagtgccggtaggaccctgacctcgggttggcagtgaggatgggatgggataacagacgggaagagccttccctggtgccgccaccaccaagcatggagacactgggcaagcccctcaccttctcaagcctcagtctccttacagattctattattatacctgacagtcacagaaaatagaatatatgttaacagcatcccactggtgcctagaagccgttatctcccaaaacctcggtagggggagccatttctctactgaaattggaaatccagctttttgaacacctgttaactttgaatttgattgggagcagttgtgtttgtccacgggaatgtttttcttgacctaatcttgggatcagccccctttccctgcatccgtatttctggagttgctactgcagggggtgcccacaaggaagtttatactcacgtttcagctgattagataaacgcttaagaacaattttatttttcaaagattctgttaactgtcagggtagcagggaatttgacatgttttctttctgtatttcttaggattagttgaaatgagtggtcaaaaagggggattttgattttcttcttccctcaggaaaattggaatatttccaaaaatgtaattaaaatgttccgggctggtggtggtggcagtgatgataatatctcacatttgcctgctattttataacctcgtggggtttgtatcaatcacaccattgagcgctgttaggaaacattttggtccagtgggcgcctgggggaggttgtctagtcagggggacacctgtgaagtcaggggagtgctgggttctcagcctgaccagcctgctcccatcaaagatatgcagaagggcctgtggaagtcacgcttcagcctgcagggctctgattcctgggcggggctcctcacctgcatggtggacatcattacaagagcacctgcatcctagtgagctgtcagtaaatgacaactggagtggccacatcagttatagttcttgccagggagaggattctgcagagacagctgtataccattgccactgtggatacccactgccattatgacacccaatttctccctctaattccttgtgtcctgttttcatattttactactatatgcattagaccttataatgttgtttctgttcaaaaaaatcaaaagtctttcaaagaaattaagacaaggctttgttacagcattataatttatccaaatgtttttcatcactcacacttttacagtcttcctgtgatctcctctgccaagtaattttctttaacagttccagtaatgcaggtctgctggaaataaattctctcatcttagttcaccttcatctttgatgcatatggattattttttctaggcccaggattctaggttgatagttttttgttttattgtttttagcatttcagatattatcttctattgtctagtagcttgcattgtttctggagagaagtcaacagtctttttgtttctcagtacagccggccctccatatccatgggttccacatcctggaaccagttctcctgaggataccaaggatgactgtatatgttattgtttttcttttgactacttgttggatgtttctccttatctttcatttttagttgtttgactgtgtgtgaatttcattgtatttatcctgttggaattcattgagcttcttaatttcagggatttaggattttcatcaaacttggaaatcttgaggtcagtatttctttgtcatttctttttcttttttttttttacttcctaggctcttaaggtcaatatttttttaatttttttttacttcattctctctctcttctcctttttggattccaggtacacatatattagtgacttggtattgtcccatagatcatcgacattctctgtagtctttttcagtttttcagggtttttctcactctttcatttggttaattttttttttaacctgtataccagttcactgttcttttcttctgctttattcattctgctgtaaaaccatcttgtatattttttatttcagatacaattctcaggtctagaaaacaaaacaaaaaataaatatttaatttaaaaataagaaaaagaaacaattccagatctaggatttctagttaattctttttttttttttttttttttttttgagatggggtctcactctgttgcccaggcaggagtgcagtggcacaatcttggctcactgcaacctccgcctcgtgggttcaagtgattctcccacctcagcctcccaagtaagtgggattacaggcaccagccatcatgcctggctaatttttgtgtttttgtacagacagggtttcaccatgttggccaggctggtcttggactcctgaccgcaggtgatgcacctgcctcagcctcccaaagtgctgggattacaggcatgagccaccacgcccagccatttaattcttttttatagtttgcattttctgctgctgagattctcttaccttcatgcattctttccattatttcttataaatctttgagcatatttattgtaattatttttatatcgttatctggtctgttcttgtatttgagtcatcttgggtcagtttctttttatcttttttcttcaatgtttgaaagtttttgtttctatactggacattgtacatttaaataaaactgacagttgaggaggactgctgtatattttcccagagagaaggaggtctttattttttttcttttgtttttttttttttcctgaagacagtcttgctatgttgcccaggctgacgtcaaattcctgagctcaagtgattctgctgcctcggcctcctgacccagtagctgggactttttttgttgttgcttttttttgttttttttttttgagatggagtctcgctctgtcacccaggctggagtgcagtggcccgatcttggctcactccgcctcccgggttcacgccattctcctgtctcagcctcccgagtagctgagactacaggcgcctgccaccacgcccggctaattttttgtattttttagtagagacggggtttcactgtgttagccaggatggtctcgatctcctgaccttgtgatccgcccgcctcggcctcccaaagtgttgggattttaggcgtgagccactgcgcccagccagttgcttttttttttttttttttttgtgactgagtctcctgactttgttagccaggatggtctcgatctcctgaccttgtgatccgcctgcctcggcctccccaagtgctgggattacaggcgtgagccaccgcgcctgtccgagatgtctttcttatgtctggtggctcctcctcctactcaatagctggtcttggcaggaagtatgggttcttcctgctttttaccccacttccttttttttttattttaagcaaaattgggaaaggtgtcttaaagggatttttatacaaaccaaattactgtttcatttggggtcttttggagtccagcttgcacttcctgctcctaccatctccagtggctcagctggcctcaggtcccttggcctgtgtcaggcttctccacccactcacactcacacctggcactggccccagcagcacgtggtcattcaggtcctcactccctgtctctgcctccacaaggacctgacctgtccaggtcccatagtgcccaggagatgaagagatgtcacacttgctgttcgcatctcagcgtgggaacagtggggagcctgacctccttacaggggtctgggaccttcatttcactgagaggggaaagattcatgatccttgtatgatacttaaaattcatgacccaaaataaatgcatgtgggctgcactagtaactgataacttgctctggtcctgctgtgtgcccaacttaagcagggcattatatgtatattactctcctgtccattgaacccaggccttggggtctaggctgatggttgcagtttcccccacaccctgaggctgtcctcctgtgggctcaggagggacccgatcctgggaagtcttagccacgctcactcctgtgtgggcccaggtgcccacctgcctgcacacacctgcctacacacacctgcctacacactatctcttggtgggactctccacttcccagaagaggacaagtgtgccctcctctcagggtcttctggaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggccgaggcgggtggatcacctgaggtcgggagatcgagaccagcctgaccaatatggagaaaccctgtctctactaaatatacaaaattagccaggtgtggtggcatgtgcctgtaatcccagctacttaggaggctgaggcaggagaatcgcttgaacccaggaggcggaggttgcggtgagccaagatcgcaccattgcactccagcctgggcaacaagagcgaaactccgtctcaaaaaaaaaaaaaagaaaaagagtaggggctgtagccgttcccatttcatagggcactgggggtgctcctgaccacgtgtcagccctcacattgtacctggggctctggagcccagatccacctctctcctctccacttccttagtccaggtgcccttgaacttctggcctccctgtctggtcctcagataggagtgggtcctcagataggagtgggttggttgacccctgggggcagggcagttggagtacagatatcactagcaggccccagatggtaggaggacagatcagcctagggaaagctgctcacagcctccttcagagttctgggtcttgaaagcagctgttctgggagcctaactgcttttcccagggacttaaggcctttgtaatttttgtagccctttcatcctccagaataaagggaccttcttgagctcagggccttctcagtactggcatgccccagggctcctcctccctgcctgggtactctggccagctccactgcttacccagcccagtcactcctagtccaggtgcatcccttcagtggcttggcccacagcctgcatggtgaactgattagcagccccaactaatgggtccaaccacagctccagacaccgctacactggtcgcccatccgccatcactgttgatgccagggtggttcttcccttcactgtagatgccagtgtggcccctccctttactgtagctgccagtgtggcccctccctttactgtagatgtcagcgaggtccctctcatcactgtagatgccagtgaggtccctccctttactgtagatgccagtgtgacccttcccttcactgtagatgccagcgaggtccctccattcactgtagatgccagcgaggtccctccattcactgtagatgccagcgaggtccctccctttactgtagatgccagcaaggtccctcccttcactgtagatgccagcatggcccttcccttcactgtagatgccagcgaggtccttctgtctgctcagacgtctttgactccctcttatgcacatcccacagatgactctcagcacatcccatcaccttcacctttgaggtttatccaggatctgacaagtcccagcatcccagctgctgccctctggcctggcctcctgctccccaaccccaggcatcttccccttctccacatgcggttggcgcaagccaggggggaatcagagcccccctacagactcgaaggtgggcttgtttctgtgacctgcaagcccccttcccacctgacttccatcctctctcttccccttgcttgctgtgctgtggccatgctggggtcctgcttgcacttcccacggatgattctcagcacatcccatcagtttcacttttgaagctgccctcctgggctgctcccaccataggccgcgtcatgcattccctcttctcagatggccgtgccttgcgcctcactcctgcgtctcctccagggctcatctcagatatcccctccttgccagggctctccctggccacctggtctgtcacacgctcactcgcactgctgtttcttagtgtttctcagtgtgtgtagcttatttcttgttgtctgtggtccccaccatagactgtgtggtcatgtttgtcttcattcagagcaccatgcccagagtccacgaggccctggcacagaggcagccaccaggatgtggttgtgtaacaaataggtgggagtgtgtctcttccatggcttcttgtccatggcagttctggggtcccccccatttttttctcccttgtctgcttccataagactaatcggtctgcaggaaacagaaagcaggctctagtgcctcgtcccccaggagtcctcaccccatgggcagcttagagggaagcagcagacagagccccgccccgggctcccgtcggctcctggccatcctgggcttatgtggcctttgtctccaccctcacagcctccagatggcttctgtgcctcccagcaggaaggaagacaaggacagagtgcaaaaggcagaggccagctgccttgaccttatgaagctcaccctggcatgtgttcccagggccttgcccagttcactctccctggctcattagagtggccggggagaacagtggccgcctcagccagcagggaccctggctgagagccctgtgactggccacgtggccaccctgatccacctcatgaggaagaagggaggggatggtactggggagggagccgcggtgtgtgttctactcactaggcctcgttgccacctctgcacaggcgcttggagcccttgtagaagctggtgctgctgggacaacagagggatagaatcctctttggccagatgccaaatgctgtttgttggtctccttgtaaaaacacccagaaatcatgggggctttccatgtgtgagctgcacctcttactctctgcagcacccaggtgtctcccgggcaccatgctgctccctctgggcacccctcatgcccccccacggaatggggacctggctgagcatgactgggccatgggagcagcctgaccctgggctcccaggcctggccatggtggctgcaggctcgcctcggctccatgggcctttcctaatctggttagcgggatgaaggcatcaggtagggtctgtgtggggtggagaggaggagccaggctctggatccagaaccctcttctgcccttgccagctcagcatcccacagaggggtcttcccgctcacagccacagagggttatcagggttatagagaagagtcacctacccagtgcctgtcagggcatcaggtacatcccgggtgctgccacctcacacctgcaatgtccacacggtgaaccgggttgaacagaaggcagcctcgagaggctggagaaaatacaccaagcactgacacagatgaccctgggatgtgggactataggcgatcttcatttttttcttcatacttttcttggtttctaaatcttattcagtgagcacgtgttcctttttttaattagagaaaacttgacagtagcccctttttgtgtttcacagaggagctaacattccttctgtacctgtagttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacgtacgtgcctgttcccccacgaaggctgtggggtgctccacctggggggccaggactgttcctggggtgggggtagccgagcccaaggccttcggcaagctcggccagtcagcccagaacccctcctcagctgtctctgccggccccagggttagcccggctcagccccaccaccacagcgtcttcctcttttcgctcagttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagtgagggccctcttcctggggagcacagggcccctggtgtgtacagtgtgtcatggggcgtctgtgtatcacggtacttctgtagacggggaacacatttcagtgagctgctcctggaagggcagggaagagagtccataaggtgaacttggccccaggccaggctcctgctctaactgggtccggggctccctcacaggctgctgaccctggggctgtccctcctgcatgccgatgtggttccaaatgcaaccatccgcaatgtgcttcgcgagaagatctactccactgcctttgactacttcaggtactcccccaagatgtgctgtgcagcgtccagggacggcgcagcccctccaagtgctccatcgccccaaacccccaggaagtcactcacaggaatacacagttgcccagttgtgctcaccaacctcctccttcagtatccctggccctgtggatttaaatacccttcagccctgtgcatgtgtcccgtgtacttagagctagcctcccagcgagatgtaggcaaattttccctcagttcaactgatttaggagattaagtgcgtccatttaatttccctgttaatgtgaaggcttattgcacgaagaattgcaaacacccactgcctggggctctgcacccataggctgtgctgttgtgtgagtgcagcttccttgccctgatctgccacaagtgcagcttcagtggaaagctgtaggggctgctgtgggcagtgagggaggagggcataagagggctcccgagccaccacaccttcccatgggaatgggccagatcatccttgctaatgactggctttgggctgaccttttgtcattaagaaactgtctgcatcaccttctcactgctttgtgtgactggcctctagtccctgactccagacactcagcccttgtcctcttatggttgtttgaagctgtcccccaaagttccctactcaaggagagaagcggctgcgtgaagacataagcatcatgattaaattttggaccgccatgttctcagataagaagtacctgaccgccagccagcttgttcccccaggtaaccctcaacagtgcagctgctcatggtggaggcaggcaggacaggggtgccacgtgggctgccccgagggtgccagaggtagggacggaaaagcagttagacccccctgagccctggccttggctgtgttgcacggtcattggaggccggtgcatgcctggctctgcttctcctctggcctgagctgagaagcataaacacgcacccgaggcagctgagcagactccactcaccgcactttccctgcactggcaccagctgcgttcacacacccctctgagcagctgacggcccaggattgggctgaggctggtgcacacccacatgactggggtatggtctgttgttgtcttgtaggaggcagtcaaatggacaggtgatttcaatatgagggaactatgggagcactcctcggggacaggcacttggcccatccagagttgaggaatcagagatggttttctggaagagagacagttgagctgagtctgaatggctgcaccggcatgcagggtggacagggcaaagcattccagggaagggtatgccgaatgaaaacatgccacgcaaagaagcagcaaacctctgtaaggaggccatgccctgttctcccaggctagagtgcagtagcgcaatcttggctcactgcaacctctgcctcctgggttcaggcgattctcctgcctcagcctcctgagtagctggaactacaggtgctcaccaccatgcctggctaattttttaattttatttatttatttttattttttaatttaatttaattttatttttttgagacagagtattgatctgtcgcccaggctggagtgcagtggcacaatctcggctcactgcaagctctgcctcccgggtatgtgccattctcctgcctcagcctcctgagtagctgggactacaggcgcctgccaccacgcctgcctaattttttgtatttttttagtagagacggggtttcaccgtgttagccaggatggtctcgatctccgcgcccagacttttttttttatttttattttttgagacggagtctcactctgtcgcccaggctggaatgcagtggtgcagtctccgctcactgcaagctccgcctcccgggttcacaccattctcctgcttcagcctcccaagtagctgggactacaggcgctcgctaccacacctggctaattttttgtatttttagtagagatggggtttcaccgtgttagccaggatggtctcgatttcctgacctcgtgatctgcccacctcggcctcccaaagtgctaggattacaggcgtgagccaccgtgcccggccaatttttttattttttagtagagacagggcttcaccatattggccaggctggtctcaaactcctgaccttctgatccgcccgcctcagcctcctgaagtgctgggattacaggtgtgggccacattgcctggctgagaccttctgatccgcccgcctcagcctcctaaagtgctgggattacaggtgtgggccacattgcctggctgagatggttttctttagcagacccacggctgacaacctaactagcaggaaaaggaaagaaaaaagcagatgcagtgactttctaaggcagctttctggctccacttagaagagggcaaacagtccttacagtctgcccccacaggccctcaagttgtcaccgtactaaaggactatacgttgccggtgatcagataactgccatcttttatcaagaaaattatgatatttgttttattctattttattttctacttttttttagaaatgcagtctcattctgtcgcgcaggctagagtgcaatagtgtaatcatagctcactgcagcctcaaactcctgggtgcaagcaattctcccaccccagcctcacaagcagctaagactacagacacatgccaggtcccctggctaatttttattgttgttgtagagatagggcgtcttgccttgttgtccaggctggcctcgatctcctggcgtctagcaatccacctgcctcagcctcccaaagtgctgggattacaggcatgagccactgtgctcagcctattctattttaaaggctagaagaagtccaggtgtagtgactcacgcctgtaatcccagcactttgggaggccaaggcaggtggatcatttgaggtaaggagttcgagaccagcctggctaatatggtgaaaccccatctctactaaaaatacaaaaattagccaggcatggtggtgggcgtctgtagtccagctattcgggaggctgagacaggagaattgcttaaacccgggaggcagaggttgcagtgagctgagatcgcgccattgcactccagtctgggcaacacagcgagactccttctcaaaaataaaacataggctgggcacagtggctcactcctgtaatcctagcactttgggaggccgaggtgggtggatcacctgaggtcaggagtttgagaccagcctggccaacgtggtgaaaccttgtctctactaaaaatacaaaaattaactgggcatggtgtcaggcacctgtaatcccagctacttgggaggctgaggcaggaggatcacttgaacccaggaggcggaggttgcagtgagctgagatcacgtcattgcactccaccctgggcaacaggagcgaaactccatctcaaaaataaataagtaaataaataaataaattttgaaaaggttaaaagaaatataataaaaatgtttaaacattccatctagaatagttaaaataaagaacttctcatgcttttggaaaacccaccatccagacagatttgttcctgcagtcgattccaggactccagaaaatgcctgctctgccactaattgctttatctctggtgaatagtagtttattttttgtggtaccttttcttgagccacctcactctagaatcaacaatgtgtttgccctcagataatcaggacacccggagcaacctggacataactgtcggctctcggcaacaagccacccaaggctggatcaacacataccccctgtccagcggcatgtccaccatctccaagaaatcaggtcggtgggaggtgtgctgctggggccatcacatgcaagctatcattctagttgcaagctgcttgatggacacttgctcagacagcagaacagagcactgcaagcttcctctaggtttagaatctcagggcagacaggtagcatctgaggactacacctgtgctttgtctttcctcctaggcatgtctaagaaaaccaaccggggctcccagctgcacaaatactacatgaagcgcaggacgctgctgctgtccctgctggtaaggcccacaggtgcagctgtgcctgctgcccgccacctgcctgtacgacacctggtggccggggcagtgtgtgggcactcacagaaggggtgcatatcaggccttatgtcttatcttgccaggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtgggcccccgggcaccacagcctgacacaggcctcaccagaggtccagcgcagggtgcttgccagctgggtcatgagttctcaggagtgccctgcagcccctttcaaggatagtcaggaagtagtctagtcctcgagccccaggacactccccgagcccttctgtgcagagataacccagcaaccctcgtgatcttttcagatgcctgcctggggtgctgcagcagctggagcctagggaggtagcagcagggtgaattcagagccaagatctgattcctgccggataggaagcatgtggaggctgtcactcctggcaggtggctgccggaaccgccttggggagggtttgggtttgttcctggatgtcacctttcagtggcagagtatttggaggaggcacatgctgcagacagcagtgacattcctgtgatctctctgtggcagctcttatggggacagaacttcagaccgatggtggctgagagggactgcagagtccctgtttagaatcccaccagatggtccacagcctcctgtgaatgtgtccagggtgggtgattctccattgtgagcccagacttgccaatgtactgcatcctctctccagccctactttgatcctctggaataggatcgcagcgcagctctgcattgtctcaaagcacagtgctcatgggacatccgccttgcattagcctgaggtgggaacacctggaaaccagtagctgccccttcatggaccaggtgccttgtggcccctggactgttgactgagacactgactcactggatgagcagctgtggagagtcaggagaggatatggtaggaaaaggagtaagaggcaggggttttaagacaaggatggtgaaaggaagccctttaaacagttaagtgtagaaaaattcctgtttctttaagaaagttccagcatttcatcacagcagattataatcctctttttaaaaaacactaatgttcagacctactagttagtggcataatagaacatttagccgtcacctggctaaacatttttttatttaaactttttttttaaatttctgtgcatatgtagtagatgtctgtatttatgaggtgcatgagatgttttgatacaggcatgcaacgtgaaataagcacatcttggagaatggggtatccatcccctcaagcatttgtccttggagttacaaacaatccagttacactcttttaaagttatttttcaatatacaattaagttattattggctgtagtccccctgttgtgctatcaaatagcaggtcttcattctttctatttgtttgtacccaagccgtcacttggtattgatgtgaatccctccagttcagtgtttccccctggctcccctcactccagtgtggtgggagagtgcaggttccctggcgaggcagcaccacccataccctctgtgcactgtaggtttaagaacacagaagccattgggaacgaagtgacccgtctcgttcggttggacccgggagccgttagtgatgtgcctgaagcaatcaaggtagtgtagcccacgtaccagggcctgagttcaaactgcacaaaatagcacactgcacccagaaatgcctgaaactagaaatgagacaaaaacagccgcttggcaacttcagtgctattcatggtttttctgatttcctgtgttttctatttcttgtctgtagcatttattttgttcacagtagaaaaaaatgtaatgcacttcaccctaattgcagttacgttgttttccataacacatcagaagcatcttccccatggttaccgatgcttagaaacatcacttctcatggccgtccttgtgtggcccgtggaccaggtatttccagaggtcccgggactgcccaagccacagcatctccccaccttctctgcagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggtgagcccagggccctgctgagctggcctctggtaggactgttgggaggggtcttacctggtgagaggcacaggccccaccattggccatgaggtcgccccgttacatactggtcctttccctgttttttgctcaagtagttgtagaagatggatttagttctaattcaaatgtgttctctagttacatttgttttttaatctagtgaggcgtttgagttaaagacataaagttaacttgagtttgattacgaggcggcgcggcagctgtgcacaccccacacagcagtgcagctagctgtgccttggaaccccacagtgacctcacccgtggagggtccctcactccttgtgggagcccagggagcccacgagatagccatgatgatggtggagaagggtctctggaatattctagagtctgacccacagcagaccattccctgaggcaggctccctagtgaggagcacgaggccctcgcccgctgtagagcgggagccttgctccttttacctgtttcctccattcctgtgttctgagccatcggtcattttgcctgccatcctctgggctttccccagttctcagccctgctgtgggcagagcagaagcagaggcagggcctgggccgtagggttgggtggctctgctctcagaagtcatggccaactctgctccacctccacaggacgccatcctcttctacatcccccagattgtgcaggccctcaggtacgacaaggtaagcctgcacctgcatggccgtcctcttcactcacagagtgtgttccacaccagcttgtgcccggtctgtccccagccctcacaggctcctcagagcctcctcaggggcagggctgcccagcagtccccttgctccccctaccccaggccctgtgattgtcccttgatacccatgttcacccactgcctcaccctgaggcccaagcatgctctgtggagcgagccggttctggggctgttgccagcctggctaggcagcctggccaggcttccctctcatcggtggggtcccctcaaatccctgaatcctgccctcttcagccggaagtggtgaggaaaattaacgagatgacatatgcattagtctgccagggctgcatagcgaagcaccacagactgggcagcttaaacgacagaaatgtctattctcattctcagaattgtggaggccaaaaaacaaaacaaacaaacaaacaaaaaacatgaattctggaggccagaagtccaaggtcattgttcgaacagggttgtttccttctgaggcctgtctccctggctttttttttttttttaagagacagggtctcgctctgtcactcaggctagagtgcagtggcgtgatctcagctcactgcagcctcaacctctcgggctcaagctatcctcccacctcagcaccttccccgctacccctcccaagtaactgggatgacaggcgtgtgcgaccacgcccagctaatttttgtattttttgtagagatggagtttcgctatgttgtcccaggctggtctcaaactcctgagctcaggcaatctgcccacctccgcctccaaaagtgctgggattataggcctgagccactgtgcccatctccctggcttattgatagccatcttctccctgagtccttacagggtcatccttttgtgtgtgtctgtgtcctaatctccccttataagaacacctgtcatactagattaggacccaccctattgacctcattttaccttaatcatctctataaagaccctatctccaaatacagtaccattctgaggtcctgtaacatatgaatttgaagggacacagttcagcccgtaacagtatccatggacataaagtgctcagcacaggtcatggcacagaaaatatccatgggaatgaccacagccaggagcccgagccgcctctgccctcgcgccagcctgcccactgcaccctgtgtctgagtgcagcttgtctgccctattccccaaccccagggctgacctcatttccctggatgaattgggcagcagactccatgtgtcctggctgagtcctcaccactctggcccacctgtgggctggctgagttacatggctgggtgtcccaggggctagccttggagtctgtagaccaaagtgcttctagaacagcagccagcctctgctgaaagactgagtcctgtggaatcattcactgccctcactaggtagtgccacactctctgcgcctctgagtggtgatatgtgtggagccacactcaccaagccggagccttcacactggtggcaacttacaggattgtcatgaggcaccttctcttcagcaacctgtttccttccccctggctcccctcccacattattttcccttgactgcttggctctctgcttgcatacaggcctagcataagggtgagatccagaggcagtggggaggggagccagtacccagggcctccgtgtgaactcttggtggtggctaccagagaaaggccgcctgaaatgattcttctgtgtgtggttgtaccaactcaggactcagctagtttcactggtttctttcttgctttccatttttagggaatttttttttgttcgttttgttttgttttagacagagtctcgctctgttgcccaggctgcagtgcagtggcattctcggctccttgcagcctctgcctcccagattcaagcagttctcctgcctcagcctcccaagtagctgggattgaaggtgcatgccaccacgcccggcttattttttgtatttttagtggagacagggtttcaccatgttggccaggctggtctcaaaactcctgacctcaggtgattcacctgccttggcatcccatagtgctaggattacaggcatgagccactgcgctcagccagaatttttttttttttttagacagagtttcgctcttgttgcccaggctggagtgcaatggtgtgatctcagctcactacaacctctgcctcccaggttcaagcacttttcctgcctcagcctcccaagcagctgtgattacaggcatgtgccaccacacctggttaattattttaattaattaatggctaggcgcagtggctcacgcctgtaatcccagcactttgggaggctgaggcgggcggatcacgaggtcaggagatcgagaccatactggctaacagagtgaaaccccgtctctactaaaaatgcaaaaaattagccaggtgtgatggcgggagcccgtagtcccagctacttgggaggctgaggcaggagaatggcatgaacccgggaggcagagcttgcagtgagccaagatcatgccactgctctccagcctgggctatacagtgagactccgtctcaaaaaaataataaatatttatttatttattgagatagagtctttgttgcccaggctggagtgcagtggcacgatcacggctcactgcaacctccacctcccaggttcaagtgattttcctgccccagcctcccgagtagctaggattacaagcgtgtaccaccacgcctggctaatttttatatttttaatagagacagggtttcaccatgtttgccaggctggtctcgaactcctaacctcaggtgatccacctgccttggcctcccaaagtgctgggattacgggcgtgagccaccacacccagcctatttttgtatttaatagacatgaggtttccccatgttggtcaggctggtgtcaaactcctgacctcaggtgatccacctgcctcggcctcccaaaatgctgggattacaggcgtgtgccaccacacccagcctggaatattttttaagtttaaaaaaatttatatcactatggcaatacaaatgtatatacatatttgtttatacttttacaaaaaaagggaacagtaggccgggcgcggtggctcacgcttgtaatcccagcactttgggaagccgaggcgggtggatcacgaggtcaggagatcgagaccatcctggctaacacggtgaaaccccgtctctactaaaaatacaaaaaaagattagccaggcttggtgggcacctgtagtcccagctactcgggaggctgaggcaggagaatggcgtgaacccgggaggcggagcttgcagtgagctgagattgcactccagcctgggagacagagcgagactctgtctcaaaaaaaaaaaggaacagtaaatcaaaagttaataaaaatggccaaagagggagagatcaggatggaactgacagatatgtaccatatttaataattttgactttggaactctgtcagtgtttacataattaaaaagcaaacttatatttaaaaacactacacattgaacattcatagtttgtctttagatccatttgccgggttagaattgggaaacccaaagtgaagacttctgcctgtgtggtaagaccacccccgactcacccaggtcaaaaatgtccatccaagggacacttcaccagatcagtggccacagactccaggaggctgcccagaaaggccagctcacctttttaaacctagggcatggaattaaaactggagtttcaaaacttatggctctaggaacaaaaaaaatttttttaattaaaaagaaaaactggagttactactatgagtggcggaaaatgaccaagaaggaagaggaggataggtccttaggatggtgaccacagttgtgtatattagtccattttcacactgctataaagaacttcctggccaggtgcggtggctcataactgtaattccagcactttgggaggttgaggtgggtggatcacctgaggtgaggagttcaagaccagcctgaacaacatggcgaaaccctgtctctactaaaaatacaaaaattagccagatgtggtggtgtgcgcctgtaatcccagctactcgggaggctgaggcaagagaattgcttgaacctgggaggtggaggttgcagtgagctgagattgtaccactgcactacagcctgggtgacagaccgagactctgtctcaaaaacaaacaaacaaacaaaaaaacttcccgagactgggtaatttataaaggaggcttaattgactcacagttccacgtggctggggaggcctcaggaaacagaatcatggtggaaggggaagtaggtccgtcttacctggcagcaagcgaaagagagcaagtgtgtgtgtaggaggaactgtcaaacatttataaaaccatcagatctcctgagaactcattcgctgtcatgagatcaacaagggggaaccgtccccatgatccagtcacctcccaccaggtctcttcctcaacacctgaggattacaattcaagatgacatttgggtggggacacaaaacctaatcatatcagtgtgtcagtttgtgaaggaggtatctctgcatgtttctggaacctgtctgtcactttggaacattgttctaaacaaccagctcacaagtgagtttttagtacccagcctgctttttctcgtacttgacaactccagaaattggtttgagagttgtgcttcttaaacccatgggaagacacagaggagacaaaggctgactgtcgcccgctttgcaaccctgccccccaggtcccagcccccagccagctggaacttggcctggccactggctggactcaacatcaatcctggagagcttgtccacaccactagagccaccgggccttacccttgcctggtctaccaaatgccgggagtcagcagctgctgacaaggccctcctcatggagagggccgagcctggctgacagggaccttgctctcctgcagatgggctatgtgcgggagtatattctgtgggcagcgtctaaatcccagcttctggcacaccagttcatctggaacatgaagactaacatttatctagatgaagagggccaccagaaagaccgtgagtattttgtcctcccacaggcctcacttactgtcttcagtgcactgccaagcaccttctacagcccccagggctctcgccagcctgcactgccccagctcaccgacccctccactcccaccctttgctggggcacttctcacctttcagcacacaggggagcaggacccctccttcatgacacctttgctaacttgctgtccgatgccaccctgcactcccaagtgcgagtgagacccttctgctccagtggctgcttctgcagagtctccatggtcaacacaactgtgactgcatgtgaggaaggggccgtcagcccagggcagcggttcccaaatagcacagcctcaggacccctgcactgtcagaaatgtttattgaggtcctcaaagagcgctgtttaatgtgagcattagctgtcagtgttaacgagtattagagattaagacagaatttcagaaaatgtaagcccattcattacatgttaatataaataacatctttttgggaaaataactttccccaaaaaactaaaaaatgagccaaaagagtggcatttccttgtagaagacggctggattctcattctcgttccacttctgcagttgatctgttgcagtgttgtttcagttgaagtgaatgtagttgaaaaaggaagttgtatgttagtagtctctcaggtcattgtggagattctttttgatactgcaccacacttgagaagtggtagcttttgttttatttttttagaggcagggtccctctcccaggcaggaatgcagtggcgcaatcacggctcactgcagccttgaccacctgggcttaagcgatcctcctgcctcatcctcccaagtagctgagactataggtgcacgccaccacgactggctaatttttaattttttgtagctcagcctagcttcttaatgattacttgcagtctgggcatggtggctcatgcttgtaatcccaacactttgggaggccaaggcaggaggatcgccaaaaaaaaggttaattgcagtgtggcatcttaaacttggcagtaaacttctcatgctgtgttttgttcaagtctgtctacgtcgcacctggacccacaaaagcttttataacatcaaacggtgggcatttgtaaaatataggccagtgagttatgcacatctttcaaaggttgatgcatttctttgtacagtgtggaaaaatcatatttgttcacatctgccagtcttaccagaaagggttttttttttttttttttttttttttgagacagagtcttgattagtcgcccaggctggagtgcagtggcacgatctcggctcactgcaagctccgcctcccaggttcacgccattctcctgcctcagcctcccgagtagctgggactacaggcgcctgccaccacgcctgctaatttttttgtattttcagtagagacggtgtttcaccatgttagccaggatggtctcaatttcctgaccttgtggtccactcacgtcggcctcccaaagtgctgagattacaggcatgagccaccacgcccggcccagaaagagtttttaagggaagctgttgagctcacagcagcagatccaagttttccaaaaaaatgtttcagttcctttgagtggaagatttattttttgttcattttcaggaaaacatctgccacatccctaagtctgaatagctatatgttgtctgtcagtcatttcttcaagtaaaaacaaaggtctgtgaaaaaggttagtccaggctccaaaatcagacaagctccaggtgcttctcaggacagcgcctgccttagatgcggcaagagtgcttcgtgcacatcccatttcatcacaaaggatactttaaaagccagatgtggtgatgcgcacctgtagtcccacctactagctgtagtcccagcaactcaggtgactgagacaggaggatctcttgagcccaggaatttaaattcagcctgggatttgaatagtgagaggcactatttaatatagagccccgcccactgtgtgcctctattaaaaaaaaaaaaagacatgtattcagggtagagtttaataagaattagttttcattgcttcacctgtgacattcataaatgacacgggcttttttctccctgcgtgtgcagcagtgaggattctatgccctgtgacattcataaatgacacgggcttttttcttcctgcgtgtgtagcgtgtgcagcagtgaggattccacgtccacttgtgcgcttggcccctgccttgagctccgcttaggcaccagcttagcttcccagcagcgtcagctgtgtcaacacagcaaaaggggcacacggcagctgttatggtctcaccaagcctgcagagcatactctgggcactgccagtctggggcctgggaaacagggctggtattcctgaggggcctctgccacagccacagagacttaagcctctttgcttccttggcagctgacatcggcgacctcctggatcagttggtagaggagatcacaggctccttgtccggcccagcgaaggacttttaccagcgggagtttgatttctttaacaagatcaccaacgtgtcggctatcatcaagtaagtgcagtgcttcagaaaccaccttctgggatctccttccagtccctgcagcttaacagaattgcctgggaagctttaaaaatacccgtgcctggccccaaccagatgaatgagagtctctagcagcggggccgctggtggttctgatggacagccagggtgggtggggaagcactgcttggggtgagccagggctcttgaaggtatggcagaatgcacggccacgccagtttcaggaaacacagcttagtttcattcctgaggtttgtggaatttagcacatggctccacaatttgaggccaccctgccctctccacactttgaaggatcgatcctcatggtgtcaggaaaaccagactgcctttgcaggtcctgtcatcgttttcctagaccttccattcatgtggacctgacaccatccttggatgttgatggctttgtgcattcataagggatgaaaccctggagtcatcaatgctgggcacgctggctgggctgtctccagtgcttacactgctctgaccttggtcactttgaggtccttttctgggctgggtgctgagaatagcagtgctggcagcttctaacccacgagatgaaggacgggagctagcgtttcctgggtggcagcaggtggcaggcattattacccccaccacccccagccacacacccccgcacacagcaggggcagagcctgccagaaaacagcccttccggggctgtcggggattctccatgaggaatgcagggcaagaatcgctgccagtggtgcctggctgcgctaggagcagctagagccgggaagagagggacagagagggcaatccaggcaggaggggccctgggctgtcccccagcagccagttcctccaggagacaaagcaagaatttctttcctgtttctcaggccctaccctaaaggcgacgagagaaagaaggcttgtctgtcggccctgtctgaagtgaaggtgcagccgggtgagcaggtggcttctggaggctcagaccaacctcttcctgcaggcgggcggcggggcgtgaaggctgctgccctctccaggcactgcaggatgtggacacagtggcttggccagccccacacctgcttgggcccacggtgcctggtgccccaggaccccagcccctccccagaatctgccgctagtgagcgggagctgctcgtcagtgggtgcccttcatcttccttgctgcctgctgtttttctggaggctgacagtgacctcagtagctgttactctagaagagggttcctaggctccagcattacaggagcaggtcacacagacgaggggatggcgggcccagtgtgggacggctcaggtgtgctgggacccatcagcaccacccccccaccgcctccatgggaagtcgctcctgggtgcctgtggctgtggccacatgggaattcaagctgagcttttcaagagaagatggaaatccagacttcactgggcagctctctctccatttctttttttgttgttgtttttttgagatggagtttcgctgtgtcgcctcagcctcccgagtagctgggactgcaggcacccgccaccacacccggctaatttttttgtatttttagtggagtcagagtttcaccgtgttagccaggatggcctcaatctcctgaccttgtgatctgcccgcctcggcctcccaaagtgctaggattacaggcatgagccactgtgcccggcctctctctgcatttctaactattggcacaaacttgtcttccaaactctgtcctgtgcagatgttcacagcggctggtctcagctgtggagtgccctgcaggaccccggtttaaccatttcttcccaacacattgtgttgagctcacacaacagcacggcttcccagagagggcaggacatgtatgcagggcctctgttcccgcatcgggaaggccacaactgctggggaggggcaaaaagagctggaagcattgtactgcagggggcatgcacagaagtccccagcccctggctctagattgtgttggctgagtcttgccccagaggtcagggaagccagcagggctctagcaggagagcacagaggggcctgagtgtgagccacagcctggagcaggaagaagggcaggtgaggaagaggaggagatggcatgcccccctctccctgtaccccacagcaaggccaagcttggctcccctcaaagcccacctctcagggctcaaggagcacacatcccccttggggactggcagttccttggccagaaacaggctttcccttgtcctcttatttcacacatttactgagcactcactgagaaaggggagcctgggccgggtgcggtggctcatgcctgtaatcccagcactttgggaggccaaggcaggtggatcacctgaggtcaggagatcaagaccatcctggctaacacggtgaaaccccgtctctaccaaaaatacaaaaaatcagccgggtgtggtggcgggcgcctgtagtcccagctactcgggaggctgaggcaggagaatggcgtgaacccgggaggcagagcttgcagtaagccaagattgcgccactgcgctccagcctggatgacagtgcaagacttggtctcaaaaaaaaaaaactaaccaggcatggtggcgcgtgcctgtaatcccagctacttgggaggctgagaacaagaatcacttgaacccaggaggtggaggttgcagtgagccgagattgcaccactgcactccagcctgggtgacagagtgagactctatctcaaaaaagcaaaaacaagaaaagaaaaggcatgacattaggtattgtagctgttaaaaagatgagtaagacatggtccctgagctgaagaagcttgaactcacagagatataaaataaacataaagaaacaatgttggccgggcgcggtggctcatgccttaatcccagcactttgggaggccaaggcgggtggatcacctcaggtaaggagttccagaccagcctggccaacttggtgaaaccccgtctcaactaaaagtacacaaattagccaggcgcggtggcaggcgcctgtaattccagctactcgggaggctgaggcaggagaatcgcttgaacccgggaggcgtaggttgcagtgagctgagaccgagccactgcactccagcctgggcgacagagtaggactccgtctcaaaaagaaaaaaagaaacgtcttagacaaaagtcctaaaggctgggagaaccaaggacagttcatggacatagtgacatttaagtaagccttttgagagagtagtattcaaatgggtaaggaaggccaggcgcagtggctcacacctgtaatcccagcacttgggaggccaagacaggtggatcacttgaggtcaggagtttgagaccagcctggccaacatggtgaaaccccatctctactaaaaatacaaaaattagccaggcatggtgacaggcgcctataatcccagctactcaggaggctgaggcagaagaattgcttgaacctgggaggcggaggttgcagtgagccaagatcgcaccactgcactccagcctgggtgacagagtgagactctatccaaaaaaaaaaaaaaggactccaagaatggagggctgttcagagggttgctcaggcaggtggaggcaggacaggcctcacacgcacccccagaagcagtagggctgtatccgtgaggatggggctcagtgctcctccaggaagagcatttcccagaaggtgcagacttatttggttgatggctggaagagtcgaagagtcaaggaggacggacccttagcggccatggaataataagttagtggtgccctggacaaggaccagaggcccctccacaggggcggggtgtgcctgcagggtggacacgcatgtaacatccgtgttggaaactgactctggctcacctgtggtgacacatgcactccctgtgactgcctctgtccctgcacaggctgctacctgcccagcaaccctgaggccattgtgctggacatcgactacaagtctgggaccccgatgcagaggtgggcgcctcaccctacccatcccccacttccacgcgtccgcgtgcgaagtttttctcggctgcatcatgggtgccacattctttttgttgttttcagtgctgcaaaagccccatatctggccaagttcaaggtgaagcgatgtggagttagtgaacttgaaaaagaaggtcagtaaagaaccctgattttgtttgggagctcagtgcttttccttgctaatgccagtttcttctggcatgtgttaaatttagtatagctctccataaaagatgatgtctgtccatctgtctgccctcactcagtcagatccctcattgggggatggcagggagctcaaatgcactgacagatgtgccaccccagaggtctgtctgccgtgagtcagctggcatgctccagcaggctccttcctgaggctgaggggcccggggctgttggggggtgttagtttcccagggctaccgtacggacgatctcagttctggaggctggagtccatcatcagggccgtgccccctctgaaggctctgggcaggtcacaccttgcctcctcagcttctggtggtgttgccagcagtcctggcactccttggcctgcagatgctccactcccatctccgcctccctcttcacatgatgatctcccttgaaggacatcagtcattggattagggactgtcctaatccactgtgaccttgtcttaacctaattacatctgcaaagaccctgtttccaaataaggacacattttaaggtttggggtgaacatgaattttagggagacactcttcaacccagtacagacggtgtggccagctgtggagagggggctgccaccccttgcagggacctgcctcccatggccatgtctgcacgctggccccgagccctcccaggaccccagtgtacagacacattcctcctgccccctagctcacagcacccaacactgacccaggcacacctgggtcttcactgcagatgaaatggggctctgtttttagttccatttaagcctaaatgttcttagactccaaccctggattccacctgctgttccaaggctttccttgggccctgctgggctcctccttggcctccttggggttttgaagaagtgatccccaagattgctggggttcctttcaggcatgtgagaggactcatccctggccccctcagagggcttctcactgcctacaggctaacagcggcctctctccctgcgggcaggtctgcggtgccgctcagactccgaggatgagtgcagcacgcaggaggccgacggccagaagatctcctggcaggcagccatcttcaaggtgggagacgactgccggcaggtaagcagggtcaggcctcgagtaggcttggggactgggcttgctgctccccaaggctccaggcccgccagagtccaatctcatatgcagaaatgtgaatcttttccttctcttatatggttcaggtgccacggggtaaattagggcttctgcaaaacccagaggcctctccttccagcccctttcccactgtccccgccatgccagtgcccacctgagggaactgtccaggggttgggtgccttatctcacacaccccaccagacagctcagcctcatgctcagcccagggcctggtggtcccagcagcctgagtccagcccccggtggtcagaaaggaaggccttccagactcttgctcggctgtggtctccccacctcactccatctctgggtgcttggcttttgccctgcatgagccagaagagctgctggggtgcaaggacgccaactgaccgcatcctgcgcctcccggcttcccaggacatgctggccctgcagatcatcgacctcttcaagaacatcttccagctggtcggcctggacctctttgtttttccctaccgcgtggtggccactgcccctggggtaagttccctgagtggagccagtagggcagccctgggcacctcgcacccagcgggcctcagaactggcctttcctcctagtgcggggtgatcgagtgcatccccgactgcacctcccgggaccagctgggccgccagacagacttcggcatgtacgactacttcacacgccagtacggggatgagtccactctggccttccagcaggtagccagggtggccacaggccgggggaggtcgtgtgtgctccaccccaccccagccacccatacccagcctccacccacaccctgctctcctcagtcatcctttgttaagggttaaaaccagggcacctgggccgggcacggtggctcacacctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaggctgaggcaggagaatcgcttgaacccaggaggcagaggttgctgtgagccaagattgcgccactgcactccagcctgggcaacagagtgagactccatctcaaaaaaaaaaaaacacaaaaaaaccagggcacctggccgggcgcagtgctcacgcctgtaatgccagcactttgggaggccaagatgggcagatcatgaggtcaagagatcgagaccatcctgaccaacatggtgaaaccccatctctactaaaagtaaaaaaattaactgggcatggtggtgggcacctgtagtcccagctactcgggaggctgaggcaggagaatctcttgaacccaggaggcagaggttgcagtgagccaagatcatgccactgcactccagcctggcgacagagcgagactccatttaaaaaaaaaacaccagggcatctgtaagccactttgggagtcaaaagaatgtagggctgggttggactccttagaagaaagttaagttctgagtgtgggaggaagtgcctgcacgcccacttccacagagagcccctgtcactcctgctaccgaagactggcttgctgattcgggctctgcttccacagtgggggtacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggtcatatcatccacatcggtcagccagccacagcgccaccctcctctcccttcacccctggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctagggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgcctgttgggggtggagggggtgctcctgttgcagtccttttccactcctcaaaacagaccacttgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggtgagcctgggtgagggccagggtggaggcggagggggtgtgtggaacgttctgagatcccctttaggatgaagggaatccggttccagagagtgaggtaggtgctagcagccacctgctgacctacacctgtcctttggtcacctctgtctgcccacctgtgccagtaaattcttgctctggacatctaattccaaccaccttccccacgatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccctgcagagaaaggcaggtcagcgtgtctgcatcccacccaagtgcagaagccatggccggcagccttatgtgggggacagggcaggacactcagcctgtccagagtgcgtgtgggcagcccttgcctgggcggtatgggttaccaagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctatctctccccaggccctacatggacgcggtcgtctccctggtcactctcatgttggacacgggcctgccctgttttcgcggccagacaatcaagctcttgaagtaggttccttggtggacacgcaggccatctgggggacagttgtccattagctgaggctccatccaagataggtacctttcatgtaattgtcactgtggttgtcatctccttggaacctcagagcagacagggttcttgggtgaggctctgcccctagaccacaactgtgaggggcccctgcttgtgccggccacaccagagacccacccaggggcctctttatgtcaaggatgctacgcccaacccacctccaccctaaggtctggggctgcagtagcttagctccccaatgcttagtcccctaatgccatggggccactcaggtgatgctgggaaggggacagggcccatgataggccaggcgtggccttcacagcaccccatcttccaacatgtggaccccaaaggtacatttccagggcgtggctctcagctgaagtccgtccccatggaagaccctcctcccactgggccagggagccagcacggccctgcccatggcagccctgacacagcctctcccccaggcacaggtttagccccaacatgactgagcgcgaggctgcaaatttcatcatgaaggtcatccagagctgcttcctcagcaacaggtgagtgccccgcccccctgccttctcccactgcctcggtggccactgggcacctgcagggccttgcctgcaccaggcgatgaggattctgctgtccccaagccgcccctctcatgaagacccaagtcttgacaggagctcttgaggagcagtggggtgctggtttagggggctgtggtgtgccgaggggaacacttggcagaggccgggcccacctgggcagggctcgtgaggccgaaggagcaatagggacacaaggccaggagtattagaactgagtgtggtgtcaggcctccctcctcccaggagggctgaggagtcagagcccactccttccctgcgcctgcctcgggctgcttcgtgggcagtgactggaggtgcaggccgggctgctggtcactactgtggtgggaggagatgggtgcagggggccctggggagggctggctcagggtctgaaggcagagcaccgggctgacaggctccctgctgtgggagtcagaggtggctttgaggggtccggcctgaacaaagggaggatggcgatcccagcaagtgagccatccccgaagggggcagcacttaaacatgtggggttggtaaggccctgaggggcatgtgggagcccaaggctgtgccatgggacagaccacattcacagactaggaggaggggcccaggtgtggccatctgcatggggaactgccggaggagcgtgagaggaagctgagacctgcccccaggtggcgcccgggtccggcaccctaacaagggcactgtggaggctgggcacggaaggagctcttgctgataggaagcagagaagccaggcggccaggacctcaagaggggctggggcagggcgagaaggggctctccagaggtgcgaggagagcgtacagaccccttggaggcatctggccaggacgagccaaggggcccgagtcccatggggcagagcagtggctcccacggatggaagcggtttggctgaggagcatgaggtggcctcggagtcccccgggttggagcaggagatgtggtcactgggtgggggagggcacgcctgggacatttgtaccttcaggtgctgggcagccataaggggctgattggacaggtagggctccctgtggggagggaccccagaccctgctggctcctcgaatctcccttcactcttccttggcctttcaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttggaatctgtgaggttttgtgtcaagtcctaagtccaccttcagccaaagggcagttcctggatttgcccctagagaggggggcccagtgttggctgcactcataggctggggcccaggagcacgggttgtggcttaacaaacatgagattcccacaatctcaccacggcataggtgcaccaaaacacacattgtgtttgtcctgactgctgtctgcccgctccaaaactgtctccctcagggctgccgtgggggcctgtctgtggctctccgcagcatcttcccactgctctagtctttccctcttgctcattttgaagtgctgtgctctggaactccaaaatctttgtgtgactagacccagcaagcatctactcccacccaccgaggccctgcatctgaagcagataggaataaagacctgaaacaaaagagaaactccaaaagatcagctaaacagcagcaggtaagaagagaaaatcagtgatcagaatagtgaaatgaccaaacatgcagtgtgaaggaaaggaaagccaagcggggtggctcctaatcccagcacttcagcaggccaaagcaggaggattgcttgagtccaggagttcaacaccagcataagcaacacgggaagaccctgtctctacaaaaaaatttaaaattagccacatggtggtgcatgcctgtagtcccagctactcaggagggtaagaaagataggatcactggagccgaagagcaagactccagtgagctatgatggtaccgctgcagtccagcctgggtaacagggtcaaaaaaaaaaaaaaaaaaagttgaatgaaaagctccagtcaactttttcttttttttttagacggagtctcactctgtcgcccaggctggagtgcagtggcgtgatctctgctcactgcaacctctctcccaggttcaagcaattctcctacctcagcctcctaagtagctgggatttcagctgcacgccaccacacccagctaattaatttttgtacttttagaagagaaggggtttcgtcatgttggccaggctgatcttgaactcctggcttcaggtgatctgctcgcctcggcctcccaaagtgctgagattggagccaccgtgcccggccccaatcaatttctaatgggatttccagagttgaaaaagacaaatattcagctttaggaagcacagttgagtcctgagcagtacaaataaaaatataggctgggcacagtggctcacatgtgtaatcccagcactttcggaggctgaggtgggtggattgctggagtccagcagtttgaaaacagcctgagcaacatggcaagaccccatctctacaaaaaatacaacaattatccgggcatggtggcacaagcccgtagtcccagctactcaggaagctgaggtggatcgcttgagcccgggaggtggaggttgcagtgagccaagatcacaccattgcactccacactgaatgacagagtgagactgtcttaataaaaaatatgagtcagcgtataagttaaaaggagttttaaaagatactaatccaaaagaaggcagaaaaggagaaacataatagacttaccagcccaatttaaaagtcagggattataaacatgaattgaagaagtgagacccagttatgtgctgattataaccaaagcactttacatatgaagacagatctaagatgaaaataacagatggaaaaaagacgggccatccataatcaaaatgtgtatgggtgtttatgaaggggcatttcacaataagcaattgacggcgctaccaacaagaaagtaaacacaggagccctgaacaagcctgtcactcaccttgacctgctgggtatttagaacacactctgtcggcctgacacggtggctcatacctgtaatcccagcactttgggaggccaagccaggcggatcacaatgtcaagagatcaagaccatcctggccaacacagtgaaaccctgtctctgctaaaaatacaaaaattagctgggcatggtggcatgcatctgtagtcccagctactcgggaggctgaggcaggacaatcacttgaacccaggaggtggaggttggagtgagccgagattgcacaccactatactccagcctggcgacagagcgagactccgtctcaaaaaaaaaatcactctgtcaacagcaacaatacactttcttctcaatgttcattacaagctttgtgctgggccacaaaacaagtctcagtaaatgagatagaattaaaatcacgcagagtgtattctctgtccgcagtggaaattaggactcggtaagatatctggagaaaatgttggccaggcacggtggctcatgcctgtaatcccagcactttggggaggccaaggtgggcggatcacgaggtcaggagatcgagaccatcctggctaacacagtgaaactctgtctctactaaaaatacaaaaaattaaacgggcatgatggcaggcgcctgaagtcccagctacttgggaggctgaggcaggagaatcgctggaacccgggaggcagagcttgcagtgagccgagatcatgccactgcactccagcctgggcgcagagcaagactccatctcaaaagaaaagaaaaaaaaaaaaagtagcacatgtgatcagagggaaaagacctaagatgctttaaggcggtttaggggaagatgacagcaatgagctgagctcaagtagtaagaataccagaatacagagtgtgacttcccaaataatcaaacagaaggaaaggggagcattgaaaaatcaggatcaacatgttacaaatggtagaaataaattcaaatatagtagaaataatttcaaatcacaatacttgaaaaaagcagcttgtcaaattggcaaagaaaaaagtgtcaaatgctatgtacaagtttctggcaatatggcaaattatgtatcctgaaaaactaaaaatgctgtttacaatactggggagtggatctaaatccatgagctgtaagaaaggaaggaatctttggaggctgaaaagccagtcaagctcctacatgacatgggagacagacgacgaacccacgagcttcatcccttgaggagtttattaggcgaccttggtctacactctcaggagaggagtgcaccagaaataaagccggtgccctggagtccacctggagccaggcgcggggcgctgcacttaggttggcagcagcccgttagcgcgcagctccagcagcggggacagcgtgtagcgcaggcggcgcagcgtcgtctccgaggtgaggctccagagccacgcggagacggcgccggggtccaacagcaccgtccagagcagcgacagccccaggaagaggagcggcagcgtcagcagcgcctgcagggcgaaaggcgggcaggtgggcggcggctcgggcgggcacgtgggggaccgcggccgcgcccaccgccctgctcacctgatggccagcgcgcgaggaccgccgaacagccgcgtctcctgcggggagagagggccgcatccagctacctccgcgcccgcggcgccggcccggtttccaggaggagggggaggcggtaccgcgggggggatggggaggggtgtcccgctccagcccaccccgcccggacccgcgcaggcgctcactcggtccgccctggccatctcctccatgagcgactcggtgctgtactgcactctgcgaagctgcccgtcacacctgcggggacaggcatgcaggtgggagcccagcccggcccggccccacagtgccccgccgcgcccgcaagcccaactcccttacagttcccggccactctgccaggcgtccagctcctccgcagcctccatcaccttcacctgcacctcctggagcgggtgagagtgcggactgaggcctcggggaggcgtcctggcggtgggttgggagacttaccgccccaggtctgggggaggagaggcgggaggcaccttggcgtctgagtggggccgcacctgcaggactacggtctgctcctggaatatggcccaggcctccgctgtctgcagcgcgtcctgggtgtggacacccgggttagactcggcgggggcggggcgacaggcccttccccatccacactcgaaagcctaccctcctccaacagaacccgcttctgccctcacctgctgcagcttctcctcctgcaaggcgcatttggtctccgccagctccagttcattcttgagaaggacccagggaatgtcaggaggtccgcaggccggcaacccgctgcgcctccgggccccgcccccggccctcagtgcccgcccccaggcgatcatgaccccgcccacgtcctcaggaccagtcgtaagcaacgccccagctggtcatggccccgccccctccgcgctccgcccgtatctagccctcagggccccgcccccaggcgattatgccccgcccacatccccgccccgcccacgccttcagggcctgccttaagccacacccccaggtggtcacggccccgctcacgctgctgctccgcccctactaaagacctcagggtcccgctcaagcacctgcagcgtcaccaattgggctgcgagttgctgctccgtgctcttctggctctgcagttcccctccgtagtagaagagctaggggcggggctcgtaaggacggggtttaccgggcttctggaggaacgagtgtcaggggagacagggacggggaggcaatgagagcgagggcaagggcaggacttccgagaggaaccaagagacaggccctcccatctcctgcacgtacctgactcgacagctcctcccactgccctgcagctgcctgctgtgctgctcctgcggacagggtcctggggcggtgccggcctcaccgccggtcctacctcaccccacccccggatcctgcccccttccgcccgccctgccccaccccaccctgggtccagccccattccaggactcttcctcaccaagtcctccttgtggcgctccgcctcctccagtcttctgcgcacccgctgcgcgcgctcccgcgccgcctcgcgcacctccccttgcagaagcagcgcttcctggcttcgcctccgcagcagcctgcagagggaaactgaggttggcgctacaaggcggactgggtcgctcaggatcccgcagtcgccaggaaggaccagccgcaggctcatgattgaggactgggaagtcctggccgagtcccccacctgggtccgctgggtggatcacccgttcccaagggcctagagcagagatgcgggcccgggcggatcagcctggtactctgcgaagcacctcgcggcgctgcctgcgggaccgaccctcgcgcgcccgccaggtagaggggcgttccccgcgcacctccgctcccgctcgctcaggtcctgcaggcgctggttgaggcaggctctcgctctcggcctcgagcccgcgcatcagcttctctagctcctgcttccgctggcgaccatctcggttatccttctgcaactgcagcagcagctcctgcgtcgcggccatggctgtggagaccgagcctaaatgccgcccgcctcggggacccagcctgcggctggcaggcgtcacaatgggcggcagggagcgcctagcgggctggatcacaatgggcggcaggggaagcccgagggtagcccgacacatgccccttctcacgccggccggaggcgggtcaggccggatcacacttagtccatcactgatgaaaattgtgtcaaagagccgtaattagatcaatgaaaggttaatgaaatactaataccaaatgcaggcaagttgaagattggttcccccacagtgcagatggcacttgcaaactgatcgatctcttgtggaaaagaacccataaatatgttcgtaacttttgacccaattatccctctcctgggaaatttatcccaggaaggagaaaaaatttaaacccactacacactaaatggttcgctgaagtggttacagtagccacaaaaaaaggaaacaattttaatgattaaaatgtgcttgggtattatgtggtatgcctagagctattatgatgtctagtgaaaaagaatttgatttagcatttatgctaaagtaactaagataaaatacatgagcaagatccgtaaaggaaacaggaagaagataagctctttcattgcttggtgagactgtaggtaaactcgtccttttaagtattattattttagaggcaggtcctgctgtcaccaggctggagtacagtggaacaatcgaagctagctgcagcttcaatctcccaggctcaagtgatccttccgccttagcctcccaacttgtccttttaaaatctgcctttatttgtccagttacaattatgaacttggatgcaaaaatccaaaataaattactaacaaaatctaaagggaaacagaaatccatggaaaccaaacagagtttattccagggattgttcaacatcagaaaatcagtgttgttcatcatatggacaaacagggaagaactccacgatctcagtggcgcacttcaatagatgcagaaaacgtgaagatgagggtcaccatctattaataattttttttttttttctgagacagagtctcactctgttgcccaggctggagtgcagtggcacaatcttggctcactgcaacctccgcctactgggttcaagcaattctctgccccagcctccggagtagctggcattacaggcactcgccaccacacccagctaatttttttgtatttttagtagagacagggtttcaccatcttggccaagctggttttgaactcctgacctcgtgatccacccacctcggcctcccaaagtgctggaattacaggcctgagccacctcacctgaccatctattgataattctaaaagctctttcttacaaaagggagagataaaagcactctctagtctgataaaggccacggtaaatattatagtaaggaggaagtattaatagtatatgcttttttttctttttctttttttagagtcagggtcctgctgtcaccctggctggagtgcagtggtacgatcaaagccaactgcagcagccgcaaacttcagggctcaagcgatcctcccgcctctcaccctataagaagtagtagacggccgggcgcgcttttagtctgggcgcggtagctcacgcctgtaatccagcactttgggaggccgaggtgggtggatcacgaggtgaggagttcaagaccagcttggccaagatggtaaaatcctgtctctactaaaaataccaaaaaaaagttagccgggtatggtggtgcttgcctgtagtcccacctacttgggaggctgaggcagggggaatcgcatgatcttggctcaccacaacctccacctcccgggttcaagtgattctcctgtctcagcctcatgagcagctgggattacaagcatgcgccaccacgcccagctaattttgtacttttagtagagacggggtttctccatgttggtcaggctggtcttgaactcccaacctgaggtgatccacctgctttggcctcccaaagtgctgggattacaggcgtgagcccctgcgcctggccctacacccgactgatttttgtagttttagtagagacagggtttcaccatgttgtccaggctggtctcaaattcctggcctcaagtgatctgcctgccccggcttcccaaagtgctgggattacaggagtgagccaccgtgcccggactaaaaggtacatttttaaaaaagaggtgacttaagatttcatagaaaccaactttttgtaaaactatgataagccaaatacttggaccagccctcacactgagaagtaccaaaaatgctgacaaaataaaaggatgttttcttaaaggcatccaggggctgacaagacagtgaggagccgccaggcaccatctggggaaaccagaaaccagagaggcgagccaagccgctcttgccctgaaaacatctgcccccatccagccaccccgggcttccgatgagaactctaaggctggtccccaccccacagagcaccccacagaatttgggacttatggcccaaattcacaccagtgagaagattccaaaacctcacagttgatggatttagtttaaattggctttaggctgacagcgccctgaggtacctggcagaaggaagcgtaaacctagtttggaggaagcatctttaccctaggtctgaaaaattcccacaaagtcatttttccaggacaatgagtaatgcagtcaaaagtaaccacacattcacggaaacaatgccccatgagcaaggacagaaaaggccagcagcaggaccagatccagagactcaacatctcaaagacctgaggcagaccatgaggctcctccacttacctgtactcacggagggaaccgatgagcttgaaagtatatgtgacgaacagcaaacgagaaaaaaaaatgaccttgcagaaaaacaggtgtagacattctagaaataaacagcattcagcccaatgggtttaacaggaataggagaataaaaagagaatacctacactgaagatacgtcagaataaattatgctgaataaagaagagtgagaggccgggcgcattggctcatagccagggtcgaggtcactctctccctgaggactctagcacggcacagcccctctgcctctctcctggtggtggcgttgaaacagcaccttctgctttggtcctctacagggtggcagagaaggaggcagtcaataagatgtccctgcacaaccttgccactgtctttggccccatgctgctccggccctccgagaaggagagcaagctccctgccaaccccggccagcccatcaccatgactgacagctggtccttggaggtcatgtcccaggtgtgggaagacaggctccagcccatgcaaccccagcctgacagaggtggcctctgcctgccccacccccagtcctgcccatcttccaacttgcattgtatgtggtggtggctgagattcagagacagggacttgcctaggtttgcatggatgggagtgatagggggagcctaggccacctcctgctcctgctggtgcaccttgctgggggcttaaaaccaccccaagtgttcaggtgtggtggctcatgcctgtaatcccagcactttgggaggccgaggcaggacaactgaacccaggtgtttgagaccagtctgggaaatgtagcaaaccccatctctagaaaaaatacaaagaaaaattaggcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttggggacttgggccccaaagacctccccaccagcagctgtgagcccccctctgagccactctcctcttccccactccgcgagggcaggtcgaggtgctgctgtacttcttgcggctggaggccgtccctgccccggacagcaagggacagagcatcctgttctccaccgatgtctaaaggtcccagtccatctcctggaggcggacagatggcctggaaacctctggctaatcaggctatctgtagagtgggaatcaagattttctgaggcatccttgggccacccccaggtgtcaggccatctgccaagagacagcggcccaaagcagaaggacaggtggcctgggcagatcccgcccaggtctgaaagccccaggctggcctcagactgtgggttttccatgcagccacctgagggcgccccaagccagtgcatctcagaggccaggcctggccctgggagacagagtgaaaccagtggtttttatgaacttaacttagagtttaaaagatttctactcgatcacttgtcaagatgcgccctctctggggagaagggaacgtgaccggattccctcactgttgtatcttgaataaacgctgctgcttcatcctgtgggggccgtggccctgtccctgtgtgggtggggcctcttccatttccctgacttagaaaccacagtccacttagaacagggtttgagaggcttagtcagcactgggtagcgttttgactccattctcggcttgcttctttttctttccaggatttttgtgcagaaatggttcttttgttgccgtgttagtcctccttggaaagcagctcagaaggcctgtgaaatgtcgggggacaggacctccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatacttgaatatttgtaagttttatacatagtttctaattttttccccaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattgtttgtaaaccctcctgactacctgactcaaagaaaacagaagcatggaggccgccaagtattttcaagaaataatcccatgaacgtggcatcacttttttagaaagaggggcttggggcaggcagaggagagaagggagagcaaactgagagccaagtttccagacggtcctgcaggaggagaggatgcagctgcgcagagggaagcaggatcacatttaaggaagtgtgtggggtccctggatgacaccagcacccagtacggctctgtctggcaaccgctcccaaggtggcaggagtgggtgtcccctgtgtgtcagtgggcagctcctgctgagcccgcagcttactggggagcctgacagcagggatatgtacctgacactcctctctgcttgtggacctgatgaggcagggagcagaaaacagagccacttgaaggctttctgtctgcgtctttgtgcagtgtggatttagttgtgcttttttcttgctgggagagcacagccaccatttacaagcagtgtcaccctcatgggtggtgaggacagaacaggagcctctgctctctgtacctatctgggcccagtgggctcccctgtcctggcttccatctctgtctcagtgaccattcagccctgcgcaggaacacatgttgcttagaaaagccaaatccagcccttgtctctgcctcctctggtctcatgatgtgcatctgttaccttgaaactggaaaccagtctatcaatgtctgtgccagttttttattccctccccaacctccttccccatacgactttttatttatgtaggatgtgtgctgtctaatgatgggatgaccacacttttccatgttctaaaagtgcttctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccgcgggccctgggtttgaagcagcctggctttctcttggtaagtggctggtgtctcagcagctgcaatctgagctcagccacctacacaccaccgtggccaacactttcattaaaaagtttcctgagacgacttgcgtgcatgttgacttcatgatcagcgccgctgggaagaacccctgagcttgtggggtggggctggaagcagcaggtgcagtgatggggctgggtgcccaggaggcctcagtgctcaatcaggccaaggtggccaagcccaggctgcagggaaggccggcctggggggtgcgggtgagcacaggcaggcaccagctgggcagtgttaggatgctggagcagcatccgtaactccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacatggaggattcctgccacacagcctgggcccgggttcttacctgtggccaccgctctggcacgagcccctcagtcttgggtggtttctgcctggtccgggatttggtgttgctgctgactccagcctttccaccacctctgcatgggccgtgggtgttgtcagctgcctcctgccttggcttcagtagctcacccagcttacaggggagctgccctgggctggagatgggcacgcaccctgggtcctacttgaatgaatgcagcttgaggagacccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcctctgcctgcagtgtgacccttctcagcttctctcagcagccctgcctgcggagtgtcaccgccaccatgatcatttccctgacacagcgagggtggggggacgtcctgggtagagacagggcccgtggcagcagcaggctcaggggcgccctgcactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgagggaagggctgccgctggcccgtttctgagtgttcagcacctaagggtgacagcactgtctgtccctaccctccaggtcctgtttgaagatcaaacccatgctcacaggccaattttttttttcttttagagacagggtctcactttgtcacccaagctggagtgcagtggtgcgattatagctcaatgcagcctccaattcctggactcaagggaccctcctgcctcagcctgccaagtagcttggactatagctgtgtgttttcttattattttgtagacatggggtctggctatgttgtccaggctattctcaaaattcccggcctcaagcaatcctcctgcctcggcctctcaaaggttgggattacaagtgtgaggcaaggcacccagctcagccacagagccctgttgcatctctcttactaggagcaagagctgactgccccctcatccccattccagagtgttggggctgtgttcagccgaggccgggccactggcatggcccagggagcgggatccttcactgctgccccaaatctgagatcattccaccttgacaagacttcctcatccaatccctttacttgacagctggggaaaccaatgcgcacagagcacccccagctcactcggggtctcagagctgatccatgagcagaggctgagatcctgggatcttgtcccccagcctccctgcaagcttactccctttctgctggaagagatggggccggacctcgaccagcagccctggcctggacatgactgtgctcatgcaggtattgaggccgagatgccccggcatcatatgtttttcttttcttttcttttctttttttgagatggtgtctcactctgtcacccaagctggagtgcagtggcatgatattggctcactgcaacctctgcctcccggttaaagtgattctcctgcctcagccttccaagtagctgggcctacaggcttgtaccaccatgcctgactaatttttgtgtttttactagagacggggtttccccatgttggccaggctcgtgtcaaactcctgacctcaggtgatccacctgccttggcctcccaaagtgctaggattacaggcatgagccatggcatcacttaaatgtagtgagaggccgggctcggtggctcatgcctgtaatcccagtactttgagaggacgaagctgtcagatcacctaaggtcaggagttcgagaccagcctggccaatatggtgaaactgtgtctctacaaaaaaatagaaaaaaaaaatccctgcgtggtggtgagtacctgtagtcccagttactcaggagtctgaggcatgagaatcgcttaaaccttggaggcagaggctgcagtgagctgagatggcgccactgcactccagcctgggtgacagagcaagactttgtctctaaataattaaataaataaatatggccgaacatggtgccttaggcctgtaatcccaacactttgggaggctgaggcaggtggttcatgaggtcaggagcctgagaccagcctggccaagacggtgaaacactgtctctactaaaaatacaaaaattagccagctgtggtggcaggcacctgtaatcccagctacttgggacactgaggcaggagaatcgcttgaaactggaagtcagaggttgcagtgagccgagattgcaccactgcaccctagcctgggcgatggagcaagactccatctcaaataaataaattaataaatacagagcaagattccatcttaaataaataaataaacttacacctgtaatcctagcacttcgggaggctaagacaggtcaatcacctgaggtcaggagttcgagaccagcctgaccaatatggctaaactccatctctactaaaaatacaaaaattagccgggccttttgacgtgtgcctgtagtctcagctacttgggaggctgagacaggagaattgcttgaacccaggaggtggaggttgcagtgagccgagatctcggctgcacttcagcctgggtgacagagtaagactgtctcaaaaggaataaataaaatacaaaataaaaaaaatgtagtaagattgcagagtcgtgccgcggaagcgtgctggtcctatccatgtagtgaaggctgatttcatacagaaatgtcacaagaactttttttttctttttctttttctttttttgagacggagtctcgctctgtcacccaggctggagtgcagtcgcgcgatctcagctcactgcaagctctgcctcccgggtttatgccgttctcctgcctcagcctcccgagtagctgggactacagacctgtgcagcagatgctgggggatccactaggcccagacagtcttaggacttgtgtctctcctgctgtgcatccatactgggtgctttagaaatggcaggcagaccagaagcccctgtagcaagtgaggacaaagtgtgggaaggccgtgagggtctgcagtccgagatggccttgtcctcaacctgcagtgcactgttgatgcgctggaatgccgcctccttctcccggtccaggtcttcagcagtgacccagtaccccagctctaagggaggtggcagcatcaaaggctcccctcgcctgcgtggcagcaggggaaacttgtgtctacggggcctagaggactgggatctgggggagccacccctggggccgagtgtctgccctggtgctgtatctgccgtcttttcacactgggtgtgacccgaagagacagcctcaggtccgtcctcactcactgtgtttgaggaactgagggtcagctggcagtgggatgaggctggcgcctcttccgctttcgtcccgggaggtctcccgtagagctgcaggagctcgagatggcatttcgtttggggcacgagctggtccgggaggtctgggatctctggttctgacctctgggcacctgctgcagctgtggctgaggcccagaaatgtgaagggcctccatccactccaatagtgaccccaatgtgcggttcaatgtggaggggggaggggctgctgcggcagctgcaggagcagaagtgccaggccttgttcttctcatgcccgcatccatgcttgcagctgggaagggggcaggaatcagcgaggtgacctgggctgagtcctgggagtgggaagaggtggcaggaaggggatctgaggaggagaacagggggcctggtggtctgtgcttctccccagacatgggagctgtagaggggacctctgtagcagatgctaggggggccactaggcccaggcagtcttgggacttgtgtctctcctgctgtgcatccatactgggtgctttagaaacggcaggcagaccagaagcccctgttgcaagtgaggacaaagtgtgggaaggccgtgagggtctgcagtctgagatggccttgtcctcaacctgcagtgcactcttgatgcactggaatgccgcctccttctcccagtccaggtcttcagcagtgacccggtaccccagctctacgggaggtggcagcatcaaaggctcccctcgcctgtgtggcagcaggggaaacttgcgtgtactgggcctagaggcctcggatctggaggagtcattcctgagggcgagtgtctgccctggtgctttctctgccaccttttcacactgggtgtgacccgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcacgagctcgtccaggaggtctgggatgactggtcatatctgatttctgacctctgggcatggaggtctgtctgcagaggcccgggcccgggcacaaagggagagaggcctccattgtcccgcaggggccgaaatgcagacggtgcatccccggtgacctcggggacccttctctgatcaccaggattctcttggactctagggtccttgtcctgctcaggcatccctgccccgctctccttgagggccctcaacactatcttccctggacacaagtctggggacagccggctgttgtggaccccaaaggggtgactcccagctcctgggccccacagagagtccatgttctcagtgcagtggctgagctggaggacgccctggaactcggagcacacagcactggcttgctgtggtacctgtgcaatcaaattgaaggcaggatcccagaaaggaaggcagggcttgcaggatcacggaaaaccttcttagagttgtcttgacaccacggatgtcaagtgtccgggtgcttgtaggatggcctgccactcagtccacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagcgagcttaacggattaataagcgcagccaggtacccgcgcgaggcacttgctggcaatggcgggaggcggacgtggggggtcatgcaataggtactggaaggagagaggcgggcacaaaggtcgcgggaggaacaggtgcccacaatggcggcagatctgcccgtggatcactgaagattcctgctctcctgctgaggtggagattgcagtgagctgagatcgcaccattgcactccagcctgggcaacaagtgcaaaactcagtcttcaaataaaaaaaagaaaaagaaaaacaaaaggccgggcgtggcggcttatgcctataatcctagcactttgggaggtcggggcggacggatcacgagatcaggagttggagaccagcctggccaacatagtgaaaccccctttctagtaaaaatacaaatttagtcagacatggtggcacgcgcctgtagtcccagctactccggcggctgagactggagaatcacttgaacccgggggctgggaagggattgcgatgcgccgagatcgcgccactgcactccaacctgggcaacagagtcagagtcttttttttttttctttttttttttttgagacggagtctccctctgtcgcccaggctggattccagtggcctgatctctgggctcaccgcaagctccgcctaccgggttcacgccattctcctgcctcagcctcgggagtagctcggactacaggcgcccgccaccacacccggctgcttttttgtatttttagtagagacggggtttcaccgtgttagccaggatggcctcgacctcctgacctcgtgatccgcccgcctcggcctcccaaagtgctgggattaaaggcgtgagccaccgcgcccggccgagactctgtcttaaaaaaaaaaaggccggggctgtggcactttgggaggcggaggcgggtggatcacgaggtcaggagttggagaccagcctggccaacatagcgaaaccccgtctctactaaaactacaaaaaattagccgggcgtggtggcgggcgcctgtagtcccagctactctggaggctgaggcaggagaatggcgtgaactcgggaggcggagcttgcagtcacccgagatctcaccactgcactccagcctgggtgacagtgcgaacctccgtctcaaaaaaaaaaaaaaaaaaagagagagagagacacagagaaaaatgtttattgacttaatgcacttttatgcctgtgttcttcaatttgcttaggaaagacctacacttgagagctgggactgtggccgattgtggacatgaaatatatggtttcttgcaaaaactagacactgaataattacgatttagttgagctagaaatccatttggtttcttccatatttttccaaaattttcatccttttttttttaattttgagacggagtttcgctgttgtctcccaggctggagtgcaatggcgcgatctcagcacctgctggcaatggcgggaggctaggggacgctggcttgataggtactggaaggagaggcgcgcgcacaaaagacttgggaagacctggcgcgcacaatggctgcagatccgccagtggatcactgaagattcctgctctcctgctgaggcggggattgcagtgaactgagatcgcaccattgcactctagcctgggcaacaagagggaaactccatctcacacacacacacaccaaaaaaaaaaaaaaaaaaaaaaaaacacacaaagaaaagaaaaagtagtggccaggcgtggcggctcacacatcccagcactttgggagattggggcgggcggatcacgagatcaggagttggagaccagcctggccaacatagtgaaaccctgtctctactaaaatacaaaaattaaccagacatggtggcacgcggctgtagtcccagctactggtgtggctgaggcaggagaatcacttgaacccgggaggcggaggttgcggtgtgccgagatcgcgccactgcactccagcctgggctacaaagcgagacttcctgtcaaaaataaataattaatttttaaaaattatgtagaagataaaaactttatgttctttttaatgtttgctgtccataaaatcatctgggcctggtgcttttctttggttttgtttttttgtgagatttttgaggggatgggatacagatttttttttttttttgagacggagtcttgctctgttgcccaggctggagtgcagtggcaccacctcggctcactgccacctccgcctcccgggttcacgccgttctcctgcctcagcctctggagtagctgggactacaggcacccgccaccagggccggctaattttttgtatttttagtagagatggggtttcaccgtgttagccaggatggtctcgatctcctgaccttgtgatccgcccacctcggcctcccagagtgctgggattacaggcgtgagccaccgcacccggccgggatacagattttaaaataaacattcaattcctttaatggttctagatctagacaaacttttctgcttctccctactttgtttttatgaagttatatttttcttttgagacagaatttctctgttgcagtcacgcgatctcggctcactgcaacctccgcctcccaggttcaagtgattctcccgcctcagcctcccaagtagctggggttacaagcatgttctaccacacccagctaatttttgtatttttagtagagttggggttttactatgcttgccaggctggtctcgaactcctgaggtcaggtgatctgccaacctcggcctcccaaagtgctgggattacaagcattagccaccccacctggcctgaagttatatttttctataaaactgcctgttttgatattttaaaaaaatcactggcataacttggtttatgtaatgtccttatgagttttgtcttaatattatttatttattttatatatttatttagagattgagtcttgctctattgcccaggctggagtgcagtggcctgatcttggctcactgcgacctccgcctctcaggttcaagcaattctcgtgcctcagcctcctgagtagctgggattataggcacccaccaccacacccagctaatttttgtgtgtgtttgtggttgttgttgttgtttctttttgtgagacaaagtttcgctgttgttgcccaggctggagtacaatggcgcaatctcagctcagcacaacctccacctcccgggttcaagcaattctcctgcctcagcctcctgagtggctgggatgacaggcatgcgccactacaccaggctaattttatatttttagtagagatggggtttctccatgttggtcacgctgttcttgaactcctgacctcaggtgatccgcccgcctcagcctcccaaagtgctgggattacaagggtgagccaccgcacctggccattttcatatttttagtagagacggagtttcaccatgttggcaaggctggtctcaaactcctgacctcaagtgatctgccagtctcggcctcccaaagtgccaggattacaggcgagagccaccgcacccggcctagccaccacgcccggcccatttatttctaagtagaaaatacatttgtatatttcaaaattcagaaggcatcatctcaaccctgtccctattcctgcagtttctcagatacaaccaaatagattcaatttcttggtatctttctagagatagtttatgaatataaacaaatatccaaataaataaatatgttcttttgctttttttatacaaatattactttattgtacctattgatctgttcctttctctttctttctttttattattttattttattttttgagacaaggtcttgctctgtggcctaagctggagtatagttgtgcaatctgggctcactgcagccttgacctccgaggctcaagcgatcctcccacctcagcctcccgaatagctgggactatagggccatgccaccaagcccggctaaactttttgtatgtgttgtaaaggcagagtttcaccgtgttgtccagcctggtctcaaactcttgggctcccgcgatctgcccaggtaggcctcccaaagtgctgggattacaggcatgagccaccatgcccagcctccagctcttatagtggacctgatattataatgcccacttcctatgatgaaaaggaactgaatgagtgtggaatctctaggaccacgctggcatataatgggcccttggggtttagtttagtagcaaattaaaaggtgcccattcctcaaaaccttctatagacgtttttcacgaaactgccatggataaatatctgcaaatcaaagcaaaactttagggacaaactacatcagtctttgcctgtgaattttgcatctatgatgcaaatgacatccctctaaggtgttacccttctgcagtgcactacctgtgcaactgtcctcagcaaagatagagtaatctgcagtaactgagtggtggctgccccctttacagaggcataagttctcaacttgccacagtctgcaccattctgctttgttaccacttgtgtctgcactgagtccccacgtcagccgtgtgctaagtcctatggagctggccttcacggtgctcacacacctgtaccctcctctgtgccccacggaccctgcactcatctgggccttcatgtgctctcactcattcctgtcacacaaacccctactaagtactgcacattgaactgggcatggtatccaagatgcccaagcaagtccctgccctccccatgttcatgttctggtgacctcaggaaactattaaaatataaggaggggtgtacactctacttttgagaatgcaaacgggcacagcctttttggaaggcaatttatcatcatgcactgagagcctcaaaactgcctgtgccctttgatacaatcatttgactaatgtgctctagagaaataaccagagatgcataaaagattgatgcctaaagatgctcatggggctggatgcagtggctcacacctgtaatcccagcccttttggaggcctaggtggctggatcccttgaggtcaggagtttgagaccagcctgacgaacatggtgaaaccccagctgtactaaaaatacaaaattagccaggcatgatggcgcacacctgtaatccccgctactcaggaggctgaggcaggagaattacttgaatcctggaggtggaggctgcagttctcaccattgcactctagcctgggcaacaagagcaaaactctgtctcaaaaaaaaaaaaagatgcccatggaaatgctgtttatcataatgaaaattggaagtgtccccaataacaggggattggccaactaaaatttggatatgttaaatgttaaaagcaaatgttaaaagccacatgctcaaagaacacttaaccattcatgaaaatacacatgattaatgttcagtgagaaaattgggaagaaaaaaatcacatggcagctgggtgcagtggcacgtgcctgtagccccagccattcagaggctgaggtaggaggattgcttgagctcaggagttggagaccagctggggcaatacaataagaccctgtctttaaaaatcaatcaatcaatcacatggcttgtctgacagttcctcaaaagcttaatcatagaattaccatataacccattaattccattcctaggtatatacttgaaagaaatgaagacatatgtccccacaagaactccagactgctggttccatgggatctcacctggggcacctgcctgggttcttcattggctgagagaggataagtggaggtctgggcatgatgctccctatccactgaggtttcgatctgcaggcgcagcacctgcaaggctgccctctgcccctcccctgactgtctgcaggtggactgtggtgctggaagcttcacttgagtggctgtgagagagattaggatcccttttcattcaattttgccactttttttttgagtcagggtctcactctgtcacccagttgcagtgcagtggtgtgatcgtagctcactgcagtctcaaattccttggctcaagtggttctcctgtctaagctccccaagcagctggaagtacaggtacaggtcaccatacctggctaaagtttttagagatgggggcttgctatgttgcccaggctggttgcaaacttctgacctcaagtgatcctgtgccatggtctctcatgtcttgggtcaattttgatttttttttttttttttttttttgagacagagtctcactgtcgcccaggctggagtgcagtggtgctatcttggctctctgcaacttccggctcccagattcaggcaattcttctacctcagcctcctgagtagccaggattacaggtgtgtgccaccacgcccggctgattttttttttttttttgatatttttttttagtagagatagggtttcaccaggttggccaggctggtctcgaactcctgacctcaggtgatccacccacctcggccttccaagtgctgggattacaggcatgatccattgcgcctggtgaattttgattttttaatgtagaaaaagtgccaggtgagatggctcacacctataatcttagcatgttgggaggctgaggtgggaggatcccttgaagcctacagttcaagaccatcctgggcaacacagcaagatccccatctctacaaaaagctttttaaaaaattagccaggcatgtggcacatacccgtagtttcgggtactcagaagactgaagcaggaggatcacctgatcccaggagtttgtggcttcagtgagctatgattgtgccactgcactccaacctggggaacagggccagattctatctcaaaaaaaaagggaaggaaacaaaaaaattgagttacaaatcagtgctgattctaaccctgatttttttcaacccagacttgagtgaaagcctttccagaaatgtgtctgtgtagtttcaattcttcaggtttgggacaaccgatgtcaaacgtccttaccatttccttctaatggcctgttcttgccttaaccatgtgcctgctgctctgagaattcctgtcagcactggatctgtcattctaaaagaaatagaatgtcatatggcattatcctgcccaaatatacacttacttgtcacaatgtatggtcattatcagaagcccctagtctcgtgggaatgccatgggctttggaatcagttcagggttgggaccaaatcctgtgtctatcagtgtgagatcctggacaagattctgagtcaaagaatcataaacgatcaatcaataactagcctgggatgggcatgatggttcacgcctataatcccaggacctcgggaggccaaggcaggtggatcacctgaggtcaggagttcaagaccaccctggccaacatggcaaaacctgtctttactaataatacaaaaatttggccggagttggtggctcatgcctgtaatcccagaacttcgggaggccgaggcaggcagatcacctgaggtcaggagttcgagatcagtctggccaacatggtgaaaccctgtctctactaaaaatacaaaaattagccgggcatagtggtatgcacttgtaatcccagctactcagggggctgaggcaggagaatcacctccaggagaacccagaggcagaggttgcagtgagccgagatcgtgccattgcactccagcctgagcaacaagagtgaaactctgtgttgtaaaagatagaagaaaaattagctggatgtggtggtgctcacctgtaacctcagctactcgggaggctgaggcaggagaattgcttgaaccagaaagcggaggtttcagtgagccgagaccatgccaatgcattccagcctgggtgacagagcgagactctacctcaaaaaaacccaaaaaacaaaaaaacaaagaaaaacaattagcctgaattgaatattctaccttctattccttaactgttgttatctgttatcactagtataatctgactagcccagattttattctgagctttgagggaaatagttttgaagacttatagttcaaggaaaatctttccctgggctcagacttgtgtttttgtgaaatggggctaacgtctaccccgcaaggccatcatgaacataagctgagatgacagacctaagggaaaggccttgcacagagaaggactccatcagtgccagttctgttcttcacaaccccttggttttttgtttttaattgaggaacaacatctatgctgaaaaatgcacaaagattaagcatagagcttggagaattttcacaaacagcataggtgtctatgtaaccagcccccagatctggaaatacagcatagccgggcatggtggtgggcacctgtagtccctgctattctggaggcttaagcaagaggatagatagcttgagtccaggagctcagggatgaagagagctacgattgagccactgcactccagcctggtgacacagtacgatcccatttctaaataaataaatacagcaggcctctaaacatcccccattgtccccttctctcctggatcttactagtttgcgggtatgagactgtcatccacaggggagaagccgcccgaaggagcttctctgagaccttgcgtgtgtgagtgaaaaatggtgaagttctcagatagtaacaaagttcatccttgtaatgggtgtctccttaggatatccaggtgaacgcagagtttgatggccttgctagctcagtgaagggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgcttcgacctccaggttgaggagctctttgattcacgaggccttgttaccacttgtgtctgcactgagtcctcacgtcagccgtgtgctaagtccacacggtgctcacacacctgtaccctcctctgtgccccacggaccctgcactcatctgggccttcatgtgctctcactcattcctgtcacacaaacccctactaagtactgcacattcaactgggcatggtatccaagatgcccaagcaagtccctgccctccccatgttcatgttctgatgacctcaggaaactattaaaatataaggaggggtgcacactctacttttgagaatgcaaacgggcacagcctttttggaaagcaatatatcatcatgcactgagagcctcaaaactgcctgtgccctttgatacaatcatttgactaatgtgctctagagaaataaccagagatgcataaaagattgatgcctaaagatgctcatggggccggacgcagtggctcacacctgtaatcccagcccttttggaggcctaggtggctggatcccttgaggtcaggagtttgagaccagcctgacgaacatggtgaaaccccagctgtactaaaaatacaaaattagccaggcatgatggcgcacacctgtaatccccgctactcaagaggctgaggcaggagaattacttgaatcctggaggtggaggctgcagttctcaccattgcactctagcctgggcaacaagagcaaaactctgtctcaaaaaaaaaaaaaaaaagatgcccatggaaatgctgtttatcataatgaaaattggaagtgtccccaataacaggggattggccaactaaaatttggatatgttaaatgttaaaagcaaatgttaaaagccacatgctcaaagaacacttaaccattcatgaaaatacacatgattaatgttcagtgagaaaattgggaagaaaaaaatcacatggcagctgggtgcagtggcacgtgcctgtagccccagccattcagaggctgaggtaggaggattgcttgagctcaggagttggagaccagctggggcaatacaataagaccctgtctttaaaaatcaatcaatcaatcacatggcttgtctgacagttcctcaaaagcttaatcatagaattaccatataacccattaattccattcctaggtatatacttgaaagaaatgaagacatatgtccccacaagaactcgtgcacgaatatccatagcaacattatttataatattctaagagtgaaaatgcccaccagtggataaatgcaacgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaactgcatggtatgtgaatggcatctcaataaaactgttttgaaaagaaggaaaaggacggacacatgctgaaaacgggtgaaactagaaaacatggcgctaagtgaaagaagccagccacaagatcacgtgtcgcatgactgcatttacgtgaaacatccggagtacccaaatctatacagacagaaagtagattatacattgcctaggtgcagagaaatggaaggattggaggttgacggctaaaggatgtggatttctttggggggtgataaaaatgttctaaaattgattgtggtgatgtgcgactctatgaatacgctaaaaaccgctcggttgtacattttaaatgggcgatttatgcggtatgtgaattacatctcaagaaagctgctgcaaaaaatatcatacgggttgagcctagtggtattaaaaaagtataaatatggccaggcgcggtggctcacgcccataatcccagcactttgggaggccgaggcgggcggatcacgaggtcaggagatcgagaccatcctggctaacacgatgaaaccccgtctctaccaaaaatacaaaaaaaaattagccaggtgtggtggcgggtgcctgtagtcccagctaggtgggaggctgaggcaggagaatggcgtgaacctgggaggcggatcttgcagtgagccaagattgcgccactgcactccagcctgggcgacacagcgagactccatctcaaaaaataaataaataaataaaataattgtttgggtacactgttgctgttacgaagcctacgatttgactgtcttgccttcattgatgatctttttctccccatggttgcttttaaaatcttgtgtttggtatcttgtcatttactactaccttgagtctaggcctggattttatttaaatatatgtttggtatatattgtgtttcctgaatttacgaattcatgttttaccaacaaatttggaacattgtgttatctcttcaagtattgcctccttcattctctagattctctccctctagtacttccagtctttaaaattcttccctccaaatctcaactttctaatgttttctagctccttgtttctcctactgttgtttgtataaaattataacgaaaagtgtttataagaaattgtaaacaaatgtaaaactaaataaacattgttatgcaacatttaaaaaattgtttgaactgaaggataatagtgacaaagcctattaaaacctctgggatacagcaaaattaagaggaaggttcatagcattaaatgcctacatcaaagagcatgaatagacaatctaaagtcatacctcacagaactggagaaacaagaaccaaccaaacccaaacccagaagaaaaaagaaataataaagatcagaattaaataaaattgaaacaaaaatacaaaagatatatgaaacaaaaaactgattcttttaagagataaacaaaatcaatagaccattagtgagattaactaagaaaaaaagggagaagatccaaataagctcaattagaaatgaaatgggaaatattacaaccaataccacagaaatatgaaatatattcaaggctactatgaacacccttatgtgcacagactagaaaatttagagagagtgataaattcctggaaatatacaaccctcctagattaaaacacaaataaatagaaactgcactgggtatagtggctcacacctgtaatcccagcactttaggagactgaggtgggcagatcacttgaggccaggagtttgagaccagcctggccaacagagttaaaaccctgtctctactgaaaataaaaaaaattagctgggtgtggtggtgcacacctgtaatcccatctactcaggaggctgaggcaagagaatcacttgagcctgggaggcagaggttgcagtgagctcagattgtgccactgcactccagcctgggcgacagagcgagatcctacgtggaaaaaaaaaagagaaagaaactgaacagacaagtaacaagcagtgagactgaaacaatagtaaaaaaaattgccaacaataaaaatgtccaggaccaaatggattaacagctgaattctatcaggcattcgaagaattggtaccaatcttactgaaatgatttcaaaagataaagaaagaggaaatcctccttaaatcattctatgaggccagtaacaccctaataccaaaaccaggaaagaacataacaaaaaaagaaaactatagaccaatagttcagactctgtaggtctatagttcagcccctgatgaacatagatgcaaaaatcttcaacaaaatactagctgagtccaacattatatcaaaaagataatacaccatgatcacgtgggtttcatatcagggatgaagggatggtttaacatatgcaagtcaataaatgtaattaatcacatataaataattaaaaatttaaaaatatgatttcaattgatgcaaaaaaacccatttcacaaaatccagcatccatttatgattaaaaccatcagaaaaagcatagaagggacatacctcaaggtaataaaagccatctatgaaaaatccatagtcaacattatactaaacagagaaaaatctacagcatttcgcctaagaactggaacaagaaaaggatatccactttcacctcttctattcaacattgtactggaaattttagccagagcaatcagacaagagaaacaaagggcattcaaataggtaaagaggaagtcaaactgctgctgttcactgatgatatgattgtatacctagaaaaccctaaggactcatccaaaaagttcttagatctaatacatgaattcagccaagtttcaggatacaaaatcaatgtacacaaatcagaggtagcactgttatacacctccaatgaccaagctgagaatcaaatcaagaactcaacctcttttacaacaactgcaaaaaataaaatacttaggaatgtatacctaaccaaggagatgaaagatctctaaaaggaaaactaagggacactgctgaaagagattatacacaacacaaacaagtgcaaacacctcccatgctcatcgatgagtagaatcaatattgtgaaaatgaccatactgactaaagcaacctacaaatttaatgcaattctcatcaaaataccatcattactcttcacagaactagaaaaaacaaccctaaaattcatatggaaccaaaaaaaagccctcaaagccaaagtaaaactaagcaaaaaaaaaaaaaaaaaaaatctagaggcattacattacccaacttcaaactatactacaaggctagagttaccaaaacagcatggtactggtataaaaataggcacatagacaaatggaacagaatagagaaccagaaataaaaccaaatacttacagtcaactgacctttgacagagcaaatacaaagtggggaaaggacattctattcaacaaatggtgctaggataatttgcaaaccacatgtagaagaaaaaagctggatcctcatctctcactttttacaaaaatcaactcaagatggatgaaagacttaaatctaagccctgaaaccataaaacttctagaatataacattagaaaagctcttctagacattggcttaggcaaagacttcatgaataagaactcaaaagcaaatggaacaaaaacaaagataagtagctaggaccaaattaagctagaaagcctcttcacagaaaaagaaataatcagcagagtaaacagacaacccacagattaggagaaaatattttgcatactattcatctgacaaaggactaatatccagaatctacatggaactcaaacaaatcagcaagaataaacaaatcccatcaaaaagtgggcaaagggtatgactaggcaattctgaaaagaagatacacaaatggccaagaaacaaatgaaaacatgctcaacattactaattatcagggaaatgcatatcaaaaccacaatgagatgccaccttactcctgcaagaatagccacaattaagaaaataaaaaaacaacagatgttggcatgaatatggtgtaaagggaacatttttacactgctggtgggaatgtaaactagtacaaccactatggaaaacagtatggagattccttaaagatctataaatagatttcatccacaatcccaccactgggtatatacccagagaaaaagaagtcattatatgaaaaagacatttgcacactatataataatttatacttaaaattgtttaaatttaatattaacaaaaataaatgtaatatgccacacaagtaggtattcaataaaactaaatacaattacgtttaacttttgaaactatgttatactatgaaaaaaatcctattaacttttgaatatttagccaaggaaaccaagtatatctcttctttaaaaagtctgattccaattttaacaaacaggtgtttttgacaaccagtttatttccttactgaaattttcaaggcacagaaagaacaaaagaagaaacatccattacactgcccaaaacaacagtacctgaaggatttagaggcaaaaatgaagcctgagaatagcaggacatagacatatttcgtaacatagactcatagcagaataatcgttatgttggttcactagggaagaaaacactaaacagctcttgcaaatacactcaatatacaataagatagcttgtgattttaacgagttagcaatgcagaacaatgaagcaaaagcaaacaaaaaaactaaaaataactaaataaaacaaacactaaataaaaacaaaaataaatccattttctagaaaaatttttaaagactttgcttgatttaccaaagaattcagtattgacttattctgtctccattttattttataatggaacccatctaattttatgctaaatgtatgccgtaaggacaccttgctactctggaaagaataagaggagagtggacagaaggccatactctattgaaaaagagtatctccagcctggtaacagagactccatctcaaaaaaaaaaaaaaaaagagtgtgttttcatatatgattttgtgactctacatttttaagtaaggatgaagaacttggtaattaaatgattcctcagttgctcatcactgtcatcagacaccttgagtatactgtggggacagcatctggaagaggaggagacctgagtaataatttggatggagccgatttccacaatcctactttcccattatctgcagttcagaatttaactaagtatctgtattgttaatctgggtgaacgacctcagtagacaccagacagctggatgcctgcacttctttagatttcatattaatggttcatatactctccccatccctgtcacttttatacttccctgaaactggattacatatgagatagaaacaaggaatccaggtattatattgactctttctcaggagccactgcattggtgttcatgatgcattactgaatgtaccagctgcctccctcttcttgtgaaggcccttctttattccctcagatgtgctcatcacgagatagcttcaagcatatcatctgcttgccttgccagttatagcaaccataaaaataaatttgcagcatcatatatagcttgaatattctcaaaagatgttcctaatagctcttaaaataaaatgttttccacagagtagctatacataacgtgctctcagcttatgtaaacttatgtttttattggtcttaaagcaaaacttctcctaaaattgagaaaagaactaaagtcttttgtcattagatgaagaaagatacagcatctaatactgtgaacttctctattttaagatgttttcagacatcaagactggatgataaaattatttaacaatttggaatataaattaagaaataaaaaacctttatactatactatattactaacatttttgtttgatcgtggctgccttataactttttggtagttcattgaaaataatggctactcgtgagaaaactgaaatagcctaggacatagaagacagagacagaaaaaaaaggtaaattaactatttgtgccacgtggtaaagaaagtttacagtatgtagtcattaaatgtacttgcttataattacataatataaccaatgatgaacaattttaaatgcaatttagaattcagaatattttatatttaatatatgtttctcaaagaaatataagatctactgaatggggagatactttatatgtgtaattacttacaaatgggagaaaacttttacaatagtttgtactctttagctataagctgtaatttaagagattcagtaagagtagctttttgtaacttaaatattctatattttccttgcacacatttttgcctttaatcatgtattttattcaacctgctaagatggtagagaatatacatacgtaagattacattaataattactaaaataatggtctatgacaaatttaaagtgcagtaggaaaaaagtttaataaaaacaacagagatatacagaatgtggctttccacagtttgtctcccatattattcctatcatttactctgtttctaaggttaagtaacattaagatgaggcgtaagtgttgtaatatgcctttaattattaaatataaatgtatcacatggcaattatattcaacatactcttattccaagctatgtacaattttaataattttatacaggtagctttgaaaatgagcgaatttgaatataaccaataatcacagaaatatttatagtgcaaatattctcagcaagatttgaattgttggtaaattcaaaacaaatagaaatacaaagaaaaattttgtataatacttttcatctagtttatgttacagtgttttaaattcagcttagtcacatatcatgatacaatgcttttggttttgtttttttgaaacagagtctcactcgctccgttgcccaggctggagtgcagtggcgtgatctcggctcagctcactgcatcccctgcctctcgtgttcacatgattcttgtatctcagtctcctgagtagctgggattatagtagtgtgccaccatggctagctatttttattttttttgtagttttagtaaagacagggttttgccgtgttggccaggctggtctggaacttggcctcaagtgatccacccacctcaacttcccaaagtgccaagattatgggcatgagccatggcacctggccctgatatgtttggaaatagtgggtgaatgctgcatttgagatactagagacctgtttggagcattaagcgaatgcatcttattaagaatgtattctttaccattctatgcaatggcttacatatctgtgtattttcttggcttgtctacatgatatacaaatatttggatacatacagaaatataggtcactcatgtaaaagcttttcaatctggcacataaattcaggttatttgaaaacggaatggtaaagtgttactgaagaacttttactatggttcatgtttggtaatatttgctaatattctaaaaacaaaacaaaaaccaaaaaataccttgatttcataatgtaaacatctgatgtctaaattaatcaataaaataatttttgtgttttaactaattatattttattttggtgccgcgtaatttcatgatagattaaatactgagactcattagaggtaaactagtgaattatcatcccgttaagaaaaattttgcttccgttcgtgggggagctgcggcggtggcggtgcaggaggccgggccggggcgcggagggaccgacggatgcacgggcgggcggtcgggagccatggagcgcggccctggggcccgggggcgcgggccggggtggccttcccacggcacgacatggagacctgtggttgcgaggctccctggggcggcttggaccgcgatggggctgggccctggcctcctaatggggctgccgtctggggctctcacccctgcccgcgactcggagcacccccacccctcccctgcccggccaggccgggcggcgttgttggcgggggccccggtggaggcccggcccgggaggcgcctgccatgaacgggctgtcgctgagtgagctctgctgccttttctgctacccgccctgccccggccgcatcgctgccaagctcgccttcctgccgccggaggccacctactccctggtgcctgagcccgggcctggtggggccggggcctggtggggccggggccgcccccttggggaccctgcgggcctcctcgggcgctggaagctgcacctgacggagctcgccgacttccagtacagccagcgcgagctggacaccatcgaggtcttccccactaagagcgcccacggcaaccgcgtctcctgcatgtatgttcgctgcgtgcctggtgccaggtacacggtcttcttctcgcacggcaacgcggtggacctgggccagatgagcagcttctatactgggctgaactcccgcctccactgcaacatcatctacgactactccggctacggtgccagcgcgggcaggccttccgagtggaacctctatgccgacatcgacgccgcctggcaggccctgcgcaccaggtgagggcgaccctgggggcagctcagcctgggcacacccaagaggggaccaagccgggggccggggggcgggcttccctgggaggaagttgggcggccctgcaggaggggagccacagtggatgcacagggccagagagccggacaggcgagcttgggtgtgcaggtgccgcctccacatggctgaggtgtggccaggcggtcctcccacaccctggcctgtggagccaggctccctgggaacccctggcctgaggacgggaaggggctgagcttatcacaggggcgtggatgccacccggcagtcgggagtgggtggtggtctgggggtctgtgcacgtgtggctgggagcccatctgcggaggcagcacttggggccaagtgaggcgaggctgctgcatccaggtcccgaggcctggcccatgaggccctgtggctgcggagcttggccatcctggggcagggcctgcagggtaaggtgcagacccccagcacacacccgaggtctgggccagcctcgattccagatccagccctcctagtcatccaggtccccagccctgcgcttgcctgggcccttcaccggtgtttgagcaccgcccgggccagtgctgctttggacgaggagacccgggtgggcctctggtggcctttcctgctcgccatccactggggctgtctcgtcctggccctccccagcccactggtctgacctgctcccgcaggggaccaggcacaactctgagaagtcagaggccctggggaggtggggtcctcgttgccttggtgatattgcaggcggtccctgctgtgggcctgggagctggtcccctggcaccaccctggctccgggggcctcccagcagtgtggggcgctgacaccaatcaccacttcatgcgacttcctcggcccctcctgtctctactgcctgggcctctggcagagtcacacccgccatggccagctctgagctctgtctgctcggccatctgtcctgctgccactttgtcctgcaggaacctaggcccagagctgtgagggggaggccagagcatgcccagggcctccactggggatgtgtcccgttcctttgagtggtgacatccaggtggcagctgggggctcctgactgtagcaggtggtagggctgggctggctcagcacactactgaccatggctgccagggagcaggccggggaggccgaggcagagctggggccacaggcaccagccaggcagcatcctttggggcatgggtgagtggcgagctgtggagtgctgccaggaggctgggattccaggccagggacggggacagcccgctggtggagtccgaatgccaggcagaggggatgcacacctgcccatgctcctgccttgcaagagggcgtctgcctgggatcagagcctggagcgtgtgggaggagagttgtggggtcccggcatgggcagggtggcaggtgggtcccgcgtggttgggattgggcacgaggaggccttgtaactgttgctggatcagctgggtcaggggccgcacaccagtgacctgggggtgggggtgcccctgggtgggagctggtggtgctgaggtggccgaggacttgtccactcccaagggaaggtgctggtgggagggggtgccacctccgcagccaccaccctcgatgctgacctgggttgcactggcatctcattgggcgtggggactccgagactccaaaatcgggtggagacatttggggacacagctgcctgaattcctcatggccaagggggtgggcaaaggctgcagggaggaagagtgtctgctgtcctggccagtgcaccaggaacggctttctaacccgggcagggaggcgtgaagcattcagaatgtagggggcacacagttcccagtgtgcacctaggggtgaccaggaggaggagaggtgccagggcctcccctacccctgccccaggggcactctgtaggcgggatccctgcagatccttgctaggaaacgccagtgaacggcagcgccagggaatagggcggggccgctggcttcgcccaccgccgcggtgttgggggctgggggtggccctcgggactggtgtggagcctgggtctgacccactgacttagctgagtggggagactggagggtcgcatccggagctgggcccggggacgcccgctggtgggaagggtgcgcccgcgtcggaggccgcggctgaccctgctccggcgccgccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagacctactgcttcgacgccttccctaacatcgagaaggtgtccaagatcacgtcgcccgtgctcatcatccacggcatggaggacgaggtgatcgacttctcacacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcgggccccaaccggccggacctcagcaataaggcggcccccggacctcaccccgcgccggccccccaggggctgcatgtggacccccgggcggcctaggggaccctgccccgacccaggggctgtggacgatgtacacagtcaacagagctacgcactcctttccttttggaagcaaaaagaaaatatgtgaaaacagaaattaaagatttaaaatttaaaaaaaaaaaagaaaaaaaaattttgtttccgggaagtaacatcttaatttaaatggaggaatttaccaaatcaagtacaaggattttatttctgctactaaatggaagatatatgtaaaatatagactccatcactctattctttactatcatgagaattaatatagacagcatattttagacagagcatacaaagccttatgttcactgaattacaagtaaaatatatgtacgtatctataaataattatatatctaatttagatagtaaatgacagaatttacttatttacctgtgcatgatggaatttgattctagcaattattccgggtacgataactggttgaaaatgggatatgaagtaaactggtatgcttaaaagtaactacatcaagtgaattcattataatgtctccaagcaaggcaagaccaccctcatgagataagaaatgagaggctacttattttgactaagttgactcaatgacttggggaaccaaggactatatgtacatggatacttgttttgtacccccccaaaaaaatgtgtttccactgcagtatttgggaacccattatttcttgattcatgctcttattttcatataagagaagcgttgataccccaaaatcaacttaaattttaattaaccaaatataaaatttttaaagacaaaaaaaatttcataataagagttaagccaacagaaagggaatatgaaacaacagagaaaatcaataaaccaaaattaaatgtttgaaaagataacaaaattggcaaatgtttacttaggtcaatcaagaaaaagagagaagagactcaaattactaaaatcagcaataaaagaaaacccatcactgccagtattacaaaataaaaatacaagacaatgcagtgaaaatcttatgttaaaaaaatcagatagcctagatagaatggatgaattcctagaaagacacaaactaaaatagatgaaaggactaaggagaaatagaaaatcgaaatagatctacagaaggtaaaaagattggattgtaattttaaaaacttacaataaaaatctcaagtagcttcccaggcaaaatctatcaaacacactgagaaattaatatcaattgttcaccaactcttgcagaaaataaaaggggagagaacacttcccaattcattttataaagccaggattactgacaccaaaactgtatcacaaaacaatatagaacagtatctttcattttgtgtgtgtgtgacagagtctcactctgtcatccaggctggagtgtagtggtgcaatctcaacccactgcgacctctaccttccaggttcaagcgattctcctgcctcagcctcccaagtagctgggattacaggcgtgcaccaccatgcatggctaatttttgtatttttagtagagacagggtttcaccatgttggccaggctggtctcgaactcctgacctcaggtgatctacccacctaggcctcccaaagtgctgggattatacaggcgtgagccgccacgcccagcacattgttttataaaatcaaaagtcttcaacaaaatattgccaaactgaatccagaaacatataaaatagattatgcactatacgcagatgtgatttaccccaggaatgcaccattgatttaatatttgaaaatcattgcatgcaaacaccatattaacagaataaaagacaaaaatatataagcatctcagacagaaagcatttgagaaaatatcacacattctaataataaaaacactccaggctgggagcggtggctcacaactgtaatcccagcactttgggaggctgaggcgggcgcaatcacgaggtcaagagactgagaccatcctagccaacatggtgaaaccccgtctctactaaaaatacaaaaactcagccagacatggtggcaggcgcctgtaatcccagctacttgggaggctgaggcaggagaatcgcttgaacctgggaggcggaggttgcagtgagccaagacctcgccattgtaccactccagcctgggcaaaaagagtgaaactctgtctccaaaaaaaaaaaaaaacaacaaaaaaaaaacaaaacactccaaatttacgaacaataaggtaacttcctgaaactagtggtagttacctatgaaacttacagctatcattatactcagcaatgagagggtgaatgactaatcagttacaagaatgtccactcttgcaaattctattcaacattatattgtagattgtagcgaggtgtagtaaagaacggaaaatttaaaacatccttattgaaaagaaaataatttttttatatttacacatggcacgatctcatatataattctaagaaattcagtaaaatactattagaaataaatttgacgtagtttcaagatataaatgcaatactaaaaatttaattttatttctatatactatcaataaactgctttaaaatggtattaaggaaacaaacccatgtataataccaacaaaacaagtaataaatttagaaattaacaagagcagtgcaaaattcatactttgaaacctgcaaaatattgttgaaataagttgaagaacaattaaataaatgagaagtggtggagcgagatggcagaatagaactctacaagattgtctccctgcaggaacatcaaattgaaccaccaacaatctaagcaagagaataccttcacaagagccaaagaaatcaggtgacagatcacagaacctggttttagcttaaaaacaagaaaagacacattaaacagggtggaaaagacagtcttgcagtgcctataccatccctccctcaaccccaggcagtgcagagagacaatgtgtccacttccaggagggagaagagagtgtgcattaaactttgccttggagcccagtaccagctctgctacagtaaaacacagcactgggcagaaccccatggtccttgattccatggccggtgcccacagacagagcatttagacatgacctgggctagaagggaatccactgcccggtgggacaaacctgagtcctgacttccttcaccaccagctgtttaaagtggcctcaggctctgaataaatttcagtggcaggcaggccatagccactgtggtccttgggtgagccccagcaaccaatgatgtgctggtctgggaggctgtgggtttcatatatgacatccgctacagtggccacagggctgcctgtgttaccctaatcccaactccaggcagtgcagtgccgggagaactcctttcctatgcaggaaagaggagaacccagtccaggctccaccacggtggacacagcatcaggcagaacacagtggccctgatcccaggcaggagctcccagacacctctagacctgcctggaggtagaagagaacctgctgccctggcgggatggacctaaaccctggccagcttcaccaccagcagagtagctcggcctcaagacctacataagtcagcagcagtcaggcagtagtggccacaggactcagacaagccccagtgctgctctggtcctagaggctgtgggcttcgggtatgtggtgccagctgcagtggccatgggagtgcccaagccacccttctcccagatccacaaagcttagtacccagactccttccaatgggaagaagagggaagtgaatgaagcactttgcctgggaacccagggaacccctcccttatcttctccaagtccatcagggccctctgggacctcagtcctgcaagagtcacagtgaacctgagcttagggcaccctggtgctgaaacagcttcagtgaccccagccttagggaactcaatagtcagtacccttggaatttctggaagaccatctagaggaggacaggtacaaacaagaccagactacaaagactggaataaatactgacttattcaattcccaggcatgaacataggcccaaatgcattaagaacattcagggaagtatgacctcaccaaacaataaacaagtcaccagtgactaacctaggagagataaagatgttaaactattcagagagggaggtaaaaaatagctgttttgaggaaaatcaatgcaattttaaaaatataagtaattcggaaatgtatcaaagaaatttaacaaagagattgaaataattttaaaagaccacaaaaacctcaaagctgaaaaatataatggatgcactgaaaaatgcatgagagggcctcaacagcagaactgatccaacagagaaagaatcagtgagctcacacaggccatttgaaatacacaataggagaaaaaagaaaagaaaaaaaagaatgaaggcagcttaggaaatctatgggatagtatcagaagagcaaatttaagagtcattggtcttcaagagaaagcagagaaagagtagaaagcttattcaaaaagatggtaacagaaagctttccaattcaagagaaatatataaatatccaggtacatgaagaccaaagatcatcaagcagattcaagccaaataagactacgccaaagtggccaggtgcggtggctcaggcctgtaatcccaagtactttgggaggccgaggcaggtgaatcacttgaggtcaggagttcgagaccaccctggccaacatggtgcaaccccatctctactaaaaatacaaaaattagccaagtatggtcgtgggtgcctataatcctagctacttgggaggctgagcaagaggattgcttgaacccaggaggcagaggttgcagtgagccaagactgtgccactgtactccagcctgggcaacaagagcgagactccatctcaaggaaaaaaaaaaaaaaactatgccaaggcatataataatccaactccaaatgtcaaggacaaagaggatactataaacagcaagagaagtgaatcaaacaacatattgaggacctttgatatgtcaggaagcagagttctcagcaaaaattaaacaggctgagggcctccctcctatgggagaagtgggatgacatattcaaagtgcttaagaaaaacaataccaatgaaaaaaaccacacccaaagaatagatccttcaaaaatgaagaagagataaatacttttcccagacaaaagctgaggaaatgcatcactaccaaacctggtttacaagaaatgctaaagggagttgttcagtctgaaagaaaatgatgctaacatgtaacaagaaaccatctgaaggtataaatctcattactaaaagtacacagataaatttagaatactatagttgtgatgtataagcaacctatatctttcatgtgaaggctaaaatacaaaattgttaaaataataatataacccaacaatttttaaagggataggcaatatagaaacatactgagcctgtaatcccagcactttgggaggccaaggcgggcggatcacaaggtcaggagatcgagaccatcctggctaacatggtgaaaccccatctctactaaaaatacaaaaaattagccaggcgcgttggctggcgcctgtagtcccagctactcgggaggctgagaatggtgtgaacctgggaggcggagcgtgcggtgagccaagatagcgccactgcactccggcctgggccaaagagcgagactccgtctcaaaaaaaaaaaaaaaaaaaaaaaaaaatactgaaagacatctaaatacaaaatgtgtgtgtgttgcgggggatagagttacagggtaaatgtttttagttttttttgtttctctcttttttgttctttgcaatcaaggttaagttttcttcagtttaaaataactcgttataattatgttgtttagcctcatgctgaccagaaaacaaaaatcagtaatagacaccctaaaaataaaaaagcaagaaattaaaacacactaccagagaaaatgacctcactacaaataaagacaggaaggaagggaaagaggaaggaaaagaaaggaagaaaggagagagagaggagagaagagaaaggaaaggagaaaacaaaaaaagagagtagcaaaacaactagaaaacaagtaaaaaatggcaacagtatgtttttacctgttagtaataatcttgaatataaatgaattaaattctccaattaagacaaagtggctgagtggatttaaagacaagacccaactatatactgactaagacactcacttcacctataaagacatacatagactgaaaatgaaaggatgataaaagatatcccatacaaatggaaacaaaaaagcaggagtagctacacttatatctgataaaatagactttaagtcaaaaaaagaaaaactagaaagataattatataagggtaaagaagtcaacacagcagtataaaagtagaaagatctcaaatacccaacctgacaatacaccaagtaatgagaaaaacaagaaaaatcaaattagtagaaataaaataataaagattagaaaaaaattaaaaattgaaactaaaaaaaatacaaaaagtcaaacggaaccaaaagctggggtttttttgtttttggaaaaaagtcaaaattgacaagctttaactagactaagaaaaactgaaaatgatagacgaaaaaggagacattacagttgatcacacagaaatacaaagtattctaagagattactaaaaacacttatatacaaattgaaaaatgtaggagaaatgaataaatttctggacatataacaaattcccaagatagaatgataaagaaataaaaaacctgaagagacgaataatgagtaatgcaattaaagcagtaataaaaagtctcctgtcaattgaagaaaaacacacgaatcatggttttattgctgaattctgccaaacatttttaaaacaacgaataccgattttactcaaaatattccccaaaatatgaagaggaatactttcaaacttgttctataaggcgagcattaccctggtacaaaaactagaccaggacacaacacaaaaagaaaaccacagacaaatatccctgatgaacacagatgcaaaaaaatcctcaacaaaatacttgaaaattgcatttgacaatacaataaaaagataatctgccatgatcaagcaagattcatctgaggaaaatgaggatgattcaataaacaaataaatgtgatacatcatattcagcaaatcaacaacaaaaaccatgtaatcgtttcagtagatgctgaaaaaaataaaattcaacattctttcatgataaaaactcaacaaaatgaatacaaaagaaacattacttagcacaataaaggccatatatgacaaacccactgctaacatcataatcaatggggaaaatttaaaagctcttcctctaaaatctggaacaaacgtggctacttttaccacttttgttcattatagtactggaagtcctcactacagcaattaggcaagagaatgcaattagacaaatgaataaaaggcatccaaactggaaaaaaaggagtcaaattttctctgtcttcaggtaacatgatcatataatagagaaccctaaagattccactaaaaattttactagaaataataaatttagtataattgcaagacacaatatcaatatacaaaaatgagtagcgcaccaatgagccaatagtgaaacacctaagaaaaatcaggaaagctatttcattaacagtactcaccaaaaaaagatacctagggataaacttaaccaaaaaggcaaaagatcccacaatgaaaactataaaacacattgatgaaagatattaaagcaaatgcaagtaaatagaaagctatcctatgtccatgcactagaaagaatattgttaaaatatctgtgtcacccaatatatgacttacagagtcagtgcaatccatgttaaattacaaaagatgttcttcatagaaatacaaaaaaaaaccagcctaaaattcacatggaaatgcaaaatatcttcagataaacaaaagaatgttgaataaaaagaaaaaagctggaggcatcacactgatttcaaaatatactacaaatctatagtaaccaaaacagcatggtactggcaagaaaaggggggggggcggggagagacagagagacagacatagacaaatgacagacagacacacatagacaaatgaaacagaatagagaactgagaaataaattcacacatttacagtcaactcaattttaacaaaggcaccaagaacacacattcaggaaggacaatctcttcaataaactgtgctaggaaaacccaacacccacaggtagaagaataaatctagactgttatcttaccatgtaagaaaatcaactcaaaataaagatttaaatataggatctgaaactatgaaactactagagaaaaaaacataggaaaaatactttaggaaattggttaggacaaggaattttcaaatagacatcaaaagcacaagcagaaaaagcaaaaatagacaaatggaattacattaaacttcaaaacttctgcaaagcagaggatgcaatccatagaatgaagaaataatccagagaatggaagtatttgcaaactatgcatcaggcgaggggttaatacacaaaatatataaagaagacaagaactactcaaaaacaaaaatgcaaataatctgatttaaaaatcagaaaaagatctacccaaaagctttctcccccatcattatttccctgccttcttttcctgaccgccttcggacccctccctctcgccatcctttttcttcctccatctaccccaaaacttcttccccatcattttttccccaccgtcttttcacaacaccttctctactctcccactcaccactcttttccccatctacccaaaaacttccccacagtttttacccaccctctttttcccccttccgctctcattagccttttgctcctccatcatcccaaaaacatttccctccatcttttcccaaagcctttttcctactcctgctactcaccaccctctttgccccctccatctacccaaaaactgtttccccatcgtcttttttcccctccttgctacgctcttttccatctatccaaaaacgtttccccactgtcttttcataaagccttctccccacttcggctcgccaccctcttcccccctccatctaccccccaaatttttccccactgtcttttcacaaagcccttcctccttcccgctcgccctcttctttcccctagcctgcttgccaccctctttttgccctccatctaccccaaaactattttccccatcatctttttcccaatcctcttccctacctccctctcgccaccctctcttctcctcccacttgccactttttcccctccatctgcccaaaagctttttacccacgttttttgtttctgcaccatctttcttttctgtcttccttcttttcgcagaaccttctctccctccctctcaccaccccttttccttctcccgcttgtcaccctcttttccccctccatctacccaaaaacattttcctccatggtctttttggaaaaccttgtctccctcgctcaccactcttgccccctcctactcaccaccctcttttccccctccatctacccaaaaacctttttcttgtctttcccccctcaccatcttttcacaaagccttctccccgctcctgctcaacaacctcttttccccactcccgcccctctcccacacgccaccctcttttcaccctccatctgccccccaaaactatttttccgtcgttttcccaaccctccttcccccctcctgcttgtcaccctcttttccccctccatctacccaaaaacttttcccccactcttttccccaccatcttttatggctcctgcttgccaccctcttttccccttctatctacccaaaaacttttctccccactctcttttcgcaaaacttcctctccctcttgctcgcccccgtgttttcccccctttactactctctctgtactccttccacctgccactctcttttctccctccatttacccaaaaactattttctccttcttaatgctcaggcggggctgcagtcttcattacagccaccaatcgcagagaggccagccgaggtgccaagagctccagcctccagcttgggacaggggtcttccccttctcttcctcctttaagccgggcactgagcagctcctgcactgtgggccaccctcctactactccggtggctcttcagtctccgtggcagcaaccaccaaccacagcagtgaggtgagccgtggtgccttaggccagagtgagggaggtgtctttcctttcgcctcttcctcctctaagccgggcaagagccgctgaggaggcaaacactaaagaatctgcaatggcctgacgtcccctcagcatactttatatagggaagttacaccactgggtcctgaactacatgttctgattggatgggagaaaaacctctaggcctactctgattggactttattatcatgttctgattggatgagagcaattcttaaggcaaccaatcagaacatgacaataaagtccaatcagagtaggcctagacgttttctctcatccaatcagaatatgtagtccaggcactcagttgcaaaacctccctatataaagccggctgagggggcaaggaatcaggccattaccgggctctcctgtgtctgcataccctgatgttcggtgcccagcttagagaaggagaagggtaagacgcctgctggatgcggtaggcttgagcgtgtggcaacgtgtttcgcttagctgaggttggtggtggccatggagactgcagcggggagagcggtaggagggcagcccacagtgggagtatggccagagtggtagaaaaggaagcagggtaggtgtggtatctgggtctgcactgctctccacgggggcacgttgggcatgctatcccaggttgcattgcctgggcgggttccgtacagtatgcatggtgcctccatttatccatctttacaaggggaacagtactaaggttttctttttcttctcagttgactgaattatttccctagtctgtcttcttgccactcttgatgctcatatgagaggacctaaggtaattcctgacaacctgggactccttaggaaaaacagaaggtgccatagactccattttaggagaaacgtctgttttccttatggaacttcaagaagtgtaagcagacaggtccctctcaaaatctaaggctctactctgttttgccttgctttatctgacctttttgatttgggtgggcatcagaaattagtaggggagagagatctaaaaaaagttgtggaaactgggcatggtggctcatgcctgtaattccagcactttgggaggccgaggcaggcggatcacctgaggtcaggagttcgagaccagcctgtccaacatggagaaaccccgtctctactaaaaatagaaaattagccaggtgttgtggcacatgcctgtaatcccagctacttgggaggctgcggcaggagaattgcttgaacccgggaggcagaggttgtggtgagcacagatcacaccattgcactccagcctgggcaacaagagcaaaaccccatctccaaaaaaaaaaaaaaaaaaaagaagaaaagaaaaagttgtggatatgaagatatatttatgtaagataggttatgaaggaaagaaattttatgtgagagagcatcttgtatggcaaattcttgtcctaaagtagaatgactaggaaagagcaaaatataggacaagtcagaaagtcataagatgggaaagaaaaacttacaactgctagatcttctcctgtctagaagtgttgtgtgtgtgatgcttatatgaaggtactctaattaattggattaagagaaaatgaaacctcttaaatatgttgtcagaagaatagacactctcatgccttttatttcacatgacttcagtaatctttgggaaatacagttttaaaattattggtaaaaaagtctttaaaatttagacatttgttctaaattaagtcagaggttaaattggctaagtgctttaatgtcataaactgcttctttgactttggaaaattatctagtttacctggtttggagccattcattagatttctaggtgaggcctgggaacaggtggagtgagccatgtctcctagctatgctggaaagagactttatctgcagttctgtcttgtatcctagactctgcacctggtaggtaattaaaactgcttacactgaaaagaaacagtacgtggttttgatttttaaaaggcatgggaatatggtttttttttaattgttttgtctaatttagaaaatttaaatgacctcaaggtcacctcaggcctcatccctctatccccccttgcgataccagatccagaagaggcatttgcatggcagccacccagagcttccacctccaaagctggcaagggcaggatggtaactgggagggaaagggggcaggtgctggttcaaggagtctaaatcgcaagtgctgagcaaacagaagacattcctgcaactttacctgcagcgcacgaggtgacccagcagttcaacaaactgctaaggacctgaaaatagcacttgagcctgggccacttgctgggcctgcagccactccagggtcaggccctgagtcctggcactctggatgcaccccaccgtgctggggagagatgctgggctgggaggggcctggagccttgcctggggtatcacttttgcaaattcattttgttcagcagtgtaggatggccgctcaggcccaggccctggcctgggttggcattagtgcagctgtgctggagcgggtacagagctttgggagttctctgtttctgggcacgctttggcttgtacagcttggccgccttcttgttctgggtgatcctgagcttggtctacttgaaggattccaggtgcttcctcatagacctgtggaagatatctcggtcctgcttcttgtcctcagctggtgtggctgtagcgatgcatatactccttccccagcttgcacaggtattgctgcagcatgtggtgcatgaccgtgtcctccccgtaccgaatgctctgccatgctgctccagggactgaatgtctagacagacggtgctgatgttctccctcaggtggtaggagacagaggccaccatggtggacgatcgtggtgtgaagtccacgtttaccacgttatcagtacttggggagccgatgaaggccagggatctcaggcactctcctttggtcacttagctgatggcatccttcaggttcagtgcatggaagacattgaggatcccttctggagacttctgggccagccttctcatgaggactccactgaggaaattcctgtcaaagtgggaccacatgtctttgagatcattgtgcctgatatgcctcgatatgtccttgatggccaagaggatgtggtcgagagggtggcattgcagcttctcatggaacttaggctcccagtgctcactcctcttcaccttcagccactgcaccagggactagatggtcagaccccagaagatgaccttgaagatgttgacggtggtgctgacaaacaggttcttctccttgaccttgtttccattcagaagtatgaccaggatgaaagccatggccccatgcaggcctccacaggacatgaccacctggcctatgatttccagccacaccatccaatagcagtccaggagccaggagtggatgacactgatggcctcagtacctgaagatgaaggccagtgcaggcggatgaatgccttgttccacgtccagatgagcaggttcatggctaaggtgcccagggacatgaagatgggattggtgccactggtcagcatcttcatggtgtagcacatggtgggggccaactgctctgagatgttggccttcatgtacttatggcagcagatgccacagaagatgatggccaggatggcctacagcaacagcttctcagacatcagaatggacaggtaggagatgaccaacatgaaaccaggctcgatgatgtgcacatgcttggtgaggtgggtcaccagtgacaacagaaaggcaaagaccattcccaccagcatgccccccaggctcaccacaaggaaggagactacaccttccacagagttcatgctggtcacgttgtcaccacccagtgtcacaaaagattgaaacacattgtacagaaccatgatgacagagtcattcagtagcaactccctgaagatgatgatgaacaggacctcattgccatgaacctcctcaaacacaaccaggacagctgctgggtccacagtggtgatcaggctgccgaacaggaggaagtccagcagccctatctgcaggtagcccatgagcctactaagagagacgtcatagagggacaggatggtggtggatgcattccacatggtgctgatgaccttgtacagcaggatggtgcccaggttgccgaagaagagccagttggggatgaagtagctggcatctagcatgatgagggacatcatcatgaaggatgttatgtgtttggccacccagatgatgctgcccagcaccaggcccaggatgatgagcagggtgctctcagggactatgctggtgaccttgtgggacaggtagaaccagtcttggccaggctggctgcaaggatgcagagcacaatcatgtacaggtcttggacattggcccattcaaaggcgaccacctggggaccctggttcacatctacacactactgtgctcttccttgacgccccctcacccatagcagccaccccagcaccagcaccagtgccatcagcagcccccggcagcaacatcagcgctgtgtctcagtgccagcctgggacacgcatgttgtggggagtcctagctgtgctcgactgatgcaccctgctgaggctgctgaactcacaacccaccaaggagcccagtgggctttggggctgttgctgatggcagtccccttgtttggttttttaatcacacatcacttttgtaagtacacacagataaaatatcattgaagtaagatattcttaaaactttttttttagttcaaagttcatcttctgtatcacttttgacttaaaatcatcagtgccctcatttttccacattgttttctgttctatcaagagaaagggacagcaaactaccacccatgaaccaaatgtggtcctccacttgtttttgcaaataaagttttgttggggctgggcgcggaggctcatgcctgtaatcccagcactttgggaggctgaggccggcagatcacgaggtcaggagatcaagaccagcctagctaacacagtgaaaccccgtctctaccaaaaatattttaaaaattaacctggtgcggtggtgggcacctgtagtctcagctacttgggaggctgaggcaggagaatggcatgaacctaggaggcggaggttgcagtgagccgagatcgcaccactgcactctagcctgggtgacaaagcgagactccgtctcaaaaaaaaaaaaaaaaaaaagttttgttggagcatagttacaaccctatgactgctttcaggccctgatggcagagttgagtggttgcagctgagcctgtgtagcttacaaaccaaaaatattccctatcaccctttgcatgaaacatttggtggcccctaatcgagaagcacaggaagtgaggcatttcttgcaagtgtgtccactcatcccggggatgttttgttttgtttttgagatgggatctcattggtgctcaggctggaatgcaatggcacaatcgtagctttctgcagcctggaactcccaggctcaaacgatcctcccaccgcagcctcctgagtagctgggactacagacacatacaaccatgtccaggtaatttttaagttttttcttttttttcttttttttttttttttttgtagagatgggggtctcaccatgttgtccaggctggtctccaactcctgggcttcagtaatcctgaaggcctcccaaagctgtggaattacagttgtgagccactgtgcccagcctgggatggtttttaagtcccattttaagtttttaagtatttggttggtgctttgcaagaaaatctggacttgtgggcctgtctgcagggatgaatatgtgtctgcctcgccagcatcgcacaggcattctgctgctctgttcccaggcttcctgtgtgcacaatagcttttcaattcaaagctgaatcacagttgaatctttttgaagacatttaaaatagcacctacactccacatttgaagtaacaaccatgcccaaaacttaattaaagtgacaatgctatgaactgctgtgactgagtctgtatgggaccaggcgggacagccatgtcacagttgtaattagaagacctacccaaatttcaggtgcatgaaaatatgaacaattaagatgtgtgtctttacattgataaaatatcgcagtgattctcccttgggttataagcacgtggggttaaatcaggacagtgcgtgggaaggctgagccacggtggggacacacttggtgctcagtaaatgttgttgaggtgaatttggtggagggatggtgacattgctcccctgacaaacccgcctgagataaagccggagagaagtcttgtaggcaaatcccgtggagaaaagatccagctgctgggaggctggtgtgggaattgtggggagaaggtttctggatattgtctgtgggatgggccctagagctcagctatcatctttttgtcttttaagcctggccaagataaatgccttctgtttgaaaaggatgattttcagagggacaaaacctccttcctggttctaaaggaaccttgggccagggccccttgagctcaggaggaaggcatgagtgtgaaggggatggggatgggggtgggtggttttcacagctgggtgatgtagaacgcatcgtggaagggtggctgcaagtgactttgcttagtatggccacctgcaaggaggcttagggtcttccaagtggccagggtcttgagaggattcgccagcctcttggttccagttatgtatgtgttcttgagtcaaatgggccagggcctatatccacggtgactccagcatcatggccaggcctgagtcctcctgtctctgcagagggacaacatggaggctgtgccagggatttctgtccctgcatcagacagccactgtcgtgaccttggagtgaacagtaagccagctgataaaggggtctgtgggggacctggactataaaaagaggtagggcactgggtctgctgtgcatctcctgggtcccttcattccccttggcacagggaagttcccctcctgagggggaggcttgtaccctgcccctgcttcttcctgctactctgcctggttgttatggccacttggctcagcctccctacagctgtggcctcacgggaaactcaaaggctcgggaggatccagaaaccaagacgtggaatttggcaatatcctggtcaaaaccagccagagggagaaatctttacaaagatctcctaagactgcaaatggcaaaatgtttcccagtctccaacctcccctttcccagcactcaagggaagacataagatgttagtatctgatccagggccgcatctcctctgaaatcctgtgatttataagatccagtggccgggcacggtggctcacgcctgtaatcccagcactttgggaggccaaggtgggcggatcacgaggtcaggagattgagaccatcctggctaacacggtaaaaccccgtctctactaaaaatacaaaaaaattagccgggcgtggtggcgggcgcctgtagtcccagctactcaggaggctgaggcaggagaatggcgagaacccaggaggcggagctcgcagtgagccgagatggcgccactgcactccagcctgggcgacaaagcgagactccgcctcaaaaaaaaaaaaatccagcaaaggctttggaacaggggattccctgctgcaatgcctgcattccagcacaattaggaaagacttcaggaagaacaaaggaagctgtggtgcaaaggtgtggccgaccccagtatttcagcttgaggagtcttggctgctggtggggacaggaagcaatggtgttggctgctccaagtccacatgtaatctatatatatatatttttacattttcttgcttttttcaggaaaccttttatgatgaaaaagttttaacctaaagatagacagaactcgggtaccttcaccaggccctaatggcctgaatcagcctatcccttctcccctgtaatattattctgaagcaacgtgcagacattatatgatttcatctgtaaatattttaatgtgtatctctaaaaaaaaaaaaactcttttcaagaaacataaccagaacattgtcattgtgttctgtgtaatgtgaagcctcagtgtggttaacatcaggtcttggagtgatgaaaaatgttcctttgcagggtttaccctctgtcctcagtgctggtcagtgggtgggacagttggtcccaggctgagctcaataattcagctccagtcagactctgctgtttctcacaatctctctctctctcttttgagacagggtcttgctctgtcacctagacttggagtgcagtggtacgatccctgctcactgcaacctctgcctcacaggctcaagtgactctcccacctcagcctcccgagtagctgggaccacaggtgcacaccaccacacccagctaatttttgtatgttttgtagagacagggtttcaccatgttgcctaggctggtctgtcctctctctctctctctctctctctctctgtctctcattttatttttagttatttttaatttttattttttatagagatgaggtcttgctttgttgtccaggctggtcttgaactcctggcttcaagtgttcctcccaccttgacctcctagactctagagtttctaatcaagagacattcatggaagaacagggtaggcctcctggggatgctctgggactggagccttgcctcagcctctttatcttaaactttggtctgaagccttctctgaccttctggttgagttcagattacataagccccaaatccctttgtagggatgctcagtaaacaaagccaacaccagctcccaccagctgtcagcaaggaggagctctgtggccatagtctgtagtcacacaattctgtgcctagctgtatagctaccatcttgcctttgagaactcagtgccttgaaggcaagggtcctgtcttgctcagatcttatccccaatacctgccacagcttgtagacctaataggtgctcagatcagctttgtgaaatgaagcagagaattcaggggacctgggttcattcaccagatatttactgagcacctagcctgtgccagccactgtgctagatacaaggaagacagcagttgtaggaaaggagaggaaactgcttaccttctcagagcttacattctgctggaagacaacaaatggacaaggagatgggtgaatatatgctatgggaccaagcctttgctccaccctccccttgctagatgaccatggaggccgtgccagggatgtccctgcatcagacagccaatgtcttgaccttgaagtgaacagtaagccagctgatgaaggggagagggtgaaggaagaaggttgggcaggaggagtctgagacacaacacacagctctaggaacatttggccagatcagttgggagtctctggtggactgttgactattagaggactctcttgcctgcaggaacaggtggcactagtacctagcatgctcgcttctggctgggagcagcctatgggtagtgtggcctcggtgcccaggctggagtgcagtggtgagatcatggctcactgcagccttgacctcctgggctcaatcgatcctcccacctcagcatcctgggtacttgggaccacagcatgtgtaaccatgcccagctaattttttgatttcttgtagaaggtcttgttgtgttactcaggctaaactcaaactcctgggctcaagcaatccccctgccttggcgtcccaaagttctgggattacagatgtgagctaccgggccttgaccacttgattgtatttctgttggatagtgctggtctaacattggttttctcagcctcagcactgttgacatttgaggccaaatcattccttgtgttgagggctgtctggtgtattatagagtgtttagaagcctccctgacctccacctactagacaccagtagcacctagttaatccacaaggcatggcaaaccaaagtctctccagacatcgacagaatcaccccacttgaggacagagcagatgttgtgtagccacaagagcctatgggaacacagctgagggaggaagagtaagatcagagtcgcatccctgagccaggctcagtggctcacgctgtaatcccagtgctttgtgaggtcaaagcaggaggatcacttcagcccaagagtttgagaccagcttgggcaacacagtgaaaccctgtctttacaaaaaaatacagaaaaaatagctgggtgtggtgatgcacacttgtagtcccagctactcaggagactggggagggaggattgcttgatcctgggaggtcaaggctgcagtgagccatgattgcaccactgcattccagcctggacaacggagcaagactcagtctcagaagaagagtcaaatcccctgggctgggatcttggctccaccacttgttagttgggtggccttgggcgtgttgtttaaactctccatgtctcagcttcctaatctggaaaagggtataatgatggtacctgcactcagtacaaagcgacagctattgtcactaatatgtttgagacccacttggtggagcagctttagcctcagaaccatggatagtgcaagtacccttttctttcattagcagcggctccactgggtctcttgcccatgggtgccctgcctcatctgttgagtcaggctccctttcatcgtaccccatgaggcctgcctcttctacagaagcacccagcaggtgccccttccttcctgtagcatcctttgagcatgactaagtgacaacatggtgaggcttggcctgctctgggatagggcctgttttcttggctgttgtctctctctgttctcttcctctctcttcagttgtcatcagttctgcctatctgttggagcccccagattttggtggtggctttcattgggtcaggtgggctcaatagcctgggtcagactataattggggctgctgttttctgctgtcacctccagggtctttccctatccctgtgctggcctggggatgagctgcttgctctgggatgaggtttctgtgacccacataggcttgaccagggctcttgttctactcaccacagtcccccaggatctgatggatgtctccatgagtaacctctcattcctatgtcagcccagctcctggaaatcgtccttctcattctgttgacagagtggttcggctgagatttgtggatgccagtatctttccctacattgaattgagtgaacatagactatggagtcaaccagatctaggttaaatcctggccttgtgaaattctagctgttgaaacttatgtgtattagtcaggctatacaaggttatatggtgcagtaacaaacagtcctaaaactcagctttttacaacaaattttatttatcatgcatgctgtgtgtctctcataggtcaaatggtgaggctctgttttttccacaccaaagggtccagctgttggagcagccatcatttgaatgttgccagtcacagtgacagggaaaggtagcattggaggggcttgaacccacaataaaagggccccacccaaaattagcatgtcatacccacccacagctcattggccccatccacaaggagccaggaagtgcagccctaccatgagcctagaaggcagaataatctcaaatattatttaatgtcaaccacattcatctcagtttgctcctccacacagtggagattctggtgcttactttatatggctatggtaaatgccagctcagataatggtttaaagtggccagaatatgccacctgcacacagtactgttcagtaaataacagttaccattttatcatgtaaacttaaatctcaggcgcatctctctctttgcccatagagcttttgtctctttggaactattcagccagttcatgagactggttttgtttcctcctggccttgcctggtagaatggaaccctattgtccttgctggtcttctgtaccagtgtgtggtccagtcttcagccataggagtgtacggtgtgagggctggcattacattgttgaagtcatcatctaagctcctggctcctcagactgtggcctgtgaaccagcatcagcaccgggcagatggtcagtctcttataccaaaccttctgaatcagaatttgtgtttaacgtagtcccaagaccatgtgtgtacttttaagattgagaagtgctaatgttaccggatattctcttattgtgcatcagaatcccctgggctaggtagcaaaacatgccagctcctagactacttcatagaagttctgattaagtctgtgcagggcccaggaatacacatgttggagcaactgcaagtaactgttaggctgatggtccatggaccagtgagaaatgctgctgtaacctacaaaattagctgggtgtggtggcgcatgcctgtaataccagctactcgggaggctgaggcaggagaatcgcttgaacctgggaggcggaggttgtggtgagccaaggtcacgccattgcacttcagcctgggcaacaacagcaaaactccatctcaaaaagaaaaaaaagaaagaaaagaaaaaagaaaaaaaatgctgccataacttactgccctctctcctgttacagcgtctgcttacacacctggcataatggggaactcagtaccttgcagaaaaccaagcccacagtgggacagctgtttatgtgaccctattctcatgtaacctgagcaactgtaagcctcaccaacctgagggcacaaagtgggacacttcagtattcaatgcctccatgtgcctgtaaaaggaaagtaaatctcagggccccaaaccactaagctaaagggaaaagtcaagctgggaacagcttaaggcaaacctgcctcccattctattgaaagtctcccctctgctcactgagataaatgcatatctgattgccccctttggagacgctcatcagaaactcaaaagaatgcaactgtttgtctcttatctacctatgacctggaagcctcctccccacttcaagttgtcttgcctttctgaacagtaccaatgctcatcttacatacattgatcggtgattggtgtctcatatctccctaaaatgtataaaaccaaactgctctgaccaccgtgggcacatgtcgtcagagcctcctgaggcggtaccgtgggcgcacatcctcaaccttggcaaaataaactttctaaattaactgagacctgtctctcatatttggagttcacatgtctaactagaggacttcggctatgtttcccccaccccagtctccctggatttttctggatgtcctttgggatgtgctgagaataaatatgccgatattcttccattctgttcattgcaagagcgtacaacactcccttcagcagtcctggatttatccagcaatgctggtaccttactcctcttgcctctttcagccaaaaaagttgccacaaattcccatgcagggagaatccttgaggcatcacctacttagcaaacagccagatactgaatcccagtttggctcttggttcagctgggtcactttagaaatcagaactctttcggccgggtgcagtggctcatgcctgtaatcccagcactttgggaggccgaggcaggcagatcataaggtcagagatcgagaccatcctggctaacacggtgaaaccccgtctctactaaaaatacaaaacattagccaggcgtggtggcgggcacctgtagtcccagctactcgggaggctgaggcaggagaatggcgtgaacctgggaggtggagcttgcagtgagccgagatcgcgccactgcccttcagcctgggcgacagagcgaggctctgtgtaaaaaaaaaaaaaaaaagaaatcagaactctttctgcaagtgatagaaacccacttcagactggttcaggtaaaaaaaattgttggcataacagaagcttagagtcatagtggcttcaggctcagatgctcgagacgggaatctctgtttcttcagctcttggctctgcttccctctgtgatggttccatccacaggcaggccctttttatgttgtggcaaagatagctcctaggagctactgtcctgtatcccactggtttagaaactgaagcagaaaaagactttttcctggtagttacaatgaaagtcccaagcctaattctcattggctcaggttgggtcatatgacaatctccgcttccattactatgactccagctttggtcctataaatgggtagagtcatccctttagaaaccggagacagaaagttgtggacggagtgatttctcaagggcaaactgggtcactggtagtggaagaggtgatgttgtaaaggtggaggtaatagcaccctccctgcactcctcatgactggctgatttcagttaccctctagagataacaagttgtgctcctctccaaaaaacctgggctgtgtttgaatctattctaagcatctccctccttctctgcctgcagggctccccagaaacttctcttgtgacaatatgaagtaccagatcctctgcagagccttctatggatgtacataggtctttgttgccgtgtagtctccgaggggcagttatcagtgcctactctatgtcagcgataccaggagatactggctttggagcttgaacctctcctcctctattacctgaatgcctggtttcagtgaatttacatgaaccgttctgagcctcagtttcatcatctacagattggggataaattttatgcctgagtcctaagagagggcagtgaacaatggggacccctggggacagaggtttcattaaatcaccattgtacccccaggtgccacagtggagggtttgttttcaggattaagtgaggagcatgtagaaagcccctggcagctagtcttgcatactgtaggtgctcagtaaatgtcagtttccttctgtcatgggcagaagcagaagagtaaagtgacgttatgcctcccccaaaacttaaaaattaaattcctagtatctgtattctgattgttcccacttaacagatgaggaaactaaggcacagagagacaaagtgacttgcccaaggtcacacagctaccaagcagcagagctgggactcagactctggcctgactccaaggctttgttttttcttctccgtatatttattcttagcaggttttatttccgtagcctcacagccttgatgggagagagaaaatgtgtgtgtgttttccatccctgaatatacacattttatctctcctcttgaggctgtgaggctagggaaataaaacctgcagctatacacacacctgcatgggcctgtgaaaccacagtgcagctcacctgagtgctgcagaggcggggagagcgtgactctactaggacaaaggttttgcctgttccgttacaatccacgtttttgcctaatgcaggggctggcgtggagcaggcattgggcaagtatttttggacccaaatgaaatatcttcctgcaggaagggttgggggttgatacgggtctggaataatgtcatcagatgatgtggctcatggctgatggtggttgagagcccaggttttggagccaggtgatctggtttcagattccagttatgtaacttgtgcaagtgacataaccagtctgggcctcaacttaccccatccataagatggaaataacagtagcgcctgctttcttgggttgtggcgagactgagttatgcaaactctgctaacagctccctggcacatagtgtgtactgtgtaagtattagctattagatcatcgtggtcatcatcatcatcatcattgctatgattgaccctcctgttagaatttagtccccaggctgcaaaatgtccagggttctcactgggaattgaggatgaaatggctggggaacgccagaaggaaagggcacagccagagcaaacagcacgggctggcgtttgctgaggcactttgcctaacaccctccaggtgacagggtgtgacagataaggggtggcacattggtaggtgtgcttttgaggcaggaccatcattgaaagcaagctgccccctcagtatctctctccctggttcctgacttactggggcctttttaatccagctgcaattttgttttatttttatctgattttgttttatttatttatttatttattttgagacagagtttcattctgtcaatcaggctggagtgcagtggcgcgatctcggctcactgcaacctctgcctcccaggctcaagcaattctcctgcctcagcctcccaagtagctgggattacaggggtgtgccaccatgcccggctaatttttgtgtttttggtagagacggggtttcaccatgttggccaggatggctgacctcaggcaatccaccggcctcggcctcccaaagtgctgggattacaggcgtgagccaccacgcccagccgattttattttttagagacaagatcttggctcactgcagccttgacctcctaggcttaagcaatcctcccaccttagcctcccaagtagctgagactgcaggcacacgccaccacacccagctaagtttgcttattttttgtagagtctgggtttcactgtgttgcccaggctagtccagaactcctgggttcaagcaatccacccacctcagcctcttaaagcactgggattacaggcgtgagccactgtgcccggccggccctctttttaaaaaaatttgtaatagatatactgtagttgtacatattttgggggtgcatgtagtattttgatagatccactgcgtattgatctatcacgtttgaggtgattggaacatccatcacctcaaacatttatgttttcttcatgttgggaactttacagttcttctagctattttgagatatacaataaattactgttaattatatttttcctactataatatacaagaacttaattccatctaactggatttttgtaccattaaccaacttctcttcattcccctcctactcttcccttcccagccactggtaaccaccagtctactctccgcattcatgagaaatacttttttagcttccatgtatgactgagaacatgtgatatttgtctttctgtgcctcactttttttacttaacataatgattttcagttccattcatgttactgcacgtgacaggatttcatcctttttcatggctgagtaatattccattgcatacatataccacatttcctttaactgtcaattcattgatggacacttaggttgattctgtactattcctccacacataggttgattttgtactatcgttaatggtgctgcagtaaacatgggcatgcagataactgtttgatgtactgatttcctttcttttggatgaatacctgtattcagctgatatttgaaagaaagttgtccacatctcacagtgtctttctctgtgtatggattggaggcagacaaaggcacagcaaggccacagagtcattggccaccttctttcctgtcccttctctgcctccagcctatcaattaaatgttttggcttccagcagaggaggatggcatcaccctgactgtggctgagcaaggtgataagacttccctagggttgtagagctattaagccattcagccagcaagtgacatcaagccttgccttccttgtgaagaaaaggaggggttaaaaagtagctgagcatgatggcacatgcctgtagtcccagctactcaggaggctgagatgggaggattgctcgagcacgggaggcttaggctgaagtgagccatgatcacgccactgcactccagcctgggtgacagcgagaccgtctcagaaaaataaaaaaataaagatgggagtgtgggacagcactttggggactccataagacagggcaaagggtatcaggtggtagatgatgatgcttttctttcctctcctgacagggcttacctactgcagacacctgtccactgagaggacccacttgtcatccctggtcaattacatgatcatgtctctggacttgccctgtgatgctggacaggagctgacagccgggatctgggagcaataccttcaggatagcacagcaaggtttagctgggcttgatctgcagtggtgtagaggctgcaaaggaggggcgattttgttatgtgagaaataagcccacctacttgtggggactcaagatgacttgtttggattctgcatatgcaaattgaagatctcctcctcttcttgagagttccaagacccacaactcacttttgcccgtgagtgtggagattgaaggggatggaaaacatgctcacctgggatgaataaagagaaagtcagtgagtaagtatttattatgaagcattagtttgtatcactcctgcacaaggtgctgagacatggccccagccagaaggaatttacagtccagtcaaaactgcctagaagtgtgacagcagctgagttggagggaggcagctgaaccaagaaaaccttatcagcactatttgaaacttttatctcatctggcttggcgcctgaggttctcccattaggtaagtcacctggaatgctttctaatattttcttataagaatacaaatgttcctggaaggaaaatgtttatgcttgaaaagagtctcataatcaaatagtttggggaagtttaagttaaacaggtatcctgaaggatatcttagaaccttggctattctggtattcttgtcactctcaggaaattgaaggcgtgtgggagagcatatggaacattccttcaaatgcatttggtcatagaagcctttactggaaaatacctcccatggctagtaaaaagcaaaaatgactgagaagcactggtttatctctgccaagaacaaaatctaggaggaggtacctgtttcctccacactgggtaaatctagtggcccaatctgctgtgcaccttcccacccaggtgcgttctggggagggttgagctggttgagtgtatcaagagttgattcctttggatggctgagtgctattccataagatggatgtagcacagtttaactgttcacctgctgatggatggctgagttatttctagatttttggctattgctattaaagctgtaatgaacattcacgtacggttgtttgtatgagcacaggttgtcatttctctgggatagatgagtcagaatgtaattgctaggtcatacggtagttccatgttcagtcgtataagaaactgccaaacatcaacagtagcatgtgcctttagtcccagctactctggaggctgaggcgagaggatcactttagcccaggaatttgagtccagcctgggcaatatagggagaccctgtctctaaagagaaaaaagagactgccacacttttgcagtggctgtggtattttatatgcccaccagcaatatatgagtgattcacacttatatcttcagcagagttttgtcttgtcactattttttattttagccactctgatgtgtgtaaattatatttcattgtggttttaatttgcatttcccaaatggctagtgaagttgaagatcttttcatgggcttatttgtccattgtgtatcatctctggtgaaatgtctgctcgtgtcttttgcccatcttctaattggattgtttgattttttgtgtggagtttgcaagttccttatatactcaagataacagtgctttgttcatatatgttgtttgaaaatattttctcctagtctgtaacttgtcatctttttaacaaggtgttttgcagaacaaatttttaaattttgatgaaacttagcttagcaatttttccttttgtagactatgtttttggtgtcaagtctaagaaaattttgcctagtcctagctcttgaagatcttctcctacattttatcctacagggaggcacctgcagctgggctggctttccagctattttaagcctcagggaatcttggtttctccaggccagctgtgctggggatgaggtgcctgagctcatggggagaccaacatgggcagggggctgacccgaggctaactggggctggaacagcctgagatgacaacaaccaaggacagagacaaaatagaatatccattttccatctgaatgtctctccagccacccagaaagtcaatttccattattatgaacctagcttcacagaggggaaactgaggctgaacccgagcctccagctccagccacaggcctggcccagtcagggctcctcagcccctggccgcctccagtcttgggacatcgctcctcctgagaccccagacaggtgctctctactccccactctctgccttatttctccccagcacaaaccccatctcctacaccacatcgctcccttgtctattgggttgatttacatctcccccaaatacgagttctccgagcctggctgtgcctaccttgccccttgctgtgttccatgagcaggaggtgctcccttgtctgaccagggtcccctgagaagtgggcccatctggctggtctggggtctcaccttcttcaaccactctgcccaggagccccgggacccagcaccccttcctttcagagctgctccgtgcccccgggccctcacagccttcctgtctcctgtgggtgccctggccaggcctggctggtgggtcatcctaaccatgggctactctgtcctcagagtggacatggggcatctgatggccccagctctgtgacacaggccacagaagtcacccagtccctcactggctcttgtacttgcctcatcgaaacattctccctgaagcccgtggtctccccagactcatttctcattggtccccacatgtgctgtgctatcgctgatcggaaaatggggtcagggtcacccccggcctctcatgagctggagtgagcttatccccaggggctttaagcagggcccacgtgagaccacgaaccccatggtgactgcccaggtgtggcccttggtaaggctgtccttgttgatgtgtcaggaaggagagtcgagggagagccccctctgagaggtgtgactgtcattgtgctgcgtcactaaccggtgggcattgcaagtggacagtgacttgtttcctctacctcccgggaagttcccacattctagttggctgaagcttggttttggaccttcgtgttggggggagtgggtgcttgctgggatccagtggcctctttttggagcatctgggtctggtttgcttgttaccagtgagtgtcggtgtcctcaggagaatactggccggggaccagccccctcttcccaccactgggctcagtgagtatgaggggtcaagggcccctccacaggcctggctggggatgctctcttggtgcttttgcaggccccatggggggccaggtcagataggagagtcatccgcttagctcagtaggagctcctagccctcacccagagccccaagcagccacctcccctcccatttcctcccctcccccaaggcccctccatacccaccggggctatttggggctctggttttggctgtagaggaagccacagatgcccctcccccatctgatttagagcaaatgcctcagccctggtcacagcgaggcaggaccagggccgggacaatccctcctccctggactccagtgctcttctctgtacctttaggggctctcccagtgtggacctaccctgccctggtgctgtggggccatcactcctgaggatatgaccagggtctgagctgggcagggcagcaggtgcagggcagtgcaggcacagggccagctgggccactctcaggctggccggagcctgggtggccctggttggtgcctccctcctggtcagcatcccctctataaggtgggcaatggcagctctagagctcagggtcgctatgaggcaaccgtggtgcattcctcatggtcggcctgccctatgtgaggtggaccatggctgccctgggcctcagggtcactgtgagggttgatgagggactgtgatgttcccactgtggcccagggatgacagctggggctccgtcagatggttctttcagttaaatcttctgctaagtagggggagatgcccctgctgccccaggcgctccctgggccaagctccaaccttggggacttgaggacaggggggtgcagtggtgtctccctgttgtcctccagctcatgagcttctccagggcaggtggtcctggtcttgcaccagcacctggcccacagctgtgctcactgagggtttgctgaatgagtgtgtgagtgaatgaatgaaggactgaggagctgtggaaagaggctgggggtgggtcaggcagcagctcaccatgttgacccgggcaggtcacttcccttcccgtggagcctcagttctctcttcggtgaaatgggcacacgagcacctgcccctgctctgctttgtggactccgaggaccctcctgcttctgcctgtctcctacaccggctcgatgtagactgaggagtgtaggtccccaaccccacagagccacaaggggattggtgtgttcagtactgtctcctggccctgcctagcacagcctcaagagggaagggtgaccttgggtcaggggcctgggcacccactgtctgtgctgccctgaacacctgcaggacctgggcaggctcagcctcctcagtctggcctcagggaagggggttagccctgggtagacccagggtcagactgggcatctaccatctgtgcatccttcagcaggtgtggaacccagccaggccaaaccctgtctctaccagagcagggaccatgcaggaaagactaggtggggctgggccttgctctctctcctggcaccttcctctcggagaatggctggagccccagacccagggagcctcacagagaaagtcccgaggcaggacctggttttccacctgaggcccaggatccaatggagaggtgtttcccaaaaagaatgccccccaaaggcagccagtgactttctgtgccacacacttgagaacatctccgtgttctggggctgccaggcagtcacctgtgcaggtgtcggagcccaaatccaatcaatactaagggattgggtaaaacacatccccactgcctggagtggtggttcacacctgtaatcccagcactttgggaggccaaggtgggcagatcacgaggtcaagagatcaagaccatcctggctaacacggtgaaaccccacctctactaaaaaaaaatacaaaaaattagccggacatggtggtgggcgcctgtggtcccagctactcgggaggctgaggcaggagaatggcgtgaacctgggaggcggagcttgcagtgagccgagattgcaccagtgcactccagcctgggcgacagagtgagactccgtctcaaaacaaaacgaaacaaaacaaacagacaaaaaacacatccccactgttagttctgaggagatgcctggcctcagcattgaaaacaccaacttccctcaagcaaaggctttgttaaatctcatagaaatgatggagctcctgttacccttcttgctctggttcctggggagcttagagcctatctttggcaagtgtcctgagcctcctgcaagccttttgtgtgtgtttccttcttgccttcctccgatttttcttacacctgtgaacctgctggcaggtgaagaatcgaggtgggccccaaatttaacagctcatgaatttgaaggtgctggagtattctggacagtccagctctcaggggtggggagttgggcagagagggaggaggggattccaggggccagggccacgggcagaggaactccaggcccagagtgttacttccaggctgaggaaaaagaggtcgtaggtgggaagagtgtctttactagggcaaggacagagggcatatctgaaggcccagccagggacagctccatccagaaaggaggcagggagtggcggggggttgggggagggagtgctgcagcggggaattggaggagggagagggcagagggactggtcttcagtgatcagattgctccttgcctggcctgtttctccagcagatgcccctgggagcctgggagcctctcccacaagctattttcccactgagtgtcaggattcccccatcccccactgagaacctgggggaagtgtcaaattatatgaaaggtaagaaatgaagacagggagcagaatttctgattaacaatgaggatatttactgagggtttattgggtgcaaggagaagggctggatgccttggggtgggaggggagacccctgccctgggatcctgcagctcctggctgctgtgggtggggtgaggggcctaagaacatagctgctgggggacctccactggtcagacgtcaggttcaggtagctgctaaccgtgtacttgtgtttctctgtttggagggtgtggcagtcttcatgcccagggtgatggtggtgccctctgccttccaggccaccatcacggcatcagggtagaagtcactaatgagaggcatcttgttggcttggagttcctcagagtgtccaaaggggcggccttgggcagacctgtgtggacagaggagggggcaagagaggcagagggagtactggggtgttgtagagccccctctctgtctaaagtctctgtgaggttcacggcatggctgtccagtccacccggggctgcctcttccctcctcattcccctccttttcactcaagacctctgcagagcagccagcccgcaccttcctaggagctcttcccaagtcaccttttctaggagccctggcccagccctcctctgcagcctctgtttccctgtgtgtacccagggcaggctgtgctccctcctctctggtctctggagtctgagtttggaatttgcacgtccccgcccagcccacaggactatcctggcagagtgtggaaaggcccaagcctggtggggcctggagcttcctgtcccctggggcaccaggctttgccccagcccatcccattcagctttcctgatgaagggtgggctgcacccagacaagccccggggctcctccaccgctcttcacctcccttgtccccaccaccccaaccataggacccttcacctccactgtggtgttggggctgctcccctggaccacgggacacagcagccccccatgcctgcctccacggactctgacaactctagacttcagctggctgccgtagagtcctctgcaccccccattcgctcccctcttgtcacctcctgagtctaacgtgccctttgaggaaggtgggagactgacccatggacagtgagacgccaggccccaggggtgaaggggctccagggacaaatatgtctctgccctaagggatctgctcctctctgatgactattctgggagggctgggctctggccatcttgccccatctgacccatcttctttttttgtccctgtgtcctcatgacccagcagaggccagagagctgcagcctagacccagagccctctctgcacctgcattgatgtcacctcatggtgacccctttgtccccaggcccccgtgtggccttcccaggctggatgggcatccagccatcagcctagaccctggggtccggggggtgtctctgatgctactgcagtgtgccagtcagaactggcctttgccccgcacctcgggtgcctgccctgaaagaggtgaaggaactctgaccttgcctaaacccagcccaggccccgggaccaggctgcgtctggctgttggaacctggggcccttctgctggttacctcaagactaacccacctcccccaggacccatagagaaaggtaggggtcagtgattaaggctgggagggcagaggagaagccaccccagggagagaaaacatattttccagagacaacagagggtggaactggctggggaaggttgtaagagccacttacctagagtaatgagctggttcccactgctgtttacccagtgactgaggcttgggtccaaattcctggggccagtacaggggccaggctgaagcggaaaccttctgggcatgatgggcacagggctgcagtgggcgttgttgggacctaggcacagtgcgtgggggtgccagaccccgagaggtgtccctgtgcctgtcccctgtttgaggcaggtgccacccacagtcttggagtcaccccaagtgtgtgtcccccctctctgaagctgttggtgctggtggcaatgctgggcccagtaggtcccagcaactccctgagtaatgtgtcccctaaggcagctgtgctgtgtggcagaggagtcctgagctggctcggatcagcccaacctcacctggcctcattttaagggcctctgagtcctcccacaaatttcccagtcaagccaggctggcttcctctctggatcaggacactgggtcattctcgactcaagtggagagtcctctgcttttatatctatccgtggagacacagctcagtcccacttttttcatgaagcttttctgatttctcagattattagtttcatctgtccatctatccagttgtccatctgtctgttcatctattcatctgtctgtccacctgtttattcatgtctgtccgtctgttcatctgttcgtctgtctattcatctgtctgtccatccatctatcacccactggaggattccactccatctcactctcctgtactcctcctctggccctcatgcaggatttttcttttttaatgtttctggtaccagcagtattaacagctccattcttaaagaagcaataccttggccgggcgtggtggctcacacctgtaatcccagcactttgggaggctgaggcgggtggatcacaaggtcaggagatcgagaccatcctggctaacacggtgaagccccgtctctactaaaaatacaaaaaattagccgggcatggtggtgggcacctgtagtcccagctacttgggaggctgaggcaggagaatgtcgtgaacctgggaggcagagcttgcagtgagccgagatcacaccactgcactccagcctgggcgacagcgagagtctgtctcaaaaaaaaaaaaaaaagcaatttattttttaccaacactgatgtgggtggatgctgttgtttgcaattaaaaaccaaggccgctacagatatgggcacaatattgtgtgaagctggagaccctcatggaagcgaaaacctgggattggctagccaaggccaattgtttccaaagccctcttaagaggatgtgattactatcaaagggtgagatgctggcagcaaagattatattcacctgaatgaaaccaggtgtggtgtacgcctgtagtctcagctactttggagacagaggcagttgactcctcaacttcaggaattgaggctgcagtgacctgtgttcatcccacttcactccgtcttgggtgacagggtaagactatctttaaaatatgtatttttaatttttaaaaggatcatattcacttaaatgtgaacaaagtgtccattgagggcacagctttaggggatcaagtggccacttctgtagaacagtgtgatgggtacgagggcttaggaactagaggcaggtcggctgcttctaactgcactgctggagctcaaatctagaattcacacctcaaacagggtcaatgtctctactgttcaatccatgggacattcttagcctggcccccagaacaaggcttgtgtctacctgccatgacctgctcataggagggtgaggtttctggttcccagggctgttggctgtctcagtaccatggacgtgtgtcctcacagcaacgggccaaggcagaacagctccccgagagtcaggatggttctcttagttccctgcttctcacacctgggccctacccttagacagaggaggtgacactgagaaagacaaaacttttgaaagtgggaagtttcaaatgcggaaagaattgtgatgttccctgaaagaagtagtaactccagcactggagataagatagtggcatcagaaattcagaggggcatggcttacatgcgaagagtgaagctgtgtgggcctgagaccaagaaaagaggtactggactccgattagctgggcccagatggccagacaggtgtggagacagatggaggtgtgtgaccaggaccctcctcagaacaccactctcgcttggccaaatgccctgttcttctgggtggctatgcttagggctagcgtcactgaggtcactgtgctgcaattaggcatcttcactagggattcagtcacagatgtaaatcaatcacagtcgcgtttgtggaagaagactccaaactagaccaaccgaatctctaggggctgccccaagtgtgcctggggtgtcctggtgccagtgcacagctctgggtaagaaccactggattagatatgtaagccccatgggtaagaagaggaccttgcctgaaaggtggatcccaagtattggtcacctgggaagactgtggaatcctagagaggacaggggacagagagagagaattctagaagtcctcatgctcataatcatgaagacgccaagatgaccaggatgaggtgagttgtcctttaagaagagtctagattttctttgtcctttacatttttttctccttccttcctccctccctccctctctctttctttctctctttctctttctctttctttcttttctttctttctttctttctttctttctgtctgtctgtctgtctctctctctctctctctttcttctttttcttttttttctttccttctttctttctttcgacagagtcactctatcacccaggctggagtgcagtatcatgatcttggcccactgcaacttccgcctcccggcttcaagtgattctcctgcctgagtctcccaagtagttgagattacaggtacagcacactccaccatgcccggataatttttggtgttttctttttttttttagcagagatggggtttcaccatgttagccaggctggtctcaaactactgacctcaagtgatccacctgcttcagcctcccaaagtgctgggattacaggtgtgagccactgcacccggcctgccctttacatttttgctataattttagaatcagcttgtcaatttttaccaaacctactggaattttggatgctaaattggctcacaatgaagttaaaaaccaaataagaatgaatccattgccaaatccaagatcttgaaaatgtaattccatgttttttgtttagagtttaacagttttagtgtttatacttagggctttgacctattgtgacttaatttttgtatatggtgtgatgtaggggtccagcttcatccttttgcatgtggatatccagttctcccagcaccattcttcaaagaaatgagtgttttccccactgaatggtcttgtacctaagtttttactcagctcggtgaaaacgtgctctcactgatgaggctgataaggttttgtcttgaattgggacctgggaatagtgctggtaatttggagatgacatgaacatttatttggggctaccccagtgctctctgctggttgagcaactgcgccatccagccagttggaaggtttgtaatgagggagctgaatgagacagagacgagaagaaagggcgaaagtggaagaactgcatcaagaattcaggagtgaagagggagcaattctcctgaacattccatgaaataatctaaataaaaccacctagtaccaagcctgccctgtaggagatgcttggtgatgttctggttgtctttgagtcaagatggagtccatctgggtcggaaagataaaatgacaatcttgctgaagtttttctccatccgaggtggaagtgagatttcccactcatgctctccagcgcttggacttgcttttgggaccagctctgatgaacctgtgtacactgagttgcaagtgatggacaatagctcagaccaacagtccacaggtgagttgcaagtaaccccaaggtgttaatggctgttccttggcagaaagagttcaatgtgtttatgaagcatcacataccacattcccctcctggggactgacagtgtgtgtggtgtatagagcaagtcctggcatacagcaagtgctgtacaagcattaccaaggattcagtaccacagacttggctctgaagctggccactgtgggctgcatgcgaatggtgtttctgtaaaatgtgggaattgctggccgggcgtggtggctcacgcctgtaatcccagtactttgggaggctgaggcaagtagatcacttgagccctggagctgaagaccagcctgggcaacatgatgtaaccacatctctacaacaaatataaaaattagcagggcctggtggtgtgtgcctgtagtcccagctatttgggaggctgaagcaggaggatcgcttgagcttaggagtctgaggttgcagtgagctatgatcataccactgcactccagcctgagtgggaaagcaagaccctgtctctacaaataaataaagaagacatgagaatcgataatgtaatgcatgttgagttacacaaatgttctcctgggcattgtgaaactatgtaatattttgttagggccaggtgcagtggtttacacctgtaatcccagcacttaagaggccaaggcaggagggccagtggaggccaggaatttgaaactagcctgggcaacatagcgagaccctgtctctacaaaaaagaaaataagaagaaaattagccaggcatggtggtgtgtgcctgtagttccagctactcaggaggctcagggggaaggattgcttgaacccaggagtttgaggttgcagtgagctatgatcgtgctattgcattctctcctgggcaacagaatgagaccctgtctctagaaaaataaaaagattctgctgtgctgcagatgttgagattttgtctctgtttttccacagtggtttgctaagaaggccattttcaactctccactggaggcttttatggcgttccctcacctgcagcggcccagctttctactggtaaatatcagctgtctggatgagtgtcagtgtggccacagctctgtagctgtgggacttgaatgttcttcccattgacttgaagaattctctagtggttgtcttttaggagcgtgtgatggaagcaatgccagactccttaagcttgactgtgcccccttattactacagggccttggggttactcaaccgctgggctctgggctctgggttttcccatacaagacaaattcattcaagttctattttctctacttcccaagggggtatgaggaggaggagggggaggagcaaatgagaatgatgtacatcagagtgttcatgatctgtaagttcttaaacagacatgaaacattctgataatcataattgtcattagtgaaaaatggagacactcttatgttctgagggggtgctaggttagcactttaactattaaacatggtgctgagaactgggtgtaatggtccgtatctgtagttctaactactaaggacaccgaggaaggaggattacttgagcccaggagttttaagaccagcctgagcaacacagtaagactcaaaaaaaaaaaaaagaaaaaatgatactgagaagcgagaagttaggtatgagcaagtattggtgatgaaagttcctaattttagttcttaggaggtatttttgtaaatatgtatgtggaaggacgttcctccccagggcaccccactagagccaccaggtctgccacatggccagacaactcaggtctccatctcttgtctcaaatcctgtgaaatccaccctcatttggaggtagacaaggcatttggaggtagacagattctagcagtttctcctgatgtgagtccatttgcacagacgctatttttatccttgtagtcaggatgctttccgtatatcccacgactgtgggtagattttattagtccttgtcctgagtcttttctggcctctccattgcctttatgtttagtgtttacttggtgcaagccatctataatttttacctgccttgtgtgtgtgtgtgtgtgttttgttgttgttgttttgctttgttttattttttttttttttgagacggagtttctctctgtcgcccaggctggagtgcagtggtgcgatctcagttcactgcaacctctgcctctcaggttcaagcgattctcctgcctcagcctccagagtagctggaattacaggcatgcaccaccaagcccggctaatttttttgtgtttttttaatagagacaaggtttcaccattttggccaggctagtcttgaactcctgaccttgtgatttgcccactttggcctcccaaagtgctgggattacaggcgtgagccaccacgcccggccctgccctgtgttttaaggtcattggtttagtaggttcactgtctgctgaataaaagacagctcagttaagagaggatgctgtagccctgattttgttgggcattcttactgatgatcacaactgtgtaatcatgatggtccatcaggtgggaaatttccatttgatgcgtacgaactcagtagtactctgtggtctgtgagaggtgcccttacacaatcgagatcctcttctggctctggggctgaccctggggccaacccctacttatggattggtggaagtcagtcctgttctgatgatgagcagcacgctgagttggtactgggaagcaagcctgagagttcctggtccagagtgcatagaaccacagcctctcctagtagcatcctttgggccactgacacacatgaggggctggggaatcacgccagtggttatgtgtctgactcataacctatcacttggatttctgtttgactcaagccagagtatcactaaaagctgcagtgaatgtcctcatgattttttcactttgttctaccttctaggctaccctgaaagctgactctgtaaataagccctttgcacagtgatgccaagacttggttaaagtcattgaggattttccagcagaggtatagctctgctgacatctctctttggagcatgtcttacacattcctttaaaaactttattataattcctaattccccccaccacccccactccaagcactgcctggcacagagtcctggcccattatcatgaccgtcatgtttatggacacatttaaatatgtgaacttgcagatcaggagttcttaaccacaggtgctctgtccctcaggggacacttggcaatatcagagacatttttgattatcacaactgggggtgatggggagtgtgtgctactggcatctagtaagtaggggccagggatgctggaaacatcctgcaaagcacaggacagctccctgcaacaaagaagaatccagcccaaaatgtcaatagcatcaacgttgaggaaccctgatgtaaatgctaaaaatatgtatttaaatcacacctggaattgtcaagcccaggaagctggcctagacaaggagttaataccaaatgacaacaggtcagttagattttaagggcttcactctgggaagggtgttgctttcctttctaatagagcatccttcgcatccatcagaagtttctgacattaaaaaaaaaatcttttggtgtggtggctcatgcctgtaatctcaacactttgggaggctgaggtgggaggatcacttaaggccaggagtttgagaccagtctgggcaacatactgggaccctatctctacaagaaatctaaaaattagctgagcgtggtggtgtgtgcccacagtcccagctactcaggaggctaaggcaggaggattgcttgaggccaggaggccaaggctgcagtgagctgtgcattgcgccagtgtactccagacagggcaacagaatgagaccctgtctcaaaagaataggtattttgtttattttattttatttttcattttttcatttttttgttttttttttcccttaatttaggcttttatcacacacaaaaaatgtattttgatcagaggctgacttacttaactggcccacgtctaaagcagcactgcttggtaagccacgtaccccagtgaaagaacccaaagctgctcttctcattggcatcaccgcaccagggttcctttgagcgcagggctgatcccatgggtctcagccagggagtggcctcctcagagggagctgggcagcaggtggtgcaggcctggagctggggcaggagtgggtgctggtcctgcctgcagcctcaccgcacactgtttcaggagctgcacgccatctccccatggctggtagcattttcggcagcctggatggtgtccttgtgggctggaacctgcgctgcttacagaggcgcgtgaatcctgtgaagtacagcatggtgatggaatttctcgaccctgggaaggtaggtttgacacccgagagaggcagggtgcttcctcatggtgattccacttttaagtcactctcaatttcttaaggttaagatacaatcaaagcaagataatttgcagttcatataccctgtttttgtttgttcaatttcatgttcagcggcccaatgatgaagttggtttataagcttcaagctgaagacttaagtttgactttcccatctcctacctgcccataagtaaaccacagtggtgagagtggtgctcgggcagtggaccttgcacagcccagtggtgacgggcagtctcctccggtcctctgagggcaaattaaggagtgatttgctccgggggtatgagaggcaaaggagatgggtattgcatggctgctacccttgccatctgcagcttttttttttttttaggcaaagtctcactctgttgccaggctggagtgcagtggcacgatctcggctcaccacaacctccgcctcctgggttcaagcaattcttcagcctcagcctcccaagtaactgggactacagatgcatgccaccatgcccggctaatttttgtattttttttttagtagagatggggtttcactatattggccaagttggtctggaactcctgaccttgtgatctgcccacctcggcctcccaaagtgctgggattacaggcgtgagccaccatacctggcctgtctgcagctttttatgagatggtggaagttctgagcaaagactcttgttgaggcactgctcaggagcagggcactgtccccacaggtgagttctgtgtgcgggtctcttccccagcagctttcccaaagggctgctgtgcatgtggggcactgcgtaccgggcactacacgccagtgcctgcccacaagccttgctgcctctctctgcagggtctcgtgaaggcatccatccaggagtgcgtccttgacagtcctctgtaacacaagatccagttccgcccaactaagggccttggcctgaacctggccttgagtatcctttggtggccttgaggtaggaaggttgtgggtggctcagctctcaacactgggggtttcccagcaaccctgtgtatttgcccttgacgctgccatcagatccgttcgagtattacatatgcttctttgccttgagcctcaacacactaaaggtagggaagggatgcctcttgctgggaggggtgggggcatggcccggggcttccctgcacttgccagtgctctggggccaggcagtgcccagaccccatgctaagaactagcttggttttccagccactccctgtgtctctccatgtccatatttcagactgtacctatttcctcctggtggacaggtacctgtcatggttcctgcccaccaaaggcagcctgccaccaccctcactgtcctccagcccaggatgggccagtccctcacctgctcccaggtaaggctaccctgattgtgaagacctggcccttccataagggagtggcctggtcagttgaatcacccaccaggacaatggtgccaccctttgtccagggttcccaaatttgtcttatgcctcattccccacctccagctttcttagcacagactggagggtgggggtgaggagggtgatctgtcctttagttttcgatgtctgtggccatcactgaagctatcaggtctctggaggcctccacggcctgcatgggaatgggctgtgttctgcatgaagcagccctccccacatgcagtgtctgaggtggtgagcatggcagaaggcttgttctatgggggaaaaaaaaatggaaatctctctgggccccaggaccaggtcttgaaggggaggccctgggccaaagagcctgtgtgtcagtccaaacaagctgagcctgttggtgactgcacaggtgggaagtgtgaaccaggggctcttgtgcctagctgtgctggggtctcagtgggccctaacccagggcctcttggctgacttcccaggagaccctctggggacctcccaggagaccctctgcacaggcagcagctgcctgtgctcctctgaccctccttaatcttgctgccccatcgccttccctgggaggctgcgtgcaggccccttcctgcagatgctggcccaccccagatctgctggcatgtgcaagccaggacaggcctctacctacaattcacatgtgtggacagatgccccagagggtggaggggagaaagggagcagcaaggaggagaggctgcctgggtggcggcagtggtcagtgaccctgaaatgttgctgatgctgtggaggacttggaggtgaggtggattcacaccctctcagatgtacaattcagttgccaagtggtttttatgcccagcttttgagtttttttgtaatttaattttttcttttagaaattatatatatataatgtgtgtatatatacacatttatgttatatatatgtgtgtgtataatatatatatgtgtatatatacacacacatatatatattggaaacagagtcttgctcaattgcccaggctggagggcagtattgtgatcacagctcactgcaacctccacctcccaggttcaagtgatgttcctgtctcagtctcctgagtagctgggattacaggtgtgcaacaccacatccagcttgtattttttgtaagatgggtctcgctatgttgcccaggctggtctagaactcctgggctcaaatgatcctcctgcctcagcctcccaaggtgcagggattgcaggcatgagccaccacattcagtcattatgtctttttaaagacagggtcttactctgtcacacaggctggagtgcagcggcacagtcgtcactcactgcagccttaaattcctgggctcaagtcatcctctcacctcagtgactacaggcacgcatcaccacagccagataattttaaaacattttttttttgtagagatatgacaggggaggcttgctgtgttgccctggtgggtcttgaactcctagcttccacaatcctttattggccccaggagcaggtcttgagagggggaggccctgggccaaagagcctgttgtgccagaccaaacaggctgagcctgatgccatactgcacggattgggagggtgaacctgcctcagcttcccaagtagctgggattacaggcgcaggccaccacacctagctaactttttattttgaaataacttcagacttacagaaaagtttccacgcataataaaaagaacttgcagactgggcatggtggcttactcctgtaatcccaacacttagggaggccaaggcagaaagatcacttgaggccaggaatttgagaccagtgtgggcaacatagggagacctcatttctacaaaaaataaaatcagctgagtatggtgacgtgcaactgtggaccaagctactcaggagactgaggtgggaggatctcttgtgcactcttcaaggctatagttagctatgattgcgccactgcactctagcctggggtgacacaagaagaccctgtttcagaaaaaaaaaaaaagttcatagacccttcatccagatttccaaattaacactttgctgcatctgctttatcccctttctatgatatgttttttctcccctaagccaataagaataaactacaggtaggacaccccttggcctcttaatatgtcagtgtatttcctaaaagtgaatgcattatcttatatagtcacagtgcgtgtgctcctctgaccctccttaatcttgctgccccattgccttccccaggaggctgcatacaggcccgtttctgcagatgctggcccaccccagatctgctggcatgtgcaagccagcacatgccaccacaccaggaagttagtattgccaccaggctacacctagtcatcagacctcggggttcaccaccagctaccccactcatgcccgttacctggctgggtttcagcacaggctcacccactgcatgcagtgatgtttctagtccccttcagtccggaatggttctgcagcctgtctgtctttcctgaccttgacccctccaaagcatgtggccaccccttgggctgtcttgtatttgctggtgattaggcatagcttgggctttgttggcaggagcactgcagcggggacacctggtccttgccaggtgtctcatcaggaggcctgcagtgcccctttgccccatcactggtgatgctagctttatcactgggtggaaagggtgtcggccaggtttgtccactgtaaaataagtacttcgtgcccagattaaatagtaatgaggctgagtgcagtggttcacgcctggaatcccagcacttagggaggccaaggtgggtggatcacctgagctcaggagtttgagaccagcctgggcaacatagcaaaatcctatctctaccaaaaattttaaaattagcctggcgtggtggcatgcgcctgtaatcccagctacttagaggctgaggtggggggatcactcaagcccaggaggcagaggttgcattgagccaagatcatgctgttgcactccagcctgggctacagagtgagagcccatctcaaaaaaaaaaaaattagtaatgagtgcctggacaacatagcaagaccttgtttgtactaaaaagaaaaatattggccaggcacaatggctcatgcctgtaatcccagcactttgggaggccaaggcaggcatatcacgatgtcaggagatcgagaccatcctggtcaacacggtgaaaccccatctctactaaaaatacaaaaattagctgggtgtggtggtgcacgcctgtaatcccagcactttaggaggcagaggcgggcagatcatgaggtcaggagttcaagaccaggctgagaaacatggtgacaccccgtctctactaaaaatacaaaaaattagccaggcgtggtggtgcatgcctgtagtcccagctactaacgaggctgaggcaggagaatcgcttgaacttgggaggcagagattgcagtaagccgagatggagccactgcactccagcctggtaacagagtgagagtctgtctcaaaaaaaaaacaaaaacaaaaaacaaagaaagaaaaacattagccaggcatgcaggcatggtggtgtgcactgtggtcccagctacttgggaggcccgggtctaggaggttgaggttgcagtgagctgtgatcacagcactgcactccagcccaggcaacagaatgagaccctgtctcaaaaaaaagaaaaattggtaatgatgatttaccgggaagatgtatagagactatgtattatcactagtattaacatcaactgttgattcttttctctttttttttaagtgaaagcaagtttattaagaaagtaaaggaatagaagaagggctactccatacacagagaagtcgattctttccttttttcaaattgattttattttactttaagacaggatcttgttctctcaccccaggctgaagtacagtggcatgatctaggctcacggcagcctcaatctcttaggctcaagtgatcctcctgcctcagcctcccaagtatctgggactacaggcatgcatcaccacatctgaatgcttttttttttttttaatagagatgggttttgcccatgttgcccaagctggacatcttattttttttagaaacagagtctcgctctgtcaccccaggctggagtgcagttggtgccatcataggtcactgcagcctcaactcctaggcccaaggagggagccattttcccttctcagccttctaagtagttaggactacaggcacaccccaccgtgcccagctatttcatgttttaatgtttttgtagagacggggtctcactgtgttgcccaggctggtctcaagtgcctggcctcaagagatcctcctgccttggtttcccaaagtgctgagatttcaggcgtctcacgcaggtcccatgcctggcctcacttgattcttgaccaaataagctattaatagggcagttgccaagtggtggttccctaacttcattcttcctgtattgggtcagtggtcgctctgcgggaaggaagacttttctctttgctatttgtttattcaggtgtatcagtgtggatttggggcaggggtgaggtttgtgcattgtgcaattgaacaagttgtaatacgtccctgctgtcattgattttgatgtccagatcgcccctggcctggccagcaggagctcctaccttgggcctgtttccgtgtctccctcaggacaccagccatgccctttgcttcctgtagcctccagcacactagccccctgaagcgacacttctctcatcagatgtctgtgaatgcagaccccgcctcccaggagatctggaggtcagaaactctgctccgggtgagagctgagctggtctcaacgtctgtttcaaaagaaactggtcagccatcttccactatatgggtcagagtcccagaggcggccgcttagcccagggctgattctaaattgttggcattttcctggtatgacatttagaaaacatgaatataagtctgcccacccacctaacttacttgtcattcatggtgtttttcatcccaggatcccctgtccatcggagtcgtttcatttgcccattgtgatataattgttgcggtctcttggtgtccgtctctcgtgttgctggagatgcttcctatgattaccatcatgtggatattaagcgttgccccagtagcacttttgtgacacggaatggtgaggggtttgtgcagcctccacaggccttctgttgattcaggggatccaaatagtaggtgacagagtcccttgtctgtcctggggggctccagcctctcacgatggtgtggactggctcactccctgagtgctatccaccaggtcctggctgtgtcttctgagcataacttggagagatttggcaggtgctgctcctgacactggatcctaggactgacttggtagccacagcctcgccgttgacacctgggaagtagataagataggattctgtctccgaccttgtacataactcctaatatgtggggtgccgtgctttttgaagcctccacaccatttcacaacaacctcgggtgctagaatgatagggaccattgtccctgggaggggcatggtccccagaggggaccatgatacccagatggctcttggctgtgtggaccatgggatgtgctggctgtgaagagggcaggagaccatgacacaagcttacaacaggacagaactggaaggttctgctgtttcctggaccaaagcattaatgcttttcgtttttttaattaagaaaaaaactgtaattgtaaaatatacataacataaaatttactgtcttaaccatttccaagtgtacagccagtagtattaaatacattcacgttgttgttatctgtagcacacagtacttctttgtgtgtgactggcatgcttcagttagcataatggattcaagattaatccgtgttacagcatgtgtcagaatttgcttcctttccaatctccagaatcttgcaaaactgaaactgaaccgaccaggcatgagagctcactcctgtaatcctagcactttgggagaccaaggtgggaaagattgcttgaggccaggagtttgagaccagcctcgccaacatagtgacaccccgtctctctctctcttttttttttttttttttttttttttttgagacagagtctcactctgtcgcttaggctggagtgcagtggtgcgatctcagctcactgcaatccctgcctcccgggttcaagtgattctcctgcctcagcctcttgagtagctgggattacaggcacctgccacggtgcctagctaatttttatatttttagtaaagacggggtttcaccatcttggccaggctggtcttgaatttctgacttcatgatgcacccgcctcggcctcccaaagtgctgggattacaggcatgagccaccatgcctggctccccatctcttttaataaaaaaaaagaaactgaacaattaattccccacgcagcccctagcaaccactattctgctttctgtttctatatgtttgactcctagatctcatatctaaagcatttttctgtagcacacagtacttctttgtgtgtgactggcatgcttcacttagcataatggattcgagattaatccatgttacagcatgtgtcagaatttgcttcctttttaaggctgcatagtgttcccttgtgcggatgtaccatgttgtgtttatctattcatctctcagtgaacactggagttgcttctatttttattttattatttatttatttatttattttgagacagggtctcgctctgtttcccaggctggagtgcagtggcatgatcttggctcactacagctcaaattcctgggctcaggcgatcctcccacctcagactcccagtagctgggactatggctgtgccccaccacacccagcaaatttttgtgctttttgtggagacaactttttgctatgttgcccaggctggtcttgaactcccggcctcaagccatccacctgcctcggcctcccaaagcactgggatgacaggcctgagccatcatgcccgctggttcttttcactctatcagtagtatcttttgatgctgtatttttttgcttgttgcttgtgatttgggcatcatatctaataaatcattgccaaatccagtgttatgaagctttctcccatgttttcttctgtaagtttatggtcttagttcttatcctcaggccgcttacccactttgagttagtttttgtcgatggtgtgagggcagggcccagcttcactgttctgcatgagggtgttctgtgttcccagctctgcttatgggagacactgtcctttccccactgaatggtcttggcagttatcgagaatgatttgactacgtaatgctcttttgcaggtttttgtcgaaatgtggcttcaacactattctctggagatgtaccaaaaaatgcagttcccctcatgccaaggtaggtttccatagtttttcttcccacctcctgcttctgaccatgctcagcctgctgcttcttatcctgcatttgagtgagttttcacagaccggatggtgggaagcagaaatccaccacccacccttcattcagaagctgaataagaagtgggcatagttctctagttcccgatgaggagcaggtggcattgcaccctgatatgtggacactgaggcctggaggtctggcctctccagggcctttcctgtgcagcttccggagccccctccctggcaacaggaacagatgaggttgtggcacttttgctgtgggggtgggggagctgcaatgcctctgggagccgcgttctcgtctgtctcctccaccatcagcagtgcctttgtgctttcccatgaagtgatggcccagggcagacccatgcccaccatagtggcaccatagttagcctcctttgtctgccccccactcccccacctcctccagagcatgagcaagccgccatactcatggtgtgtggggcctggcgccctcctacaagcagcctggcctgcttcctccccctccgcctcgcctctccccactctctctctaggcagcatgccctgggcacacatcctgtagtccggtgcccgtggcgtctatgcatgggagactttgcctttattgctgacaaagttccagaaggcttcatccagaatgaaggatctgtgggtgatggagttaaacttcagaagagcctcctgtcacttttcctccggttctggagaagagctgtgggtctgtttctgccacagcctctgcagccagttctgtggccccatgctttgccatgtgaaggctctctcagagcataggttcccccaaatcctcaccctcagcatcacctggaaggagcacaaggaaaagttggggaccccatcttgggcctcctgagtcacaaagagcctgcagtgcccttcccgcttccagagcagacttactgcatatgcctggctggtgcctggggggctggttggttcctagggccccgcttctccctggcgccctagaacacttgctcagcgctcttgcatgtggcttgacctggcaggggcaggggccgctgcactgtgtcaccttcctatctgctggttctgcctactgagtgagtggaaacacacctactttcaagggcaagccagaaaggctcttctgggctgtcacctgtgaggattctgtgtcctcatgggtcaggggaactggcaaggcgtcgtccctgcagagggcaggaggtgcctttcccctcttctcaatgttcgcttcctcttggccagaccttgggttgcgtgagtcctgctcagaatgacttgcagtggtgggacgaagtgcccagagatgctccactttttgcctcttccagttgaggcaaaaaacaaaacgtgagaaaactgggtgggtgggggtcagagaaaggcagctgtggaggtcggggcccccaaggcccctggccctttgccgcttgcccaggcctatgctgctcctgccatacagaaatccctgcctgtctctgctagctcttattttcagatgcaggaagtgaggctcccagggttgccctccacaccctggttgaatccgaggtgcatgcttgctccctggtggccccgtgggccataaagatggccaatggccccacaagccaccgtgttccttaggcaagggcagagacgcactggagaactgtgtgtctgtttcctgcctgagccctaggtctggcacagaggaaggctgtgaagggcaacatctctctgccctgctccttcccgccctgctctgcgtgttgtgacatctagcaggtgtgttctgatgtctcctgtgtggagcccagtggtcgtgctacttgggcaggaggcatggcgctcacggggcaggatatgcaccaggccagctctggctatgctgggccgaaggggtgcttcggaggctgcagcgctgcagggtggtagattggagggtcctggctgggggccagcttagcctcagtttcctgttgcctctgggtgtgtgtggctgtggccaggtcctcgggggctcctgcccttgggagccctccatatctggagggtgggagttcctgatgcggtaggagaggttgcctcctggagtcagagctgatgcacacaccacctcggctgacctccaggctgggggagtgcggagggcagggcctgggggcctgagcctgtgctacccttggggacctgtcctcatcctcagctctcagagagatccactcatggaggggacattgattgggttttagacataggaattgatcatgtcatatacaaatttgataaatttctcaaaacaacccagggaaatccagtcaattacatatgtgtcttctctaggcagagtcctcctcctagaacatgctttgccagtttattttctgggcctcaggatcttgaggccttggtggctgacagcatgtcccagagagaaggccctgggtacttgaagggctgtggtgtgcacatggcacacacggtgtggcctcagagtcactggggagagcgggtcccatctggaagggcagtgagttgggcccttccaatgagctggagaggcctttaggccccagcgacattgagaggccacccaggtgacctggagggtctatccgcccccagcctccaaggctgaggagagtgctgtcacagctctggcctggctgccgaggagggtgctgcgctggtcacagctgctgggactgcagttgtttggatggtcactgaccatgcttttgttgtttttttctcctcacttctgggctcgttctcattgctttctttctccacttccccctcccatgtccggtaccatgtctctccttcaccaccctgtcctctcatgcttttctcttctgcctcttccggcttctctctgttcactctctcagctggaggtgctgcactaccgactctgtgtctccagtgcccaccacagcccccggcagcccaacctccaggccctccacacctaccaagtactggctgtgctcgttcattcccttcccctgcccggagtgcgtgtctgcgcctggcaaagcaaggggctggctgggcccagctgcaggtgactcagaggctagtttcaggcagagtgaagcccctgtgttgagggaggcagagatcagcctccagcctggcctggcccctggctttgcagactagcctggcttgtgggagtggggtgtggctgtgtgtcagaatgaggcatgtggcctgggctggccagactccccaccagtggtggaggtgtcacaagttctctggtgttggaggctctgtgctcggccctggtttgaagagctggagtcgtgaggcctctgcagtggcccggttcacccccactctgcagggcccagtgctaaggaaggagctgaagacacagaggcctgggacttacggtaatgtgggtgctgccctgttcagaactgtcatccagcttggaggttccatgacccagactgtgtgtgaggcaagggggttggggaggacctggggcttggccctatagctcacagaggctgtcagtccttcacctagggagccctggccactcgtagacacctgtggaggtggatgagaataggtagtgacctcatagaggttgtggtctgcctaggcacaaatgacaagcgtatggatggatttgaggtcagtgaagcagagttcaggcccatgggggatttcggggacgacagagttagtgagtctgtgagagcccggggagacgagctgtgcccacagccaggggtctgtcccgttcaccctgcgaaggagcacacgtgattgaatgggaatttgagcgcaagatgaaaaaaacatgtgggccccaagtgccggtgggttgggatggcaaccactgcatgtgatggcgtccctgttccgcaggagccactggagaagagggacatgagggcttgggccagggcagtgtccaggaagcatctagcaacccccatggcaggacaggtgaccagggagaccctggaggagtgagctgaggtgctgtgaggctgggcccagtgggaaatgcggggctttgggtacacatctttgagaagcaagcaggtgtgactgtggccagggactacacatgggaatgtggcccaggaggggtacagagctgagggaaaagtttggctcagcaaatctgtgggaaaatagcctgagaggctttcatgtgactgctgggggcaggggcagacactggcccctccagaccctctggaaggaccaggtgatgttgggtaagtgaacctgcaggggaaggcaggttcccagttcctatgtggatgctgtcccctcccgtgagctgcagggaggatgtcatggctcaggatcccaggccaggatcagagggagggccaggggtgagactggaggagaaggaccctggtctaacttcccaccccactagtaccattctagtcgggccgtataggtactggttttctccttccttccaaagcaatgcaaattcattgcctaaatacttaaagatagagatagaagaaaatagccaggtacggtggctcaaacttggaatcccagaactttgggaggccaaggaaggcagattgcttgagctcaggagtttgagaccagcctgggaaacatgatgagacccctgcctctacaaaaaaatagaaaaattatctgggtatgttggtatgtgcctctggtctccgctactcgggaggctttggtgggaggatcccttgagcccaggaggcagaggttacagtgaaccgacattgtgctgctgcactccagcctgggtgacagagtgagaccctgtctcaaaaaaaaaaaaaaaaagaaaaagaagaagaagaaaatacctccattcccagcctcagccactgatctgtggggtgtgtctcctggacctgtggggacattttcctgacgggcagacttgagtgggcagtgatgtgagcagtggtccatgtgggttctgcagcatcccaggatatacccagaggccgggccctgcaccagtctcagcatcacagatgtgttgaggcccaaagggctgggggtaagcatggagaggcgagcatgtccactcggactcaggggcccaccctcagtgcccccttctcctgccctcatccactcttgatgctcccccctgccctctcaatgctgagcaaccagagaaagcccacagccagcaaaaaggctttcctcttgggtgtaggtctccaggatcctgcttgtacattgtaaatcaaaagcttggcctgttagcttgactgtgctcttgtcttggggttttcctgaccacaggtctgtgggcaacagaggaattgatgcccagcgcttctcccagggtgagccctcatccagctgtgtccagaatgaggagcagatggaaggaattggggagaaaagtgaaggttcttattttttgaacagggtcttactctgtcacccaggctggagtgcagtggcacgatcctagctcactgcaccaagaacacctgggctcaagcgatcttcccaccctagcctcctgagtcactaggactacaggtgcacaccaccatgcccagctaactttttaaaatttttgtagagacagggcctccctatgttgcccaagcgaatctcgaattcctggccttagccatcttccctgggagaccctggatccagagcttgggggtgacatcggcctcctcctgccatgaggatcaagataggcagcaatggccaagggcacagtctggcgggccatagccctgtgccacccaccgcgggtgtgcagcggtgcagaagcagatgcgtctgtctcagcgagttctccccaggtaggctgtgtgggcgctgggccaagcacttccctaccacgagctggtcgcagttcagaccaagcagtgcaaggcacacccgctgggtgtgaggcacagtggtggccccactctttgcctggctcgtgcctcctgtgtggaggcagatcagctgtcccagggcgggctgtggtcagacctggaggccacgtgctgcagcccttcccaggccctgactcctcttcctccacctaggagtcgttcatgcccaccaaggggcacatgctggtggtgcgcctgccactgaagcacctgcacgcctttgccgacagcctgaagccagagcaggtctcacctttcgtccactcccacaccaccagcccgctgggggagttcaaacagtgggtggcccttgcggcttccagccgctgctgtctcctcctcgttcccctcctccggtgttgcccacggcgacctctccccggggcatggggggcagggtgaggggaatcccttcctgctcacagagcacgtgaggcctctggagggctacgcaagtgccttctcagctagcctggtggggctgccggctgatctctggctcccagagcctctctctccagactggccaaaaaggccccatcacggtgccgtctcttgctcctccccacccgtcaggagaagggttggggcgggtcctgactcccaggcccatcggggctggcagagtgggctgttttgtgtggggctgaggtgaggtgtgtgcaggagatgcaatggcttggccgcctgcatgctgtgtcctcgggatgctccctaacctcggtttcttcctctgaagaatggggctgaaaccagctcttaccactcagaagtgcctagtgctctctcccagcagagccaaccctcactaatgggaaccccgggctcatctgtgagcagggccaccttactgtgcaagcggctggtgaccctcccctcctctgcaggccgctgtcccgaggttagtccagcagaaactctacctcttcctgcggcattgctttggccactggcccttggacgcattgttcagagctaggagtgtcggccccatcacatgtgtgcctgtgtcttctgtgtgccccaatgagggaggtcccctggggtggatgaaggagaacaagtgttgtcacagagaccttggagaggagggggccttggagggccacgttgttctttctgtttcagtttccaaaggcaaccctcaggcacagcaaagccctgccccatcccacctgtctggtgccagacaggtttctactcttacgcaaccaggtagcactgggtcccgtgggccgggaagagcccgcccatgaccctggcttctgaagagcagtgagagaaccaaatctcacagggctgtgcgcgtctctcctgcgccctctgggggacgtgggaagagccaacttagctgccacctgggtacctgggttccaggccatcagaggatttggccccagccactgggccttcagcacacacctcccccacaggtcctggaggtgtggctgagctacctgcagccatggtggtatgcagctgacaagcaggctgccagcagcaactcccagccccagtgtgtctgagaaatggtgagccctggccccctctcctcacatgccactggctcccctgggcaaatgttgctccagtgggtggaggccaagacagcggcctgtgctggggtcagcctggccctggccctctcccagctgctgctgagtggagcacagaccagcccttcctaggctcaacttcgccaggccctagaatgggtttctcatggaagcagtgggtgacctgtcccctctcccttctggcccagacaaattttcatggtgacccccaaactgttccttaacccttccttaccagcacagagcagaccagtggccaccttcccctcatctcctgcttgatcctcacagcagacccccccaggcttccatggcacctggcgtggccactgacctctcctttccttgcccgaggccttcccctttggaccctctgggggatcctccctcagccccctcaggctctgggctggcctctgccatggtggcttcagtcctcttggaaaggggcctcaggcctgctaaggatgcagcaacctcagagggcctgggtctcacctgcctgtgtcctgccctccctgcctgccaacagtctcctgagctgtcatccataacactgcacagttaaggctgagaccggctggaccctgcctgccctgcagccaccaggcaccaggcactgggtggaagaccgcaggtatacccacagagggggtctgcacagaccaagctgcgggcccatggcaccacagtttctccctggcaactcgtggcagcatccttgggaggcggtcttggtctctggcatgcgtttgtcttggctgggttggacattggcttctgtcactcctcctggtgtttgccctcctgcagacactgtcgggggctctgtgagccaccagctccctcatttgccctccccatgtcggccacctgctacatgggagacactgctgggcaggacctcaggaggacacccctgggtcatggctccccagatacctcggaggcatcctgaaaacctgtgggcagcaaccaggttctctgtgcccccggaagtgggcgctaggttcgtctcctgccttccagttcgagcagctgttcccggagccggagctcgtcatccccctaccgccagcaccgactcttcacagcctgcacattcgccagcagcatcctgtcatagtggccaccagtggtcactgatgcctccttcaatgtgaagagtcacatctatggcctggagggccaggactgcaagtacacccgatgttcgggcccgaggcttacaccctggtgagtgggttggcggtgccccttcacaggacccctggagccacaaggctgagcagaggcagggaagtgctgtgttctggcgggagggagggaggttgggcggagagttgacgcacatctcctttccccgtttcagtaaagtctgatttgtttctgataacgaaggcagtgttgggaaatttcacatttagaagatcattctttagtctttaaaagtcctccagcagaagctgctcctcccgtcactcagtgatctggctgtgcacccatcttagggcccccagccagcctgcctgggtggcagtacaggcgtatcctgccggtgacctgccctcgcctcccttgcaggtcctgcaccttactcagctcatcacgcaggccaagcacacggccaggtccatctcggaccagtgtgtggagactccagctggccactccttcctgttgtggctgggctttggccccacagacaccaacggctcctattcagccatgacctgggcgagatggggcaggacagcgtccagaagatggacgagtgcctggaggaggccctggcgtacctgcgccagatattccgagtatgagcaatggggcctgttccacggccgttagggtccccttccccgaaggatccactccccctttgcccatggtcagcatgcatccgtcccaggccccatgcagatgaacccggtgttgtgggaggcaggcccacaccccgagtgtcatgtccgggtgctctcgttgccactgttagaggctggtggggtgaagactggtgttcctttgccttgacactgagggcagaggagcttctctctctctggtagctcagtgaagtgcagctcacgcagagtctctcacacttgccttggacaccatccaggatgagaatggaaagaagcagctccggactgcatcgcgggtgaggacagactcatccccacgcccctgggccagtaccaggtgagaggcccaagtcccagaggtgcatgggttgggccctgacgtgtccccagctccctcctcccctgtgagcagagatggcttggctcttctgagttgtgtgcaggggccatgtttccttttctcttctttcttttttttgaaacaaggtttccctctcttgcccaggctggagtgcagtggcatgatcttggctcactgaaacttccacctcctgggttcaagcgattctcccacctcagcctcctgaatagctgggattacaggcacatgccaccatgcctggctaacttttttttttttttgagacggagtcttgctctgtagcccaggctggagtgcagtggcgcaatctcggctcactgcaagctccacctcctgggttcacgctattctcctgcctcagcctcctgagtagctggaactacaggtgcccgccaccaagcccagctaatttttttttgtattttttttagtagagacggggtttcgcagtgttagccaggatggtcctgatctcccgacctcgtgatccacctgcctcagcctcccagagtgctgggattacaggtgtgagccactgcacctggccaatttttgtatttttaatagagacggggtttcatcatatcgatcaggctggtctctaactcccgaccttgtgatccgcccgcctcggcctcccggagtgctgggattacaggcatgagccactgcacctggccagggccatgttttctggcccaaccctatagcctgggtttctagatcatcaacaggctgcaaaggtttgaaattgagtaccagggggacccggagctgcagcccctctggagttatgagattaccagcttggtctgagcatccttccggctgtcatctgccatcaaacacagagtgagtgggcaggagggctggcctggcctcttcagagagggttctgggtgctcctgcctggggtgcagtctcagggtggcctgtgggggtggggtgcagctgtcctgaggcctgtggtgccaccaccccatgcccccgtgccactgcctgcgcttcagtttgcagaccagatggcggctctgtgttcctgagatgacttccttgccagcttctgttgctaccacctcacagagcccacgctggccagcggccacaggctcaacctgcacttcctaggcagctacctgacactgccctggctactgctggctttcttcatggcctctctgttctgcatcaggcccctcacctgtgcactgctgttcaccctgggctacgccctctactccttggccatgatgttgctgaccaggtggggaagctgcaccagccctgatggcattggaggtgggaggccactccaggtgggaacatggttatctttgggctcctggtgggggcaggggggttcctgcagtcgtggatgcatctaggggaaatgggactaaaaagggaagaaggtagcttcaataaaatctagtgcttaaagacacagcaactgttcgatgatattgaagtattcaaaatatatgacaactacagattcactgacagaaaccaccacggggtatctcacaccttcattcaccccacagatgacacaccagggagaacagcgtctcggtggtgatttttttttttttttttttgagacagagtcttgctctgtagcccaggctgcagtgcggcggtgcgatcatggctcactgcaacctccgcctcccaggttcaagtgattctcctgcctcagcctcccgaatagctgggattacaggcatgcgccaccatgcccagctaatttttgtatttttagtagagatggggtttcaccatgttagtcaggctggtttcaaattcctgacctcatgttagccacccacctcagcctcccaaagtgctgggcttacaggtgtgagccagcgcgcccggccagtgctttgtatttttatgtaaactcagaatacaggtattttagggcctgtgaccaaaaaccaaaccaagcttgtaactccaccagggatctgaataaacctgcccttgcttttgagttttccgccgcctaggctcagtatccaggcggttcacccatacagggtccctgaccacgtgggggctgtggaaacaactgctgggcaccctgttggcccctcaccccagtgtccacgggcctggccctctggtttcctttgctttccttgcccaggggcacagtagactcggcagcagcaaaaccaaggcgcatattaacactgaagtgcctgagacagaaaggggctgggccggagccatgtgaattttgccttctactcaatatcaacgttgagtagattggcctgtaatcccagaagtttgagaaaccaaggcagggaggatcacttgagtccaggagtttaagcccagcctgggcaacacagcaagaccccatccctacaaaagattcaaaaagttggctgggcgcgtggcccacgcctgtaatcccagcactttgggaggtcaagacaggcagatcacctgaggtcaggagttcaagatcagcctggccaacatggtgaaactttgtctctactaaagacataaaaattagctaggtgtggtgccacctacctgtaatcccagctactcgggagaggcaggagaatcacttgaacctgggagctggaggttgcagtaagccaagattgtgccactgcactccagcctgggtgacagagtgagactccgtctcaaaaaaaaaaaaaaaaaagattcaaaaagctaggtgtggtggctcacacatgtggtctcagctacttgacaggctgaggtgggaggatcacccgggctcagaaggtcaaggctgcagtgaatgatcacgtcaccgcactccagcctgggcgacagagcgagactctgtctccaaaaaaaaacaagctgacgacctgaaacatatgccaccatgtctgtggcttccagaagctctgaggatctcgggagtggctggggactgtgcactcagccccagggcagcgtctggccaggaatggaggcagacacaacctactgagtagagaactaagaacagcaaagccaagtgaggaggcagggtcttggtggttggggcctggacactggagagaaaaggggactactggcacgagagcagaagcaaaatgcagttgggggttcccagccaggaggcactgggggggacttccagggaaggtctggggttggagcaacccaggaaccagttctggggcacaaggaggaggaagctctggggacttctaggagggaggctggtggccggggtcctgaggaggccaggctagaggcaggagttcttgcacattctcgtctctccaccccggacgcctccagagtggtttactctaaccgccaccacctcctcaactcctaggatgccctcaactttttgccactggaccacacttccctgctgtgaacaggccaaatctagatgcttctcagacctcatggcctggagcctctggcagcacagcttcaggctctccagacaccacccctgctccctgcacctccacatccccctccttgcaccaggcaacgctattcccctggaacccatttgtggcccactctcttccatgaccaacacatcctatctctaggatgtaccagcacccacatgatcccaggtgactcagattctgatcgcctcatgcaggcgacccacaagcagaggccctgtgtaatcaggagaactctatacctttcctcttggacatcaaagagcaagttagatcccctaaatggccaataactctgacatttccaacatagagaggactctttgtatttttttgagacgaggtcttgccatgttgcccaggctggagtgcaatgcaccatcatggctcgctgcaacctccaaatcctgggctcaagcaatcctcccacatcagcatcccacccaagtagccaggactacaggcacgcaccaccacaccctgctaatttttaaatttttttgtagagataggggtctcactacattgccaggctggtcttgaactcctgggctcaagtgatttgcccgaagcgctgggtttataggtgtgagccaccacactggagagaggactcttatgtagccttcactttaaaaattaagctagcttcccttgactctcaaaaccagaattcttagcagaattttcccaagtgagaaggggccgaaatatataaaattatttcccaatcaagaatttctacttttggccaggcacagtggctcacgcctgtaatcccagcactttgggaagccgaggcaggtggatcgcctgagctcaggagtttgagaccagcctgagcaacatggtgaaaccccatctctactaaaaatataaaaaattagccaggccatcatggaggctcacacctgtggtcccagctactcagaaggctgaggtgggaggatcgcttgagcttgggagaaaaaaaaaaaaaaaagaattcctactttctcccaacgagtattccagctatgaaaatcaccattgactttaatatccatgtgaatctttgtacgcccttaagagatcagaagaatgcaaagaagtgagaagaggaggaggagcaaatgctttccagccacagcaggaggctggcactttggagggtggaggccttttgacacccagctcagcccaggggagcacagggtcaagccgagggtcagtcaccaggcaacttctctctccactgttgggtcttcctggcttcagcgcctctgcagcctcctccctccagctgcctccagctgtgctgacctctgggagagcagccagggagcacctggctgcatgtgctgtctcggacttcccaaggagtgctcagagcacttttttctcaagatgctcaggggaaaagctactcgggccttctagagaaccagactttgtcctcttaagattcaaaatggtaaaccgggcgcggtagctcatgcctgtaatcccagcactttgggaggccgaggcgggtggatcatctgaggtcgggagttcgtgatcagcttgaccaacatggggaaaccccatctctactaaaaatacaaaattagccaggcatggtggcgcatgcctgtaatcccagctactcaggaaggctgaggcaggagaatcgcttgaacccaggaggcggacggaggttgcggtgagccgagatcgcaccactgtactcccgcctgggcaacaagagcaaaacacagtctcaaaaaaaaaaaaagaaaaaaaaaagattcacaatggagaccgggcctggcggttcacgcctatcctagcattttgggtgggagaccaagatgggaggactgcttgaacccaggagttcaagaccagccttggcaacatagcaagatcctgtctctgttaaacaaaacaaaacaaaacaaaaaacagcctaggcaacatggggagaccctgtctctacaaacaataaaaaataaaacattagcggccgggtgcggtggctcacatctgtaatcccagcactttgggaggctgaggcaggtggatcatgaggtcaggagatcaagactatcctgggtagcatggtgaaaacctgtatctattaaaaatacaaaaaattagctgggcgtagtggtgcatgcctgtaatctgagctactcaggaggctgaggcagcagaattgcttgaacccaggaggcggaggttgcggtgagccgagatggtgccactgcactccagcctgggcaacaagagtgaaactcagtctcaaaaaaaaaaaaaaaagattcacagtggagaccgggcctggtggttcatgcctgtaatcctagcactttggaaaaccaagatgggaggactgcttgagcccaggagttcaagaccagcctgggcaacatagcaagaccctgtctctgtttaaaaaaaaaaacaaaacagcctaggcaacatagggagaccccctctctacaaacaataaaaaataaaaaattagcggctgggcacagtggctcacgcctgtaatcccagcactttgggaggccaaggcgggcggatcatgaggtcagatcgagaccatcctggctaacacagtgaaatcccgtctctactaaaaatacaaaaaattagctgggcgtggtggtgggcgcctgtggtcccagctgctctggaggctgaggcaggagaatggcgtgaacccaggaggcggagcttgcagcgaggcgagatcatgccactgcactacagcctgggccacagagcgagactccgtctcaaaaaaaaaaaaaaaaaaaaaaaaagccagggctgggcatggtgtctcatgcctgtaatcctagcactttgtgaggtcaaggtgggtgggtcacttgacatcaggggttcgagaccagcctggccaacatggtgaaagcccatctctactaaaaatacaaaaattagccaggcatgttggtgcatgcctctaatcccagccactcgggaggctgaggcaggagaatcacttgaacctgggaggcagaggttacagtgagccgagatcatgccactgctctccagtctgggtgacagagtgagactccttctaaaaaataaattaaaaatgaaagtgataaattggcagctggcatcagggagaggccagttcctgatgggtcacacctgtttcattaaagtgttaattgaatgcaggcaccagggagaagcaatttccccggccatgtgcattaagagacaatggcagagtatgaccttctgggacggaagaaatcttcagatgggcatgcgtacagtttcctaaacacactgcgtgtgctcatctcccaagggtaaggaggacactgtgcatgtaggcagcccaccctaggggaagaatcttgggaaaggggtcagtctataaagtcctagaatcaaggttaaacaccgcacttgacctttatgtgcctgtttaggtctcttccaagaatactttctttcctgttgtaaagcttttttaaataaactttcactcctcctccaaaacttgcctcggtctctttttctgccttatgcccctcagttgaattctttttttttttgagacggagtcttgctctgtcgcccaggctggagtgcagtggcgcgatctcggctcactgcaagctccgcctcctgggttcctgccattctcctgcctcagtctctcatgtagctgggacaacaggcacccaccaccatgcccggctaatttttgtatttttagtaaagacgaggtttcaccgtgttagccaggatggtctcgatctcctgacctcgtggtctgcccgccttggcctcccaaagtgctgggattacaggcgtgagccaccatgcccggccagttgaattcttttttctgaggaggcaagaattgaggttgctgcagacccatacggattcgctgccactaactcagacaccttccactgctaacactgactttgttattgtgtttatttggaggttaagtatggtttaaggagatgtgtgtaggtaccaggttgacaaggggtggacttgtgatggttaattctatatgtcaacttgtctgggccactggatgcacacatatctggttacacattatttctgggcatgtgtgtgagggtgttttcagaagtaattagcatttaaattggtggtgcaagcagccatgcctatacttctggggtagcttccctatagcttgcaggagccacagcaggcaataagagccccatcctccaaatactggggatctgtgttccgattgatgatggctgcttcagattgtggaagtgcagacgaagaggcaggcagccactcttgccatctccactaccatgtttgcaacatccctcctcaacactcaccccctccctagagacataccttccagaggtttttatggatcagcaccttttcctgcctgcatttttctttttcccttcttggaagccacttatgtaggactaggacattcaaaagcaaccataaaccaggcacagtggctcacgcctgtaatctcaacactttgggaggctaaggcaggaggatttcttgagcccaggagtttgagaccagcctgggcaacacagcgagacaaaaaatttaaaaattagccaggcatggtggtgtgtgtctgtaatcccagttaccagggaggctgaagcagaaggatggcttgagcccaggagttgcaggctgcaagtgggctataattgtgccacttcactccagcctgggtgactttctttccactcaggatatcctccttcccatcccttataacattgctgccattcattccagctatccataagctataattactgaatacatgttgatataattattttgaataacctgccatctgttcaactaaaaataagaacaatacaagattctggccaggtgcagtggctcatgcctgtaattccagcactttgggaggccgaggcaggcagatcgcctgaggttaggagttcaagaccagcctgaccaacgtggagtaacccccgactctaataaaaatacaaaattagctggacgtggtggcacatgcctgtaatcccagctactcaggaggctgaggcaggagaatcgcctgaacccagtaggcggatgttgtggtgagccaagatcgtgccattgcactccagcctgggcaacaagagtgaaactccgttccccacccccaccaaaaaaaagattctattttatcttcatttatttcttatctaatgcacttccttttttttttttttagatccaaatttcctataccattttaccccatttttgagacagggtctctctctgttacccaggccagagtgcagtagtacaatcacagctcactgcagccttggcctcctgagtagcagggactgcagatgtgcaccaccatgctggcaatttttttaattttttgtagagacagggtctggctatattgcccaggctggtctccaactcctgggctcaaacgatccttctactttggcctctcaaagtgctgggattacaggcatgagccatgcacctgacctttctttctttcttttttgagacagagtctccttctgtcacccaggctggagtgcagtggcatgatctcggctcactacatcctccacctcccaggttcaagcaattctcctgcctcatccttctgtgtagttgggattacaggcatgcgccaccacacccagctaatttttgtattttgagtagagacggggtttctccatgttggccaggctggtctccaactcctaacctcaggtgatccacccaacttggcctcccaaagtgctgggattataggcatgagccactgctgccagccctgatctttcattctgttgtgtttttgacttcttatattttctttttgttttttgagacggagtcttactgcccaggctggagtgcagtggcataatctcagcttactgcaacctccacctcccaggttcaagcaattctcctgcctcagcctcctgagtagctgggattacaggtgcatgacaccacatccagctaatttttttatttttagtagagatgggttatcaccatgttgcccaggctggtcttgaactgctgacctcaagtgatccacccacctcagcctcccaaagtgttgggattacagtcatgagtcactacctggctgacttctcacatattctccttctttctttctttttctttattttctctttctctttctttctttcttttctttctttctttctttcctttctttcctctccttgtttcctttcttttcttttcttttttttggtggtgtctcactctgtcacccagatttgagggcagtggcacaatctcagctcactgcaacctccacctcctgggtccaagcagtcctcccacctcagcctcctgaatagctggaattacaggttcatgccaccacacctggctaatttttgtattttttagtagagatggggttttgccatctggtctcgaactgggctggtcttcgaactcctgacttcaagtgatccgctgcctcagcctcccaaagtgctgggattacaggcataagccactgtgcccggccttcacatattctttagattctttctcagagtgtctatccctgtttccattttctgtctgtaatctcatgttgtccacttttccattagagcccttagcatattaatcatagttgtattccatttcttggtctgataattccgacatctctgccatatttgagtctggctctgatgcttgctgtctcttcaaactgcattttttggtttttattatgccttgaaattttttgtggggagctggacatgctgtacggggtacgtgataaatgggctttctgtgtgaagtttttgtttgtttgtttttgttttttgagacagagtctcactttgtcacccaggctggagtgcggtgccgcaatctccgctcactgcaagctctacctcctggcttcaagcaattctctgcctcaccctcccaagtagctgggattacaggtgcctgccaccacgcccgctaatttttgtatttttagtagatggggtttcaccatcttggccagggtggtcttgaactcctgacctcgtgatccacccgcctcggcctcccaaagtgctgggattacaggggtgagccacagcgcccggcctgtgtgaggttttattttgctctggttaggggttgggccatgtgtgctgtttgttctaactgtaagtgtcagaggcataaacttcctctggtgtcttagtttttgtctccctgttgtctttagggtttcctagacatttctcaaataagttctgagatgggctgttctttcacttgtatcccctgttattatacaggagccctattgatgtggcaggaagatgtggggaagaggagctagaacaggctgggattgggtatgttcccttcctcccttgggttgggtatgttggcatctggtaaaatcacagttggcctggctctggcgaacatttttttttttttttttttttagggcaggccttgtaaagaaagacatatttctttttttttttttcttttaggcagcatctcactgtgtcacctagcctggagttcagtggtgccatcatagctcactgcggccttgacctccgggattccagcagtcctcctgcctcagcctcccaagtagctgggactacaggagcacagcaccaagcccggctaattttttttcttttactttttatagagacagggtctcactatgttgcccaggctgtagagaatgcctgaatgcgttttattattttattttttcttttttgagacagagtctccctctgtcacccaggctggagtgcagtggcgcgatctctgctcactgcaacctccgcctcccgggttcaagccattctccggcctcagcctcccaagtagcttggactacaggcacgtgccaccacgttcagctaatttttgtatttttagtagagaaggggtttcaccatgttagccaggctggtctcaaactcctgacctcaagtaatccgcccacctgggcctcccaaagtgctgggattataggcatgagccaccgtgcccagccctgggtgccttttaaatcagactgtactcacccaggaagagccagccacaggccctgccccagctgcccaccctgctcctcagccacgcccctttccattgtgacgggcagcatggccactgagccagggtgcagtggcagcggctgtgtagttgggggtggcgacatgagccgtgcgagctagcctcccagctggtccccgggatctcaggttacgtcgcaccccccgcagtgccgccggtctgtgggtgtccagatcgaccagcagaggcagatcctggacttggacctgggcctgcagttcctacagcagcagtccttggagttgctggccaagctccactagaagatcgagcatctgaagtgggagaacaagggtgagcccagccacagggccctaggcctgccctgcctccccaagcgcctgaacacggcggcggcccgcagagcagaaacgcagcacatgaactccagcacctgcctgggctcagggaggacacagggcagcaagcccacgctaggtcctgccatgctgagctcttcccctgccccaggacggagacccgcctaggcccggggcggtgccctccttgtctgcctgtcccgccgggggcagcatcatttcaaacgctgaccctgccagccctcccctctccaggcagggtcaggtacacatctgttaaaaacttcgtagaaggaaaacatgcccagtgccggtgcacaactgagtgaattttctccaactaaacatgccggatcaggagcaggcatgcccccggcttcgcctgtgcccacactgtcctcgggctgggccttcctaactgcacccttagcagctcctcacccccactgcccaccagagcagaaagagggcccgccaggatgtggctccgctcctccctccctgcttcagcagaggctccagcgagggcaccagtgcctgcagcctcatctccctccccgctccctggtgctgccttacctaggtgctaagtattccatcaccaggcatctgttatgtcaggatcccccttccccatgtcttcttgagcctctccccagtccctgatgcccacaggatcatgacactgaccatgctcatccatggccaggggctcccagagttcacccctgtacccctggggcccaggtcctgcctggcaccatgggcgtcttgtagtcagatgggaggatgaggctgatgtgctgggtgggctctgcctagggaacaggcagggtcattcctgccctcacatgcccacagcaaaggtgtggtggaaagcgggacctgtggggcagggcccagtcagccagtggcgagccaggactctcggggttcagcagggggtagtggacagcccaagctgcttctcttagaatggctgtggcttcacaagtgatgagaagagcatgcgcttgatttcagatccccattacaagctcataatgaatgagtcacaggagaaaggtgagacttgggccctttcgtgcctgatgggaagctcctgccaccccggggagcccctccagactgtccttgcccacctggctgcactggcctctgtatgccaacccagtgaggacaggttctgagggacctggacagatgctgctgcccctagccatggctggacgatgttatacagccaagcacagcacgtgctgctctcaggaagcccaagggctgtggtcagtgcagtggtgatggtgggcacagggtgcttcccagaccttccctcctccaagcagagctcctgaaatgggaggggactctgggacagcccctaccctgctgggtctttgcctcagattgctgctgtggctgggcctaggatctccagccttgtggctctgattcctgatacgctgggagaagggctccgggcacaccccatccagggattccttcctgccatctcagcaacaactgtggggatgggggtggggggagtaaccagagtcctgcttccctgccacttgtccaaggcacttccccatcccaatggtggcccccacccagcccaggattctggttgagttcttgagctcactctattacctttggggccggggctgacatcaggaggacatctgactggtgaatgggaccagcctgggaacatcccagctggggcattgtccagggctctcccttctagggagacacagagaatgggattgagtgaaggcccttccctagctgcggtggcaactccagtgagctgttctgggcaaagtgtggccctgcagtgctggggaccctgacaggacacgggaagaggccatgctctccctccggacctgctgctccatgggtcccaagccctcccgctttctggatggcccctcaggaaacaacctttccggggcctctgctcccttgggcgcgcggtgggtctggggctgcctcagtggagtgtgggtagagcagggaggacacaggcctgcaggcagacggagggcttctccctcaggcaggtgtgcgggtggcaacttccagcctgtcaactccacctcgaattaaatggtgtcaggtgagcaggctggtgtcctccatgtgctcacaggggcaagtgccccacagggaccccagcctgggtggtcactagaggtgctgaccagggagctgaaagtcctctgctgggccaacctcaaggatttgggggtgaacgggcagctgaagggagccctgtaagctgaaaccaccaggaggggcctagggtggggtgggcaggactgggggccagtcacaggggctgtcaacgcagggcagcaaggcctcatggcaggcaccccaagccagcacagcaagcggtcagaaggggcctccttgggtggccttctagggggaaggacgtacactggctgcctggcagaggccctgcttggcccacgtccccctccacaagcagacaggatacaggagggatggcactgcccacggagccctgggctcatggcatcttctgcagagtgagcggggagtggctcgagaccaggcatcttccttggccccaaccctggcccctattgttcctgtgatgagcccaggcgtgccatgggcgttgtccttgcagaggaaacccatgcaggcttagtcccaggcctcgcatgcagttttattttacccaaaacagagccagcttccactatattgactgttctagaatgttcacaggcaccacccatgggcttcatcctcagaacctcatttattcctcctagaaccctccaaggcaggcttccctttacagaggaggcaactgaggcaggggcttcttgggcacacacagctgatcctgaaagacttgggcagcggctgttggtgcctgcagtgactggccctgtcgggtctgacctgcagccaactctcaaggaaaggacaggccccagccggttccttcaagaaacaagactctaaagcactggggtactctaaggtaccccagaaggcagaccttgaggaggagccactgcttcacaacagcaagctggacaaagttcctggggtgcaagggcagtccaagtaaggtttgcctgcaccctaagggccccaggaccacatttactaggctcccacactgcagtcagcaaactgctgtgtcccttgctctaggatcctgtctccagggctcatgaaagcagacaatggccacgctctgtccacactctgtccattgggtgggcgctgtcttcctcccctcccctggagtcctgcagattacctgtgctgacctgagcccacaagagggggcagcaacagcccctaaaccactttctcagagaaaagaaaacaaagtaatctttttaccaagaaaagtgagttgtgttcctgggcctgattagaatggagctggtcagtgcctgctgcccctggccacagcctgcctttggaggggactaggagagcaggaccaggctctggtactccccgagttgccgggctgccctgagacattgcagagtgcacattttgagcggtgcaaccagcaggacaggctcctgcatctctgcacgtcccctgagaccagccctgaagcaagaagccccactgggtatagggtcctgactaagggcagcctggcagctagctggtcacccactgaagcacatctgaccctcagggcaccttcagaggggaggaagggacagaccccagtccgagacccccatctggcacccagagcactctggtcagtgggagaagggagccaggccctgttccccacactggcctgggcactgcctgggggaagtatgctgcctggatgctcagacccacctgggcaggtcatttctggctactgtaatgactttcagagacagggaagcagaggcctctaacgccagggctttctgttgggtgggcagccagcacagggacaggcagatgatggcactccccgatgatcctgtccccacacctgcgaaagcccaccacacttcagcagtgtaagtggtcatccaccagctgtggaataccaaccttctgcaggcccaagaggtgaggccctgggtggtggggatggccctgggcagcctggtgccaccgcaggccccaccacacccctgcccctgcctttcagctgcagcacctcaagtccctcctggaagggaggcagaggccccaggcagccccaaggctgacagcatcctgacaggacagcgagcccagattcatggagaaggggacacagtgatgaacaactgacaaacacaggaataataaatttattataatcacagatggtggggtagtgcacataaaaaggggggacctcttctcaccagagggtgctggccggtgcccagagtggcaggcaacatagggaggcgctccctgcatggcccggcccgctgccaggcccgctgtctctgggtgctcagtgtgtggtgctctgaggacacgggtcctgagggccttgctcttcatccttcacagtggggacacggccctcatgccagcggcacaggggtgccggcagcaggatccctgacgcccctgctccctgggtgccccacggtgctcagcaggaatgccgtgagggctgaggcccagctggtggcggggagccagcagcacctatgggccagccctccctccaaaaggcagcctgtgccctggacttgcaggcttcctcggggggtgctccacctgcccaaagcagcatagcctgaacccaaaactgtgaccagagaatcccatgtgtgttttaagggtttcctatgtcctctgtgttctataggaacgagtaggggtgcgtctagcacacacgagacgctctaacaacaccctgagtgcaccctcacgctgctgagatggacctggaccgtggacaggccacggtgagagcagcctgaggatcgcatctggctcctgggaggaagtcacatggagggccttctctaagaagtcggccaacgccccccaagcaacccgctccactgcgcctatcccagttctgtacaggtgtgggatttcgtttggcaggtccccaaggcagaagataaaagcaggaaagctaacctaaccccaggctctctaaggaagccaacacctagaagtgtctgacaggaggcgtgtgtccttggccccgatgaggctgcgggccatccctgcagtcttggctaggcggctgagaggcaggcctggtggacgctctgggcccaggtgttgagcaaggcggtgaccgagtgcttgtccgggagctgcagcagcctggaggtcatgcagcggtgcaccgactggaggaaggggttggcgtctgcaacagagcagtgggcgtgaacctaaggcggccggcgctgcgctcgctcctggcacacccggcagtgctctgggaaggggtagccccaggcgcgggccgaagcaccaggaggtgatgtgtcctgcacgctgcccggcctttgggctctcctcccagagcctcatcgtcagtgagaaccaaatctgaacaggatctagggctctgcctctaacaaccttggggacccagcctggctctactgtgtgccagctctgctgtgtgccagctctgctgtgtgccagctctgggctcagagactgccccctgccaccgtggttctctctggagccacagcacccagattgggccctgtgtgcccaagctaccagtggaacctggcagccctgccaaggtagtggcctctgggaagctagtggcctctgggaagagcggggactgtccctgagccatgggcttactcacccctcacccactgaacacaaccaccctggacagctgacgtgacacaagttgaaggggcgaagggacacagtgggagcagagacccttttctctcaggcgaccactggaaaacccgctgctgtctgtgcaggaggagccagaagaggggagggaggggcctgagctggggaggggcaggagcacacagaggctgtccctgctgcagtggaagcctggttttccacaatgacccctgcttgccctgggtccccagacagctcctctgggtctacctaccgtactgccactgccggtctatccacagcgggctttgggcaggatagtcagcgggcacactgagctccagtggtggcacacttgggaggtccttgtcatctgcaacacagaaggctctatctgtgacctggacaagccccggcctgccctgcctcacagccctgctctggaacaggactccacacccagggaggttctggtgaagcttgtggcaaagcctggaggaggtctctctgactctcagatttccaaacgtgaagcctggagtgctctgcattgatgggtgcccagaggtcctgcctaccacctccctagggcccaggcaagcaaagccacatctgtgttggggaggtgagagtgtgcgggctctggcagtggggactgaggcatggccaggctgtctggagcccggtgtgtgtgaggatagagcagacagcctggcggggcgtgaacacagggtgggttctgggcgctgtgccatctggcttggatggcagagtcctggggctgcggtcagggcctgctttcccacaccagtcccggccctctggacactcacccagcttgcagatcaggtggacagtgccattgttgctgcagtgagaagggtccaggtttaccaggaacttggggtccagcctggccacctcaccctggagcacactggggatgctctgccgctcatcatcctcaagcctgcgcttccgggtgcacaccactggggccctggggaggcggcatggtgaccacacctggcacacgcggcccagggctggccgccctccgcaaagcccagcccagctggacatacgtgatgggtgggccgtgaatggcggtcatggctggaacgaatgtgcggtacagggaatggttgaagacaggtgagcggatgttggccaggacggcatccaggagcggctggcataggtactgctgtttggtcggtggcaccgggggcggtgggggagtgggctggagacaggatgggcacggtcagcagcccgggacccgagggttccccatttagggggccttcacaccccaggcccatggtcactcacagtcagattcccgaggcctctctcacagcctccacccttgtgcagacaatgttggctgatcctgggaataatcccccacccccacagcctatcctccctacagtccctgcctcctctgaaatgggtgaaggaggcacccacgggggccgtagacagagggtgacttctcccatgttcccacccagcacagcagacctggccaggaagcctcgtgggcagggtccaaggtcaggcccggcccccgcccagatgccctgaccttgaaggccctctcagcagcactcccaggagctcttaggagagccctggttcccctaggggtgtctggcatcccactcaccaccgccatgtcattcttgagtttctccagggcgatctcacacttttgcaaggtcttcaggggacacctgcagagagagaggacttgggctgaaagagtggaagacatggcagttctcaggctcaggatcccaactactgccactgggcctcagccatcagaaacctctgcaggagctcctaccagttgaccagctgttcccagacccagagttgaaggcaggcagccctcaaccccaggagctgcttgtccctggttggcagagtgaggtgatgggtcaagagaagggacagtggccaggcccctgatcaggctgtgaatgcctcattgtcatgtaggccagtccctgccccactcatccctataaccctaacaaaggatcaacccatgaagacctggaggaccacccaatagtgactggcattctatccagacaagcagaacagagagacccttctagacaggggttgggggatagcctgagttgaggtgaaagggaggtatatgccaatgcccatgcagtttggaggtactgcccgagctctgatcctcacagcagcctgtggccagcagccctgccttccacctgcttctcaccagcgccaccttgtttcattttcatgacaacacacgtgggctacaaatggggtaactgagatgcagtcgcctgcccatggtcaccagcaagtcaggggcagaactccaggtcaggctcaggcccatctgggccagctgatggtcaggccactgcaagctgggcccctggctgctgactggatgaggtctggctgtgatggcccagcatgagggccacagcagcagccaggaatagggcaaaggctgggcatgggccaagatgaagcctgggcttgaagccccagcacacaccagagtggagccttggaggcctctggccagggtccaaagagctgcctggtgcctttgttaaacccacatcatcaccaagtgcccatccatggctgggctatctgtgcccttgtggaccctccgtgggctgtgggcaaagctcaccgcttcgaggggtctgtcagaatgtccagaaggctcttcatcttactcaggtccttttttctgtctgggacagaagagggtacacactaagacacaagcctggtggtgtccccagggtgcaggcccctgccctggctgcagcctaccttcgttcttgtcgatcttgttgatcatgcggcgcaggggctcgatgtacttcgacagctgcttcagcttgtccaggtactgctgctcctcagcctggctggagccagctgggctcatgacagagctggggttcactgcaggacacaggcgggtgaggccacagccctcgaccctcgggtggggaacttgagctctgagggccccagagctcgcacacccagtatgagctgaggcctcataaaggtgaggagtgaccttagcacctcaggcccaacttaccaggtgtgtttaaaggtccaggtgaggggacactgaagttctgtggggtccgcgccgtcactgggctctgggagggctgcggtgaggggctgggcaggaagctactgggagatggggcagggccagagctgcagccaagtgagagaaacatgtgagccggggtccaggcagggccagcctcgagggccaggtggggaggggcaccccaggccaggcctacctgacgttggagttgggctgtgagctgggctggccgggctgcggggacggctgggggggagggggcatcgactgcggggtctgcacctgctggcccggtgacggcgaggacagcatggggaggctgctctggctgacctggaagtggaggggctcagccggcgcgctgccacacgcccgcccgcctgcctccacaccacctgcccaccgcacgcataggcccatcctcccgcacagcctcaccacacacctgtgtcttcatccaaatgccacctggacatacacacaggcacactcccccagcctggcacacagcatgaggtgaccaaggggctggcggggggggcccaggcagggcagcccttgctccttggccagggacccacaggggcacaggctttgagggctgtgtcgtgggagtgtgaggaaaagggcagtctgggaggcaatgcccttggctggcactagcctggccttccctgacacgcctgcctgtcctgtgacatgctcctctgtgggtcggtgaggaccctgctctgctgaccagtgggaccgtcttcccacatgcttccacaagcccccgcagcccccaggctgactgcaccaaggacaagcctggtggctacagccatctgttgtggttaacacatgctgctgcagggctggtcccaggctgtcccacctggacctgcttaattggagtgaggtggcccagggagccacacacacacccatggtggcacttgcatcggcccacaccagcgcccctgggagaggcgagctactcagtgtcagacacctgggcccagagcctggttctgccatgcaggtgtgcacctgagtcctctgaggccctgtgtgtatgcaaagcaaggctgttgctctgctccccaggccttgctggccacgacacaaataagatcaatcaccccagtgtctgcaccagggacaccactgtcttcatccgtaaactctagggatgaaaccacaccacccaggcatcagggataagcatatgtaaaacacccacaccttcctggggtggagcacagatggctgctttgatggggagaacagctgcctgccagccctgggcgtctggcctcccctagagggactctcagcaaagagggatgccttgtcacactgggggaaccctgaaggccctgctacatttcccacaccctagtcaaccccctgcatgccaagcatcccctcacagtctgcctaggagccaggcccctggaccatccatttctgtagaccaactcagtgcttctcctggggcactctggccatgaacgcctgtctcgggccacggctcacaccaccccccaagcacttccaccacagtgctgtgagtactgggataggacagctgctttctaagctccttaaattggggaccaggcccagagcccacaaacagaatgctgccctcctcaccaccccaccaggcagcagagggcagggtggcactgccctttcagcaccacgtggaccaagctcctggagcgaaatgctctttctgtcctgcctgttccatgggctgtgcctgacagtgctgcaagggatgctgggtgcaggccgttcctgaaccacgtgtgctgggagaccagggggtggggggctaaggcacagagcgtgaccacaacagggtacttccagcacagctgggtcagaggtccctatccaaagccactggcccagtgggacatcaaccgatggaatggactgttcccactgctttgtggtcaagacacctctgcctgggagaggagggacagagtgcaggagccccagcctcggcctgccgggcctcatcactctacctaatggagcaaaatggctcgcggtgattctcgcaaaggttagcaaggtcagaaacggggactgatgtgacttcatttgctaaatgctgagttgaacaagtacagagatttctcccaccaaagtcctgtgcattcacggtgctggggtgcacagagccctagctgaagaggagtaagggcatgtcccagacaccggaacacatgttctagacttatccaggtgtcaacaaaatcccaaggccagaaaattccatacagagaaccacagacggcaccgaggagtgggaagcaaagactctgggccccatgctcagcccaactctgccttttctgacccatgcttgacttgctgctactctctacctgcaccccagaaagctgtctcacaagctcacctctcttcctgcttgaaggtcagggcccctccccttgcctctacctgactgcctcttccagagaggcgcctgtgcctgagcagctgtcccttctagaagatggtcagctcttttctgtggcctaaagctcagcgcttctctgaggagcaaggcagctgcaggctgggcagaggctgccaagcagagaaggccaccacacagccctcattgccactcaagagttctcatctgctctcgaacctcaggaagcccggcacccactttggccctgaagcggcaatctcaccagccacgcccgtggggcctccaagcacccacccagaacttaggtctatctcagttcttcagctgccccaggtcagggcagctggtggccagcagagcctacaggatgggagacagggagatttctagtgggaagaaaaacaaacgaggggcaccctttcatttccaagagcacaagagcagaaagccaggccctgtgcccaggtgtcagtggtggacagtccaagtccagcacctgggatgagaagcagccccccaaagactcatctgaagacacaactggcattagggaggcagccagagaggtcgggcgccggtgtgtcacagctagcaaaggccccaggacaagaatgtcacacatcctagggaaggagtttctgagtgcacaccacctgtcacctgtgtgtcacaggttgggaacagggagctcagagggaagtgacttgctcaaggtcatcctagtgatgaagggagctcaggcacgctaaacatcaacaccccagcaacaccaccaccccagcaacaatggcctgaactgcatttctgggaaagggacccacacagcagcctggagctgaaggcaggtggacaccgagtgggccagagaggaggtgggagggcaaaaaggctggtccagggagctccatctcacagaggaaccctcaggcaaggctggcggcactgcgcgatccccacccccgcccccacatactgggaaccgttccttgctcctggctccggcactcagtgtgtcccctggaggcactccccagggtgcagtggaacacgggtctcaccctggcagctggcagccagcagagcccagaggatgggaggcagggagatttctagtgggaagaaaaacaaatgaagggcacccattcatttccaagagcacgagagcaggaagccaggccctgtgcccaggtgtcagtggtgggcagtccaagtccagcacctgggatgagaagcagcccctgcaaagactcatccaaagacaggctctaggctctggggaggcagccagagaggcgagaaagaaacctcccagtccttggtctcatgtcaggtctgggattggagcagggaacagggaggcaacagtgcctctctagtcaaaggacaagcccctagtgagaaagacactgcctgcttacatctgccaagggaggattgtggcatgggccatgccaccccctgggcccccgtgctgagcactgtgtccagaatgcacccagcacagaatcctgcttgacctggtagcctgagtccgtgaggcatgcccaccgtaacaggaagatgcagccatgagccgtcaagacagagggagggagcctgggccctgccctctggagaagagcccatggggcacgtacattccctctttcagctccacctgttttcttggacctaatttgttgccacaaggaaagagcaagagcaaatgggcagtgtagtctccagactgtgtcctgctgactgctgagggcaagtggctggagggacagtggccacagagtggccatctggacacactggagacagcaggttctggcccctgagagctcagatgggacacagtggggcaattcctggtgagatcaacagatacgttcctgagataagctctctttttctcggaagggactggattgaaagatactgacacaaaagcagaggcacacctctggagccacctggtgtggtcaggtgaatgcccttggtacacggggcccagcatgcctcacgtccccaaggctggcccacagccaggtgtgggagactgtaccaagagcctggtactgcagccggacgtagagggctgagctggggagggccctctgcggggaaggccaggaccagagagggctgcagagcagctgcctgggcagtagggaggcttccactccagggtgtccctctattcgcttttctccctccctcaactccttccagtttcctttcttgcagctaacaagcatgaacaaacctgctttaaaaacacagtacaaggctgggcgcagtggttcacacctgtaatctcaacagttttggagaccgaggcgggcggatcacctaaggttaggagttcaagaccagcctggccaacatggtgaaaccccatctctactaaaaatacaaaaattagccagatgtggtggcaggcgcctgtagtcccagctactcgagaggctgaggcaggagaatcgcttgaagctgggaggtggaggttgcagtgagccaggagtgcgccattgcactcctgcctgggggacaagtgcgagactctgtctcaaaaaaagaaaaacaaacagtaacaatgacaacaaaataacagaacaaaaccagaaccttgccccagttctgtgccttccttcctctttccataaatcctgtggcttttgtctactgccgggacgaggaatactttctaaatgctgccgcgtttgtcctcagtgaacaaccccaaaggttcaggggtgtgcctctcactgccagtgcgaatgggcggggcctggtgattaaatctgtgtgcagttagccagcatcttcccatgagagcgctctcaccccacacagtgcaatgaggacaaaccagaattctccatggcatttattccaaggcaataactttttcagcttcatcatatatttctctatccttcctctgctccaccttacctccttgcctttgggggttggaagcttctagagagagagagacctattagctggcataactcagggcagacttaatctaagggccagggaaggctggggagggaaagactgagtgggtttgggaactggtgggaaggagggagggagggagggaggggctgcctgtgagaagtctaggtggaaacaccagcagctgggtgtggggagtggccagcccacaacagagtatgggcaagccaaagcccaggacagagcctggtcttgtgggggcatggagggagcccacccaggagtgcccagtaaacaagaaggagaagccaggtcatcagcccagcaggaaggggagtgaggagtttccagaagaatcctgctgagaggccaaggcataagggtttcacttgagccctcgatcctgacttggtggctccctgggggcactcttagtctgtaaaaggggctaaatgctcaaactatgacctgctacaacaagaaacagtgaggctctgtacacaaagagcttagctcaaggcctggcacatatcgcacactgaaaacattggggactttttgtgtttataaaaatcagtcctacatgctgctactaaagtcattcctccacatacagcaacccaacctgattctgtgaacccagtggatactgtgccagaggctatgggaaaggaggagaagcagttttagcagacaagagtgcagaacccaaaggggtctagtcaaggagacaccagcagcatgtgagcaggtcgtggaactcacagcctccaggccatggggaactgcaccctggcttctgcccacactggcctcctttccaccacagccacacaacctaattcctgacccccaacttccgctcctctggagagctctttcaccaaagcctttctaccagcagattccaggcacttcctcccgctgtaattcaacaactactaaaaaggaagtccctgccaaagaaactaagttccagtcagtaactatgtgaatggcacatctggggtaacccagggggttagtatgcagggaaggcaaaagctaaacatgccccagtgggggcccaggccactttcttggcagtgtgtggtgtgtggcaccaggcttggggccacatggaccaagggccatcctggctcagcctccacttcttcctgtgtagaacagagctgcagagacgccactgcacaagccagggtggtggcagtgcctgcacctgggcgttcagggatggacagggaccactgtctgctaggattatagaggcatttcccctaaaacagaaactgaattgtaaagttcttttggcaaatttgatgttttcacgacaaacccactaaaatggaaagcctgtatgatgagagaacttcagcataattttattctcagaatcttagcatagtgcctggcacacagaatgcatgtggtaactatttgttaaaaaaatgactatgccatggagtaattccaaatttcatacaataaaagaagccgggaattcctgtctctgaaaagcataatgtacacagaagtctacctctacctagaaaggggatctgtgttacaaattacacactctacacatcaaactctacaacagcatggcccaataccactttggccacattggccacgttctggagtctgtgctgtccactgcagcagccactagcttccctgtgggcaaatgagggcttaaaatttatttggtgcgactgaagaactgcattttttcattttatttaattttagttgacttttaggttttttttttgtttttaaaatatatatacatttatatatatattttccattaaaaaatgtatataattaattggagatagtatgtcgctatgtgaaccaggctggtctcaaactcctggcctcaagtgatcctcccatctcggcctcctgaggtgttgagattatagccataagcccctgtgcccggcctaattttagtcaatttaaatgtaaacagccacacatgcttagtggctacactattagatagcacagctctagaaagcaaaacttttgcttagctgctgttttatttttaccatgaaaatgcgtacagtataactattttaagctgaaaagacccagatatttattcatatcctctcaacaagcacaagctgggcttggcttcatttaaaaaaaaaaaaaaagggactgtgggtttggcactctgaaagccaccataaaagaagtcaccggcgatgataatgacaggtgcgctttacaaaggcgctcagaggacgccccgagctcccagccgtgccctgggcgctgccccgtaaatacctgtgccatgggctgtctgcccaaagggatggagcttgacgggatggcggacacagcggtggtaggcgggaaccgggctcttatgtgcatcccaccttgggccaaggcttccgtgatcatctttgaggacagagggacaacagacaaggtgatcgcaacaaagaaactcagtgcctgggcaggtggagagggcacgtgtagcctctgcaagaaggagcaccagggcaaggaaagcttgggcagctcggggcagcctgggaggggaggccacccacatgttcaagcccacagcacctccaggtctgtctgggcattgggaatctagaagatttgccaagaatgctgcttccagacctttctgttctactggttgctctcctgcactggtgtcctcaacacacttctgaacacacctcgctaacagatcagaatcctatagcccacagaaccatcagagccagaccttgagggcctgagctggtgtttctggagaccaggctcctggggacagatgtcaagagtacattccaccaaagcctgtgatgagaacactcaactcccactgaaccatgagctcagttaagcctgctcacagcatccctccttctcagtggcacacctcttacagcccgaacccaaatcatcctcctctcctcctccaggcctgaggctgatggtcctggtatctatcaaggaactggttttctttcgtaataaaaatgggcaaaggtgagcaagagaagcctggggggactgcttggcaggcctccgccctgacgaggaagttcatctccacagggatgcgagtcaggaactccagcatgagccaggaccattcccctcatcaatggacacttcttgaactacaaaggcagcaggacagctgagcactgttgtgggcccgggcccgaccactcttgctctgggttctgagttgggggtagagcccgagtctcgtccctggagagcagggcctacaggcacttaggacggtaacaaactagaacaaaacacgccaggctcagaaagaaaggaggactgatccacagaaaaacaacacatctcatggtgggaggctgtgctctgggtcccaagctccaggaggtgctgccagccttcggtgcaggcagcgacaggtgccagtaacagagctccagcaggagagtggctgcagggagacccgtggcctcacacacacggcccacattcacaatcctgggcacgcacaggaggtgccagaagccggggtgacacggcatggcagacgccgaccagaagctcactcgttcctcctgcagccagagcaacagatgaaccgaccggggggagacacgaaggagcgaccccagtgggtgagagtcgatttaccaccacctgcggcacttcggaggagcccgtctgagagtgcagcagggctcaacggcactcgttccacaagggagaaaagcctggaagtaagtcagatggtatgagagaagcaaacttttttccaggaagagaaaaacaaacaaaaaaacgcaaggaatgcaaagcttaagtctaatgtactgctgactgatgttcttataactgagaactgataaggaaagcccaatttctttcaacccaaacgcaccagttatgtttactggatcagatgagccaggcagctatcaacatttcactacttcccaacacacatctacccagagaggaatccaaaaaacctctcccccacccccaggtctgactctccctactgcagtcactgtgcagaagggtccagcaaaaagagagagggtcctccagggtggccaaggcttcagtacagtagctgtgaatcagcaatgccacatacatgtccacaatgggagtctgtcttggataattctttgtgacttgtaaattagagtttggttttcacatactaaaagaatagaacgttaaatgacaaaggtatagggactgtttgaaaatgagatgcatggccaggcacagtggcttacgcctgtaattccagcactttgggaggccaaagcgggcacatctcttaaggcgaggagttcaagaccagcctggccaacatgacaaaaccccgtctctactaaaaatacaaaattagccaggcatggtggcacatgcctgtaatcccaggtacttgggaggctgaggcaggagaatcccttgaacccaggaggtggagactgcagtgagctgagactgtaccattgcactccagcctgggtgacagagcaagagactctgtctttaaaaaaaaaaaaaaaaagaaaatgagatgcattctgtcctgtttcttgcttttttaaagagacaagagttttgctctgtctcccaggctagagtgtaatgctgtcatcacagctcactgcagcctcaaacccctgggcttgcacgatcctcccaactcggcctcccgagtagcagggactgcagacacgcaccactccgcccagctaactttttatttttatttttttgtagagacagggtctcgctgtgttgcccaggatagttttgaactcctggtctcaagtgatcctctcaccttggcttcccaaaacgttgggattacaggcatgagccactgtgcctgcatgtcttggttttataggggagaaaaagaagtctgctgtgtcctgctaaatccccttgtgggtgacattgcccttctcagctacataaataacactggaaagagaaccaggtgtgcacagcacaaggctgagcaatttttctagaatactcagtcccaggctaccctttaccacatccaacaccacagtactgcaagggcctgacagggcgcctctcttcggctctaagatgggcttgagagacagggcatggagggctgcctgcatgggggcccccaatcccagaatttcattcatgaactcaagaggcctgtttccgcagcacgcggcagctcatacatacaaagctgcaacacgtggtcaccacgtcctgatgtccactgtgtgaacaacacaaggggagctccaatctgcatctctgacctcctggttagagggtggctgatcagatctgaaggccctcaaagtgaaccattcactcacctccatcagctccaggaacaatctaagacatcaagatatgtgtcactggtaatagcaaaaaatcggaaattattacaaggtccaagaacaagatggtaactgaggatggcaagagacattcacagaggggtatgacaagagttccttcgtgccgaccagggctttctaattaaaggagaacatttcatcccctattgatgtggaagatgctgcacaaaaaaccccaggatagcatgaccttgactatgggaaacaaccagaaaggacaccagaccttctctctcatggaatggttctcttacttctgttcctctccactttctgggttctacagttaccacacatacttttaaagtttttagatcagagtaccgtagcctcagctggtcactgtgccaattcaagtttcaaaagaagatcatgaatccagatggcccctcagagggcttgctgtgcccaaccctccccatcccccagcagggggcgctgctattggtggaacaaggcagtgagggtgcccaattagcccccaagaaactgcactgcttgcaacaaggcaagaccaagctctgagagaaaaccagcagaatgcgggttacagaatttcaaggtgccacatctggactgagaagcacctcatagatacgccctacccactgctggactttgagaaactacaaggctcctctgccactagcacttgggaatcccctgcatggcagcacatggtgccacagggcaggtgggcaatgatccttaaaacatcaaactcactcagcaacgaaccacagtggtaaccactctccatcctccttcctgtgccagtcgggcggggacctccacctgaaacaaggggtggagaaaccgacaggaagaccagtggcccaaggacaggctcagcatgggccatgagcacacacagctggcatcctgcttctggacggtgatgggatgccagtgagactgcagagtggacacttccttgagctagaagcctaacgaacataccagctgggcctgcaccagctgaaaacactggctgctccatggctattcactttccaaataccaagaaatggaaagaaaaggaaagttcggctgggcacagtggctcacgcctgtaatcccaacacttagggaggctgaggcaggtggatcacttgaagtcaggagcttaagaccagcctggcccatctctactaaaaatacaagaggaaaaaaaaattagctggatatagtggcgcatgcctgtagtcccagctacttgggagcaaaggcaggacaatcacttgaacctgggagacagaggttgcagtgagccaagattgcaccactgcactccagccactctagcctaggtgagagagcaagactctgtcaaaaaaaaaaaaaaaaaaaaaaaaaaaaaagaaagaaagaaagaaagaaaagaaaagagaaaaaagagaagagaagagaagttctaggctgggtgcgatggctcatgcctataatcccagcactttgggaggctgaggcgggtgaatcacttgaggtcaggagttcgaaccagcctggccaacatggtgaaaccctatctctactaaaaatacaaaaattagccaggtgtggtggtgtgcaactgtagtcccagctacttgggaggctgaggcacaagaatcgcctgaacccaggaggcagaagttgcagtgagccgagatcgcaaaactgcaatccagcctggatgacagagtcagactctgtctcaaaaaaaaaaaaaaaagacagaaagaaataaagaaaagagcagttctcactttcctgctgggcttgacctgcggtacagaagtttccagccgggcgcattggctcatgcctgtaatctcagcactttgggaggccaaggccggcagatcacgaggtcaagagatggagaccatcctggccaacatgatgaaaccatgtctctactaaaaatacaaaaattagccaggtgtgatggcacgcgcctgtagttccagctactcgggaacctgaggcaggagaatcacttgaacccaggaggcagaggttgcagtgagccaagatcgtgccactgtactccagcctggcaacagagcaagactccatctcaaaaaataaaaaaagtttccaggaagtgaggtcctgaacagaggatcgatggtccaaagaggcaaaggtagcagcttccactgggtgggcagtcactatgtgccaccactaagctgactctgaacacaccacgtccttcctctgcatgagaccaggacaagggagcccccccacgaggcctgaggacatgccgagacacacagggaggtggcagagacctccaacctcatcacacgaagtggtcagcctcccccagctgtaagtaaatgtgagttctgtggtgtgtttcatacagggctccatctaagtaagaatgtgacatggggaccctggccccaagtcatttggtgccctgccaaggtaggatgctaacctcagctgcagccaaatacctcagattccctcctcaggcagcttcccagggacttaaaagaggtagcaggcaccatgaaggacattactgagcaccccccaagcgtgagatgaagcctgccacgaggcactgtgcacccaggcgctgcgcccagcaggcctgcagaaaaccacaaggccaggtacccttaagacgacagcaaagtgcaggcgcactgccagctgtgggctgggacccagccacagtcttaccacatcaactagcacattctgactctttctaaagccaacgccccttccgagtcaggaccaacagtgtttccaccatcatgtgaaaagaggaaaaactgaagccccagactgtacgtctccccacaagaaggagaggaggggttataggaaaaggtacagaaaccctgggcctccaatcccaggacactaggaggccagacaaggccatctgcattccactaacacgtgacacacagagacacacacacattccacacatgtgacacaccagcaagctcagcaatgtgggagtggcacgcttctcaccacacagcgccggagtccctgagtgcaggcgagcaccaggatgccttctcccacgctcctgctgcatgtggctcccatctgcttccgagtgtctagaaagctgccctccaccctggtcagctctgtactcagactctcaaatggaagatgagaggtgaggagaaaactgcagccttctactctctgatacatgttcccagagtcactcagagtggcaaggaagagggataatgaaggatgcccgagcaaagctggaaacgacacgcactatgcggctggtgggtcctagacatgaccaagcacagctgcccaccccaaggactccaggggtgtcttgcagagtgcaagggggagagaagcccctgctttaccaacttagcccccagcccctaatccaaccagaaccctcactgtagcactacatgcgcaggtgaacatgcacctgctgatgactatggagccctccacccccaggccctcacctggactccgggagccaccatctgggcagcctgagctgtctgtactgctgtctgctgctgctgcacctggggctgcactgggggctgctgcaccaccatcggagctcggaccttgagggagaaagagagaatgtgatttggaaccacctgggtcagagagcagagcctagtcttcctgtggaagcttaggaaatggagcctttcttgaggtgaggaatgggactttcatgacctcatgtgctgtgatgtcaccttactggccatctaggatcccattagctcaaatccaattctggcaagtggcaatgtggccctcccactgggatgtctccacacatccctcagcaccagctatcacaagcactgacgacttccaatgcagagcttacagcctagcctgctcatcctctgggccaagcatgctgatggtccacaagagcttcactcagcctgattccttgaaggaaagctgggttagccggccagcagagggcagggcgtagtagctcctgtctgtattctcagcattctgggaggccaaggccagtggatcgcttaagcccaggagatcaagactagcctgggcaacacggccaaaccccatatctacaaaatatacaaaaatttggctaggtgtggggatgcacacctgcagccccagctacttgggaggctgaggtgggagaatcgcttgagcagggaggtctgatcacatcagtgcactccagcctggaaaacagagaccctgtcttcaaaagaaaaaagtgggggtggggggcaaacttgggcaaaaggggcaactgtggagccactgcatggaggggcctccagaaggacgagacaggcccgcgccaccatgcagggggctcttccttagacatctccaagtcaccagggcaaaccctgccagggcacattccaacatgcagcgggctcttccttagacatctccaagccactagggcaaaccctgccagggcacattccaccatgcagcacacaagggtttcagtctgcacagtccccggggtcaggcagtgtgtcgactcccaggtgacagatgagtgagcatatctgctcctcacaactctcctagacttccagtctgcctatgaggcctcttgttcacccccacacttgcctcaggccccattccactcatgaatcacaaacagaaaaggccacaaaaaccaagggagccaaagagttgtccaaatggccccttgatgcagctaccttcatcctggtgatcatactctgtcctctgtgcctgtcactgagtagactggctttgtgcagagatacaaaatgaaactaggaataacagtattttatattaatactcctctcaaaaatatagtaatgaactttgttctcctgagacttggcagagtgtaaaggaaaaaaaaagatatttgcttagaacattaactctgagtagttggcaaaccaccagacactgacggagctggcacatcctttcatgtggtgctcatcagtcgaagtgctcacaccctgaaagggcccacagaactgctgcaatcagccacactgcttggaatgcgacttggtgccccagtagcagcagcagtaccctgtgcggggtgcagaagcagctctcagaacacaaaatgcaaaacacatgcttccctgctgagccatgctagagtcggcagggctggcaaggggtgggggctgcctgaagtctcagcacttgaagaataggatatgctatctctagccaaagagcctagaaactactgctgacagagccacgggctgcatgtgctccactgtgggccacaggtactcacaaatttcagtggtggttgggtatacaacatttgtccagggagagcttgcgcctgtgacaccaaaggctgggtctgcgactgtggcgggagttgtgatggttggttctgagcaactggaggctgctggggctgtggtggcggctggtggtgctgtgtgtgatgcatctgctgcagctgctggggcagagcctgggagggcggaggctgtggctgctgcatcggtggctgctgaattggtggctgggcctgcaaagcctgctgctgctgctgctgctgctgctgctgctgctgttgctgttgttggagctgcagctgtgctattcgctgcagctgctgttgctgctgctgtatctagagacagaacaagcagcactcggttatcactcatctgcctctgtggcaccagctcctccctgtgacagtctgggcctcaggaagcccaggtggccatctgcagagccatcaagaaagccttcctggctgggtgcagtggctcacgcctgtaatcccagcactttgggaggccgaggcgggcagatcacctgaggtcaggagttcgagaccagcctggacaacctggcgaaaccccgtctctactaataatacaaaaattagccaggcatggtggctcacacctgtaatcccagctacttgggaggctgaggcaggagaatcacttaaactggtggggcagaggttgcagtgagccgagatcacaccactgcactccagcctgggcaacagagtaagaggcaaaaaaaagtctcaaaaaaaaaaaaaaaaaaaaggccttcctgggctgacaggctgacctctcactcacacggggaggggcacatctcccacagaaaggctctgggccccccgaggccaacaccagctgccttcctgacaccggggaggcaccaagtgtgtgcctgggctctggtctaccattccactaggatggttcaaagggcatacctagaaacttcagcaaaagatgacaaggaataggtacagctccatggaagctaggataaaagctggggcaactgcagatttctgaagcctctgcaacgatgcttgctttgcccctataggtcagtggcatgagcctcacggtgacggtcaaggtctgcttgtcagcaggagaaggaaaagtgtggctgcagatgcactgtcagctctgggagaggggtgccaagatccagagaagcccagctagctgaggcctgaaggggtgggagggtggtggggccctttggggctttcctctcccaaccaagacctgctgtgagggcagatgtttaacacgtctagactctctatggaaaccatgggaagctgaacaacttctgagaagcagtgctgctaacatgacatcaccatcacctcatgcaacaccagctggaggtcgactaacactgagcccagaacccaagacacagaggtaaacaggaggcacatgtgtcctcagccaaaatggcccacaatggctcaagtagtcccaagcctcagagtgttcgtctcacttcttgcttcagctcactcttgtttgaatccctcgcagcccctgaactacacaggaggcccaccgccagatgcccaagcccaaatggaagggctcgatcacagaaccttcctagtgagtcagggcctgtttctcctgcctgtcccagacttttgttttccttttttatttttattttttttgagacggagtctcactgctgcccaggctggagcgcagcggcgcgatctcggctcactgcaacctccgcctcccaggttctagcgattctcctgcctcagcctctcaaatagctgggattataggtgtacgccaccatgtccagctaattttttgtatttttagtagagatggggtttcaccatgctggccaggctggtcttgaactcctgatgatccgcctgccttggcctcccaaagtgctgggattacaggcatgagccactgggcccggccttgtcccagactttttgagaagcccatggaaaagggcaggcacacgtgtcaagagaaccctcggctggctccgggcactgcacccagcattgtggctgatgccagcccagggctcacgctgcaggagggaggccaagagcaggaacaggggacctggtacctgttgctgattttgatgatgcaatttaattagatgctgctgctgctgctgctgctgctggagctgctgctgctgctgcactactgcttggaactgctgctgcatggcactctgctgagcctggaactgctgctgttgctgctgctgctgctgctgctgtagcgccgcctgctgctgctgctggaactgctgctgttgctgctgctgctgcagcgccacctgctggagctgcagctgggctgagaaaagaccagagtcgccagtcagtccacagggcagattcccagaaacgctgcagggctgcacagcaagggacaaaacagccagcaaaagccccactgccacggctgccgctggaatctgaacgttccatttaccacagacagaaagatagaatacgaagtagcatttgtgttgattttgggatttcctatcatgagttactctataataaccaaagacaaaagaaaagggacaactaagtcttttggataaataagaagcctagactctggcaatcagtaatctcctctctgtctctatggattggccacttccggactctttgtacgaatggcatcgaacatgtgctcttttgtgactagcttctttagcataatatttacgagttcgcccatgtcgtggcatgttatcagtttttctgtgttatttttatcgccaaataatattctactacaccgatttcctgtgatgaacatttgcgctgcttctactttgtggctattatgaaaactgcttatatgaacagtcaattacaagattttctgaggtgaggtttcttttggggtgaacataaaaatgttctaaaattgtgctgatggctgcacaactctgtggattacactaaaacctaccgagtggagcacttcagatgggtgaattgtatgctaatgagaattatgtctcaataaagctgtattaaagaaatatagagagatcctttgtatactttgcccagtttcctccaatggtaacattctacaaacttacaaggtatcacaaccacgatgtgtgctcacttgtgtgggtgtgtgtactaagttctggacaatttaaccacctgggtgggttcagtcaccaccagtcaatacactacacagtccccacaccacaaggatccctcgtgttgccacctctctcagcaaccctgacccgcaaactctggcaaccactgcagcatcctccatttctaaaattttgtcatttcaaaattatacataatatttcaaaaatggaaccatacagtatgaacctttttgggatcggctttttacattcagcatacaggttgtagttctagcaacagtactgccagggtattccatggtacaagcacctcacagtgtgtttaaccgtctacatgaaggacatttgggtaactgtagatttgggctaccacaaataaagctgctgttaaaattcgtgcatgggtttttatgcgaggttttcatttctctaggaaaaatacccaagagtgtaactgctgagttgcatatttcattttgaaagaaggtaaaaccactttacattctcaccagcaatatatgagtgattcagtttctctgtcaccaacacttgaggctgtcactattcattttagcaattctgatgggtgtaagattttttttttttgaggtggggtctcactctgttgcccagtctggactgaagtggtaccatcgtggctcactgcacccttgacctcctgggcttaagtgaccctcctgcctcagcctcccgagtagctggaactacaggtgcatgccaccacacccaactaatttgtaaaatttttatagagacagtctcactttgttgcccaggctgatctcaaactcctgggttcaagtgatcctcctgcctcgacctcacaaagtgttgagattataggcgtgggtcactgtgcctggccaagtgtaaaaaatttttaatttattttgtgacagatttctaactttatttgacattcataaaacatgtatgaccggcgggtcgcggtggttctcacctctaatcccagcacttcgggaggctcaggcaggaggatcacttgaggtcgagtttgagaccagcttggccaacatggcaaaaacccatctctactaaaaatacaaaaattagcgggcatggtggcacgtgcctgtaatcccagctactcaggaggctgaggcaggagaattgcttgaacccgggaggcagaggttgcagtgagccgagatcgcgccactgcactccagcctgggtgacagagtgagactctgtctcaaaacaacaacaacaaaaagtatgacaatacttttaaattttctgaaattgttgaagcttgctttatgatttatttttataaacatattgttccatcatatgcttaaattaagttgttcattacattgttcaaattttctgtaaatgaattttttggtctgtttatcaataacaaagagatgtaattgaagtaattgcccaatacatctttcttcatccttttttttgtttgtttcttttttgagacgggattttgctctgtcacccaggctggaatgcagtgtctccatcgtggctcattgcagactcagcgttccaggctcaagcaagcgatcctctcacctcagcctcacaagtagatgggactacaggtgtgtaccaccacactcagctaattttattgactgattgattgagattgggtctcactgcagcccaggctggaatgcaatagtgcaatcatggctcactgcagccttgacctcctgggctcaagtgatcctcttacctcagcatctcaagtgtacctacaggtaatttttaaattttatgtagagatgggggtctcctattttgccgaggttggtcttgaactcctgggctcaagtgatcctcccacctcagcttctccaagtgctgggattacagacgtgagccactgcacttggcctttcttcatcttttatttttaaatccttccgcatgttttattgtaggtgtgtgtttcttctaacaataaaacaactgtgctgtttcatttccatttgttctcacatttcctatctttcagcagaaaagtttagtccactcacatttattatgattacttatatttttaaacttattttctattaatatttgtctttcctttcctttttttttttgagatggaatctcactctgtcgccagactggagtgcagtggcgtgatctcggttcactgcaacctccgcctcccgggttctagcgattctcctgcctcagcctcccaagtagctgggattacaggcatgcgccaccatgcccagctaactttttgtatttttaggagagacggcgtttcaccatgttggccaggatcgcctcaatctcctgacctcgtgatctgcctgactgagcctcccaaagtgctgcgattacaggcctgagccaccgcgcccggcctttgtctttccttttctaagcttctttgtcttttttgattgcatttttgttggatgattggattgaactttgtattatctggatttctgccttatcctattttttctattgatcttaaattttatgaattatttccattgttttagcaataatttttcaattttatcatgcatatttaacttaaagtataaacctcatcaatattttagcatttcccaaatttactactttttaaagtaggttttatatgtacccgacagaaccgatattcacgctctatctccctgctgacttgcatttatttcatattttgttgatctattttaactcttcacagcagacattctattaagaggctggatggatttgaggctagggatacagcctccaagctaggctgcctggactcaaaacctcaactctgtcactgctcattgccttagttttccctgttagaaaatgcaataatagtacctactccacacactggactaagaattaaataatctattatgtaagtaaaacactcaaaatagtccctggggttgggtgctgtggctcatgcccgtaatctcacactttggatagccaaggcagagcagatcgcctgagcccagcaattcaagaccagcctgggcaacataaggagaccctagctctataaataataataataggccaggcgcggaggctcatgcctgtaatcccagcactttgggaggccaaggagggcagatcacaaggtctggagatcgagaacatcctggccaacatggtgaaaccccgtctctactaaagatacaaaaattagctgggcgtagtggcgcgcgcctgtagtcccagctacttgggaggctgaggcaggagaatcgcttgaacctgggaggtcgaggttgcagtgggccgacattgcaccactgcactccagcctgttgacagagcgagattccatcttaataataataataataataatagaaaagaaatgaaatagtgcttggaatgtggcaagtctgtatggaggttagcctgactgttttattttacagaggtaaatttttatttacaccagcgattttcaaccttttcactactgacacttgacccagatgattctatgttgttggggggactgacctgtatttgtaagatggttagcagcacctctggtctccacccattacgcaccagcagcacccccacagtagtgacatcccaaaatgtctccagacattgtcaaatatcccctgtggtggaatgtcaccctgggtgagaatcactgctttagatttatacacatttactatcacctatgctcaacgtttcttttcccattttaccttgtatcacctgagagggaagaggaaaggataaacaaaagaatatatctaagagtgcaaaaggcttattggaaaaaggataaaaaaagatatatcctttagaaaatcttttagtgatggtctctaaggctaggtttatctaaaaatggcttgctttccacatccttgagtcttgctggcatacaaatgtgactggcagctctattctcaatgctttaacaatattctattacctttctgactctactgctgagtgtactcattgctcctttgcaggaactgcctatttctaagacattcctctggcctttggtgctctgcagtctcacagcagatgagatggctaacttggttggggccagatgggcttttctcagtagttatcccctcacatattgttttcttccattctctccatttgatccttccggggctttgcttggatgccaattagaatttctgatcttatcctcatttcttacccttgctttcacattttccatgtgctcttctctgtgctacattctagataatttcttcaaatgtagcttctattacacaaattctttcttcagctgtatctaatgcgctgttcattcatccactttcttcgttcaataattatattgctcatttctacagctttcatttggttccgtttcaaatctgcttcattgctcctgatgatgctttttcatttgaatttctgctctttcttttcctttttgttttctattttttcagagatggtgtctcgttctatcccccaggctggagtgcagtggtgcaatgatagttcaccatagcctcaaactcctggcctcaagcaatccccctgccttagcctcccgagtagccaggagtgtagtcgtgagccactgtgcccggctctccactttatttctttatataccccatggcccataactaacagttcctgtgtgtgtggtcactgggcatgcctacatgtgtctattttttctgttcaccttcatggtgtctctccttcccttcaaggctggtgatctttgtatgctgattgcttgaccttaatgtgcaactgtcacaggtcttacactggggacatgttcctccaatccgcacctgctccaatctgcacctgcttctggggggtatggggggtgacacaggacccagcacaaatcctggctgactacaggaatcccaagctttcttcccccaccttgcagcagctgaggctcaggaggacaaagcctccccaactgctgcaggccagcattccaaagtgcatcctaaccagaacctagttatccaggaggagaacatgtcctcagcaccccagtccatcacacaactggcagtagaaattatttttaaagtcggctttacatgcacgtcatataaaactcatgagaaacaaaaatgcgcagagtgaaaagctttgcttccaactctgtactgcagccccagccataggaacaaccagcagtttcagccttttccgactaacctgggtcacctgaaaactatcacaatgtcccctggcctaccctttgagagtccctggcaaaacctctgacccaggctctgtcctcttggtggcactagatgaagatctgaaagggccttaatcatgcagtagtctttgggaaaggtgtcaggaaggggtatcaaatgcccatcagacaacactactagtttcagggagaccagggaggcaagtggtgaagggcagggagagttggcctctgacaaaggtggtaacaagatcctgaagtagagaatccactgtaactttttcttttttcttttgagacagagtctcgctctgttgcccaggctggagtgcagtggcacgatctcgccccctgcaagctccgcctcccaggttcatgccattctcctgccttagtctcccgagtagctgggactacaggcacccaccactacgcccggctaattttttgtatttttagtagagacggggtctcaccgtgttagccaggatggtctcgatctcctgacctcgtgatccgcccgcctcagcctcccaaagtgctgggattacaggcgtgagccaccgtgcccagcccccactgtaactttcaactagtgccacacagaagaccagtccccttggaagctaaaaacaggatgtgggggccaaggccagactggggagggcgtgggcaggatatcaagcttcaccactgaacttctgacaaagaactggtttaagacaaagtctctgaagtgggatgacaaggcaactcatgtgagcattctaaactcatacatttaaaaacaatttattatcaagtataagctcatgattaaaaaaaaaatgcaccaagtacacaagagtagaacgtgacaaggaacttgagccggcacttctgtgggtcctccctaaacccagctggtgtacttatctgatgtgctaaaaatagtgaggtaatgagagcttgggacgaagaaccaggcagattgttctaggatgaggaaaccagcacgtgctgagagttagacaacaggaagtaagaggagaattaaggtatgagaagggaaggtggcttgggatggaggaagattccagagcaggagtgggtagaaatgaggatgcctatggccccaaagaagaggaaacctgacacaggatagggtaggagtgtgaggatggggtcaggcagcagcttcgatcccagctcttggcctggggtgtgactccagttctccttagcagctgctacactgacaaagcagagggggcgatgctgccctcttcatagggttatcatgagggatgtgtgacaaaaatatattgaagcactgaagcctgtacacagatatccacagcagctttgtttgcataatagtaagcaaaagcaggaaacaacccaaatgtccttcatgggtgaatgaataagcaaactgtggaaaatccgttccatggaacactacttagtgatgaaaaggaatgaattactgataaaacctggctgggtctcaagggtatcagattgaatttaaaaagccaatctcaaaaagtcacatatggtatgattccatttatacaacattcacaaagggacagaactacagagacacacaacagatcagcaattgtcactgcttaaggctggagggagggcgcgatctctgagaggtaacacaagagagttggttggtggtaatggaacggctccgcatgccaattgtggtgatggctacttgatttgacacgtggtaaaatctcacagacctacacatacccatatatgtagcccaagaatgagtgtaaaaaaactgatgaagtcggctgggcgtgatggctcacgtctgtaatcccagcactttgggaggctcaggagagaagatcacttgaggtcaggagtttgagaccagcctggccaacatggtgaaaccccatctccactaaaaatataaaattagctgggcatggtggcaggcgcctgtagtcccaggtagtcggaggctgaggcaagagaactgcttgaactcggaaggcagaagttgcagtgagctgagatcacaccactgcactccagcctgggcaacaagagtgaaactctgtctcaaaaaaaaaaaaaaaactgatgaagtccaagctaagtctctaactgaggtgattacactgcctcaacattaatttcttggttttgacaatgttctatgtaagatactattattggggagagctgggtaaagggcatgtgggaactctctatgctattccacaacttcctgtgactcctattttaaaaataaaaagttacatgaaaggggaaaaaaacactaaagcactttgcagtgggcacagcacactctaagaaatgttgatgggactcaaggatacatcaagataggtcctaagggcaggcgcgttggctcacgcctgtaatcccaacactttgggaggccgaggtgagcagatcgcttgagcccaggagttcaagataagcctgggcaacatggtgaagtcccatctctacaaaaaatacaaaatattagccgggcgcggtgctgtgagcctatagtcccagctactttggaggctgtggtgtgaggatcacctgagcccaggatgtccaggctgcagtgagccgtgattgtgccactgcactccaatgtggcccacagagcgagaccccgtctcaaaagacaggtcctggaaagaagagggaggttctttgcctcccctttagagcagctttggttcacctataacacctgatcacagcccagtttcccaccacagcagccgtgtggagaggacacagagtctccttcacagaaaggaagccagaagataatatggctgcaagccacacccatggtgaccaaggggcaagggcagcactagaagagatggtgcccagagctcgggcagacagtggagttgtggttgctggcactcagccctgccttgtagctgagaaccctctgaaacacactgtatctatttcagccacaaaacacaaacctttggatggagtctcaggccatccccaccctcctgcccagggctaggaggaggaggagggcccagcatcacttaacccttctgggagctcaacgaaaattggaagccttttctctccacatacaacaaagatttaaaaaacaaaaaaaccagagcgatttggagcttctccatgcttttcttgataccatcataagcacaggaataaaatgtgttgtcgtttgcaaggaaagcggcaaatcctccaagaagtgtggtactcactctgtggagttgccgtagacacgacagccatgctgtgaggggccatccccgaggtcccaggaggcggctgccctgagagagacattggctgtcccatggcaccaaggctacccatcccgcccagagactgtcccgggccccgaggaggcatgccaattccagcggctcccgcagcaggtccgccagtcaggctctggagtgcattcataggatctgtgggaacacaagggcagagcttctcaggaaagggcctaccagactgaccatggctcaaagggcgtaaggctcacagagcacagatctcgcctacctacaggctcaatcccctcacagccccaagcagtaagagactaggctcctggagactcccaaatatgaatggctaggacgccaggtgtgttggtcactgcatgacccatacctctagcctggcctggaccagagtcctaatgttaagggacaaatgacctctctgatgcctgcagatacactaaagatgggctgaggccttgagggcaggtggcaacccctgcctctcctggctgtccagccctcctgctgggtgagcgtacaaagcacgatgggcccttctgagcaagcggtaacacagtggccaggggacgctctcccagggagggcacaagtccacaggcacacacagctccactcgtgctgttgcagagtccaactcagcctgggcccctgtgtgcagggccaccatgccagaacagcttaggggtgcagaggagggctccacagagcactgaggagaaatgtcccaagcccaccaggtcagcagctcagtgagcaatgccacaaccaaggacaaggatgccattgtcacaacagtgtggacttcacagcaaacagctacccacagacaggtatgtcctggcaggaccgccatgccacacaactgggtggtacccaggaccccatgctccaatgccaaggggcccagatgttctggccacatgcccttgctgccgctcagccccagttggccaagaatccctgtcctggctgagaggtgagacccacatgggcagagacagctggcatgtacagctctactgtctagggcagggcagacagtggcgtgcagcctgtgaggtcagtgcactcccttcccaatggcagaatgcagttggccagcctggatctgttaaaccccttcccttgcagcttagtcagcagagaccaaggctgaattgacagaattcccctcatgtgataaacgctgaaatttaaaaatatggatttctaaactttttttttgagatggagtctcactcagtcatccaggttggagtgcagtggcacgatctcaactcactgcaacctcagcctcccaggttcaagcgattctcatgcctcagcctcctgagtagttgggactacaacgcatgccaccacacccggctatttttgtatttttagtagagatggggttttaccatgttggccaggctggtcttgaactcctgacctcaactgatctgcctgcctcagcctcccacagtgttgggattacaggcatgagccacagcacccagccagatttctaaatttacaaagaaactttgtaacttaaaaaagtgaattcacagcattttctcagaaatgctactacatattattacactgaaaacagcataataattctctaccagagagctcaacacttttggataatgtcttaatagctttgtgagtgtttatctttttgctgggcaaaggcagcatttgtgtgaaacgggatggggaggatcatgcgacttcacagtctgcaggaagacgaaggctggagaggtcagggcacagctggtcagcctcctccctccagagttctctccgcaagcattctcctctagtgacaggttaacccaggcacatgaggcatgcactatgtcattcttgccacctcaaatccaaagttgggagaaactttaactcaaaagggaaaactcttaccactgacggaagcttgagatttcttgttatctatatgaaaacacaaacaaaaaaacgaaagtaaacatagttttatataaccacatatttccatgggtaggtcagttctgtaggcatttgcccaagccttaatccccacggagctcctagtactccccactactgggggaagtgtttctactcttggcagcgctgaccccacaagagacctgggggcagagggtgcagagtagctccagggtcaacctggggccttagggagctgcccccaaggctgaagcactctggggttggggaccctgggcctactctggctttcctttttcccaggtccagagtctcagctcagccctgagcaaacaaataatagaacactacaggaacccacggcggggctggagtggtgccaagacttgacactgcctccctttgcagcccactctggtgaggcagtgtctctgttacctagatgaggaaactgaggctgtccacggccagctggaagccagtccagctgaccccagtgcccagcggagaacttctgtagcagtcatggggccctgagcctcctgctcggctgcttcccatgacctcatgagccccacaggactgtgtgcaccagccaggccactgtccctgaaagcagaacatgcggagtctgccagcgcatctgggccagatcatctgggctgctccttctcctcttacacatcccagtgactttccaacaccacagagagtgagatcagtgaagttcactttgctggccattctggtgaaaagttagtgtggaaagaagcaaaacctaccaggctctggagtgctcaatgtctccctttgacccagcaacacactgaaggtacagctgcctgtccctaacccacaggggaatagaaataggactcgccaggcacatgctccaacgacaggcctgtgtcaagagaagcctgcctctggtggttatgcagcggcagtgggcaggagccattgttggctgaaaacacagagcagctgctggccccagtttccttcgcaggctgtggccatccaggaacacttggtgtccacatacttccacgtaacacacacaagcacgaagaccctggccctaggatgcaatgacaactcatttctgtagagctggggccactgcctggctgacagaaccacactgggccctctgaatcagaggaggcacaacgtgaggttaacacgggggccctcagcacagcagggagccagggtgcagactcaggaggtcctcctcagaagcttctagtctggagggaaaatatgcctaagtgtctctggcctccatgggtcaataaaatcaacttttagggaagagagtttctgttccagggtaaacagaacttcccagaagtaaaaacaacagccctatgaaaagggagattaagtgagcaagtgaagcagcaacccgtttagaccactttgaggacagcatttccatgatgctagaatcagcatttttgaggccaaggctctgggaggatggagggatctggagtcaaatgcaaggcagtgaagaacttcccagaagcaagtgaggtgacacagaccttctgactcaggcaccacggcctgcccagaaagctctgccgaggcagcgtcagggctggcctctcacagagatctcaacaacccagaaatgcaaaatcttacttacgaatgtctcgaaaatggataatgagcctggccacgagagaaaggtattcgtcctaaaagtaaaaacaggaagcagtttaataccagatgaagaagcgcagtcatcggactcccccttcccgccccctcgcctgctggcaccgagctgaagcccatcctgcaaggcagattcagacgcttgctcggcctcctctggaatccgcctctcggaagagagccgtcagtgctcagctaggctggccaataacaggcacaaagaaacaagaaggggacagagagcctccaacggccactcctctcccctgatggaaaggcactcagctgagagagctgggagccatcttgagtgccctctcttcatcacaaaggggacaggcaggttgggggtgatgaggcgctggcctgagggcacaaggcctgtcagaggcagccgtgggtgggccgctgtgtctttgcactatctgtaaagaagggctttcatttctcagcccagcctgttgctgccttttcactgatgacgcagtatctgctgaaaatctgggcggccctcccctggctgcgctttccgggagaatctgtgttcatctccatttacgcacaggcaaggcagagggtgaagcccactctcaggtgaggtgaaggccactggctgccaaggcccgctatatgcaagctgctgtgtttctgagattgtctggcaggggctgcctcccacccattgtcctctttggccccaaggacactcactcccaagtgtttcagggaaatcactactgtgagttggtcttgtggtcaatacacggatgtctgaggtaaagtcttatttcagagaagcatccttgtcttctgctgaagtgcccatccttctggcagggcagcctggaaggggcaaagccccggctccgtgccctgctcacccaaccttcctcctgagtcactgtgacactcagagtccatccactacactcataagatggcagggcagagggaaggatgatgaaaagtggtctcagatgagtgtaaaaatacaaagacacttttgaaatctttatcatcccacatctatctccaaactctaccccacttctttttttcagctcggggaattagcacaggacaacatgaagaagaaaggcccaggggagaggaaaagctgggataagcagcgaggcctggccagaacaaggggacaccaaggcagttctgtcaacacgcccagcttccggctatccccatcaattactgataggaaagctgatgtgcgtgtgaagggggcccacaggcagcctgtccctgaaggacagtggtatgagaatgggggcaatggaggtgtgggaacctgaggacactcaggaacagaagcaaggtggccatgtatgaggggagaagggcctgggggccagccaggtcaacacctcacagctcctaaggccctggaccattttttaggtctgcgatactttaaatgaatttgttttctccacatccataaaaggtaaaacaaggggaagtaggtttcaaaagcaacaagatacttttacttagacataagacactcaaacaaggctcaggaccatgtcaccaaagcccttctgcataacaccagggctgagcaagacccactgccagcccagcacctggaatgcagtgggcaggcatcatcatcctgcagtgcccagcaccactcctgacccacagtaggcgcagccactgccatctgctccagctctgctaccagaccagcgtgaggaggcttagtggggagcggggagggaggggacgcctgatgtgagaaacaagcacaggaagctgtcatgctgccagccaaggagctttcttgtgggcgatgatacttcctacattcccccaaaggcaggtttatctaggaacatctaggggctgaacgcaatgggtcaaccacaacaactcctttccaggggagaaagccctggatctgaaactgcgcctctgatccccctggctgggctctttcactcctgactcctcaccatccacccccacccccatccagatggacagattattatgcccctttctgctccaaagcacaccaactcccctagaactgctgcagaaaaaagggctaaagagtcaggaaactccctatcttcacttggtctgctccagctcccctgctggctatcaaaatataagtgtccagctgtacctgaggctgagtattacaaaccataaacaatgaacatcatgacagtaacagctagcacttggcactttacagtgccagacacaggagtcatcaattcacatgcattatcgccttgatttctcccaaccacccagaggcaggtactactaacacatccagtttacagataagaaaacagaaaccttaaaaaactccatagaggccaatcgtggaggctcacatctattattccaacattttgggaagccaaggcaggagggtcccttgaggccaggagtttaagaccagcctgggcaacatagtaagacaccatctctacaaaacaaacaaacaaacaaacattaccctggtgtggtagcacacgccagtggcctcaaagtgggaggctgaggcttgagcctgggagatcaatgctgcaatgagctgtgaccactccactgcactccagcttgggcgacagagtgagaccccacctcaaaaagttaaaagcttcatagaatttccacacttgcttgacatgtggaaatcttgcacaagtgcctcacaacatattgtggagtgaacacaaggaaggagaaaggatagaaacacgtgctccgtgccacatacactgcatgacatacaccttttatataagacctgtggaacgtaaacacacatatttgcttaaatctgccatgagaaacactggaaagatacaccaaaattgaaaatcgacaacccagcaagtatcaggaactgggctggaaatgtgccctctctaaatccacagtgttatgggttttcacttcagaagcacataaatcttttactattgagaagataaagccaaatcaagtcgggcaccttggctcacacctgtaatcccagcactttgggaggccaagacaggaggatcacctgaggacaggaattcaagaccagcctggccaacatggtgaaactccatctctactaaaaatacaaaaaaaattagccaggcctggtggcgcatgccggtaatcccagctacttgggaggctgaggcaggagaattgcttgaacccaggaggcagaggttgcagtgagccgcgatcacgccactgcactccagcctgggcaacaagagtgaaaactctgtctcaaaacaaaaaacaaaaaacaaaaaaaacaaatcaaagctaggcacagtggcacagtcttgtaatcccagctacttggaaggataaagtaggagtattgcttacacccaggagttcagcctgggcaactcaggggcaactcagtgaattttatttctctaaaaaatatatatattttttgagatggggtctcactctgtcgccctggctggagtgcagtgacgcgatcatcgctcactgcagtttcaacttcctgggctcaagtgagcctccccacctcagcctcctgagcagctgggactacatgcatgcagtaccatgtccagctaatttatttatttatttatttttattttttagatggagtctcactctgtggcccaagctggagtgcagtggtgcaatctcagttcactgcaagctccgcctcccgggtggtgcaagctattctcctgcctcagcctcccaagtagctggcactacaggcgcctgccaccacgtctggctaattttttgtattttttagtggagacggggtttcactgtgttagccaggatggtctcgatctcctgaccttctgatccgcccacctcagcctcccaaagtgctgacattacaagcgtgagccaccacgcctggccaattttttgtattttttggagagacacggttttgccatgttggccggcttgtcttttgctcagtccccaacctccaaaagtgttgggattacaggtgtgagtcactgtagccagcctaaaatatttttctaaaatgaaaagtatagcaaatctaaagaaaaaggtccaattcctaaacattccaaataaactaaaacaaatgagctgaatattaagttggtggcagaatcatatagagaaaagaaatcttttgagaggctttttaaaaaaatgaaacaaaaagcaaaatgttctcaataaaagggatacattttaaggacaattagaacttcaaggtaatcttaaatgtttagtctaccttttgttatcagtggtaatataaactgtttattctgaaatgattttaaagtaaagcaaccaagtatgctaataatattagaaaccaagatattcatagtaacagaaaagacacatgtttaaaatgaaagaagtaaaaaccctatatataagtttaaatttgaattagaaatattagtgtaaaattatgggtttttgttgttgctgttatttcaaaaacatgttttttcttagttctgttcactgaaaggcccaaagcaatgaacagaccagcgcccacgtagcatgctccaaatgccactttaccggcagaagtccccagggttcactccctagaggagcagccaatctgggtctaaatgccagcagactaagaaaaactaaagaggttgtgtgagggccccaagagacacaggagctcctgctagatgaggatgggaccatctaagcatcaaaatgaatgacagcaatggaccagaacaccccagatacacagccctgagctcaaaatgtcactcaaagagaacccatctgtggcccttggggggactccttagactggaaagatcagaaaaacagcattcctggaggtcctgaacacacagggtttcaaacaatcatctagccctggctgacgaaagaaaacctttcttgacaaaaaaaaaaaaacaaaaaaaactccatgtaacgaatgtgggagaaaagccagaattagtctacaagccctaattaaatgatgaaaccatcggaaagataataggagctttacaagggtcaggctgttgttgctctccaaacctccaaattgtggtcttatgggaatatcaagatgcccagaaatacaaattaaggcaatacttcggatatatttttgctaaaagaccacggcaccctctctgctctccgatttagcacccagttcataagaaggagggggcaggcaggatgaatcagcagcttgggagacatcagagcccatggggagggctgcaggacagctgggctgctccttcaccaggctgggaggggccagaggggagaaaagaccctcgtttggatcctgattcaaagaagccaactattaggaaaaaagcgttgaaacttgaaagaggccttcccattgatgacaatagtgactccatgtgattgtcaggtggggccctagcacaggccagtgtggagatgctcagcagagatacaaccctgagggtggggatgtgccctcgacacttcaggagggacacagagacagccaagggaaaagtcaccaaaccacagcaactgctgactccagattagaggaatatgacgcctctgtgctttcatgtctcagagttttcctaatagattttgaaataccatcaaattccagaaagagtggttccatgatagtatccatagccccatgggaccttggccccagcccacaggacacaccatcagaaaccaagtagggacaaggcagccccagcagtgccccccacccaaggaaaccacacggccctgacctggccaccaagggaaaacagacctgttattcatcattttcactcgttccattaaaaatatatgtaataggctggctgagatacaattcacccatttaaaacatgccattcaatggtttttggtactacattcagagttctgcagcattaccaaaatcaattttaaagcattttgtttcttttttttttttttttttttgaggtggagtctcgctctgtcacacaggctgaagtggcaccatctcagctcactgcaacctccacttcctgggttcaagtgattctcctgcctcaccctcccaagtagctgggactacaggtatgcgctgtcaccccctactgatttttgtatttttagtagaggcaggatttcaccatgttggccaggctggtctcaaactcttggcctcaagtgatccactggccttggcctccaaagtgttgggattacaggcatgggccaccgtgcctggcctaattttagaacatcatcttcactccaaatgaaaactccatttccctacagcacccttggcaatcaataatcaactttctgtctgtggcaggctaaataacagtccttaaatcaggtcctattccctggaacctgtaaatgttaccttatttgagaaaaaggtctttgcagatatgatgaagttaaacatcttgagatggagggctatcctgggttatgcgggtggaccccaagtgcaattgcatgtatcctcctaagagggaggcagaaggaaagttcacacacacagagaaggcgacgtgaagatggaatacagagaatgtatttacctcgtgatgctggacttgaagactggagtgatacagccacaagccaaggagtaccagcagtgaccaaaagctaaaagatgcaagaaacaggttcctctcctatagcctccctgctgccactgcgatttttacccatggtactgactttgaacatctggccttgaaaactgtgagattaaatttgtttgtttgtttgtttttttgagacagagtctcactctgtcacccaggctggtgtgcagtgccgcgatctcggctcactgcaagctccacctcccgggttcagccattctcctgcctcagcctcccgagtagctgggactccaggcgcccgccaccacgcctggctagttgttttgtatttttagtagagacgggggtttcaccatgttagccaggatggttgcgatctcctgatcttgtgatctgcccgcctcagcctcccaaagtgctgggattacaggcgtgagccaccgcacccggcctaaatttctgttcttttaagccaccaagcttgtagtaacgtgttatagcagccacaggaaacatacgaattttgttaccaggagtagggtgcctaaaaatatggcagtggctttgtaactcaataacaaaggagggctagtagaattgtgagaagcatgatagaaaaggcctaggtttccttgaacaggctgtgggtagaaatgcggatgttaaagactgtcacccagactctgccttaaaggaaatgacgaacttgatacagaaagtctgtattatcttcaagaatacatatactatcaaaaacagaatgttgttagaaacatgaaaattaaaggtgattctaaagaaacaaaggaaacaaggaacatgttactggaaactagagcaaaggtgatctttgtaatataatggcaaaaagtttagctggattgtgtcctgtagctgtgtggaaggcagaatcataagcaataagtttgcacatttagctgagcagacttccaatcaaagcattcaagactcagcttgggccgggcacagtgactcatgcctataatcccagcactttgggaggctgaggcaggcagatcacctgaggtcaggagttcaagaccagcctggccaacatggtgaaatcccatctttactaaaaatacaaaaattagccgggcgtggtggtgggcacctgtaatcccagctacttgggaggctgaggcaggagaatcacttgaacctgggaggtgggggttgcaatgagccgagatcgcgctactgcactccagcctgggcgacagagtgagactcagtctcaaaaaaataaaaaaaaggactcagcttggtttcttctttctgcttgtagtaaaatgcaagaggaggccgggcatggtggctcacgtctataatcccagcactttgggaggccaaggcaggcagatcacttgaggtcaggagctcaagaccagcctggccaacatggtgaaaccctgtctctactaaaaatacaaaaattagctgggtgtggtggtgggcacctataatcccagccacttgggaggctgaggcaggataatcacctgaacccaggaggcggaggttgcaatgacctgagatcacgccactgcactccagcctgggcgagagagtgagactccgtctccaaaaaaaaaaaaaaaaaaaaaaaaaagcaacatgaaagagataaattaagggtacaataaaaagaattttaaaaatacacacacacacacacacacacacacacacacacacacacaaagaagagagagaaattgagggaagaactgttaagcagaaaggaatctagacttaatgatttgggaaattctcaggctatttagattggaaaaaaccaaaatgctaaaactaggagatttactgttaggaaagtgtgttctgtagagaatgccaagggtgtggcatatcttccaaatttttctagtgccaaagagattaaacatgggactcatgaatcccctcaatcatctcacagaagtgaggaagagagatgaaattatctaggaaagatctgtggagaaacctcatctaatactatgaattccatcatatatgtagaagttccacaaggattttgagaatgttctaccagcagaaacactgccagcttggagtagaaagtttatagactaggcaaaatcaaagaagaactcccaaaattttagaagcaggaataggctgataaaactacgcagcctcaaacatgtgctaccctttaagaaagtgagggcagagacatgggctcagaagtcagagccatggacccagagataggagcctccaactttatggtaacttgttatggcagccatgggaaactaatacactatctctatagatcttcgtattctctggacattttataaaaatgcaacatgtcatcctttgtgactgcttcatttatgtaatgtttttagcttcatccatgttgtagcatgtatcagcccttcattgcttcgtgtggccacatgatattcattgtatggatattctacattctgtttatccattcatcagctggtagacatttgggttgtttccatttttggctatttatgatgttataatgatgctataaacatttgtgtatatatttttgtgtggacatgttttcttttctcttggatatatacctgggagtgaaacttctgggtcgtatggtaactctacattcaattttttgatgaactgtcatactgttttccacagcaccatttcacattctctccagcaatgtatgagaattctaatttctctgccaggcacggtggctcacccctgtaatcccagcactttggggaggccaagatgggtagaccacctgaggtcaggagttcaagaccagcatggccaacatgatgagaccctgtctctactaaaaatacaaaagttagccgggcattggctgggtgcagcggctcacacctgtaatcccagcactttgggaggcctaggtgggtggatcacaaagtcaagagatcgagaccatcctggccaacatggtgaaaccctgtctctactaaaaatacaaaaattagctgggcatggtggcacatgcctgtagtcccagctacttgggaggctgaggcagggtaattgtttgaacctgggaggcggaggttgcgttgagccgagatcccgccactgcactctagcctggcgacagagcgagactccatctcaaaaaaaaaaaaaaaaaattagctgggtgtgatggtgtgtgcctatagtcccagctacccaggaggctgaggcaggaaaatcaccggaatttgggaggcgaaggctgtagtgagacgagattgtgccactgcactctagcctgggcgacagagcgagactgtctcaaaaagaaagagaattccaatttctctacatctttgccaacgcttattattgtcttttttaaaaatcatagccattataatggaaatgaagtggcatctcattgtggtttttatttgcaatcccctaatgactagtgatgttgagcatcttttcacatggttgttggccatttgtatctcttctttggagataggtttattcaagtattttgcctattttttatttcatttatttttatttattttatttatgtatttattttttgagacggagtctcactctgtcacccagtctggagtgcagtggcatgatcttggctcactgcaagctccacctcccgggttcacgccattctcctgcctcagcctcctgagtagctgggactacaggcgcccaccaccacgcctggctaattttttttcctttttttgtattttaagtagagacagggtttcaccatgttagccaggatggtctcaatctcctgacctcgtgatctgcccacctcggcctcccaaagtgctgggattacaggtgtgagccaccgcgcctggctgtattttgcctattttttagttgctttttgttgttgttgttgttgttgttgttgagttgtaggagttctttatgtattctggatattaaacccttacctgatatgtgatttgcaaatattttctcccatcccatgggttgtttttccctcttatgacagtgtcctatgatgtacaagtttttaattttgatgaagtcaaatttatctacgttttttgtagcttgtgcttttttggcatcatatctaagaaactactgcctaatccaaggtcatgaagatgtacgcctctgctttcttctaagatatttatagttttagcttgtaaatttaggtttttgacccattttgagttaattttttaaaaagttttttagagacagagtctcactctgtcacccaggctggaacatgttggtacaatcatagcttactgtaatctcaaactcctgggatcaagtgaccctccagcctcagcctgtcgattaggcaggactacaggcacgcgccaccatgcctggctggtgttttttattttgagttaagttttgtatagggtatgaagttggggctcaacctcaatattttgtatgtagttacccagttgtcctagaaactactgtgatttatgtatttaaaattttatttttggcacaaaatggaaaggctgcctacactgtcatcttcagaaagagtggcacagccttttccctaatctgtcaaaaaccttatgtggctttccacgtcctccaggagcaatttctagccctttccacagccccccttgggtaaacctcttatgagaggtgtcctgctctccgggatgattacaatgcatcactaacaccccctgcatccctccacttccactgcactccagcctggccgacagagcgagactgtctcaaaaaaacaaaaataaaaataaataaataaaatcccccctatatatttgcaaattatatatttaataacagacttatatccaaatgcataaagaactattacaacccaacaataaaaagactaacaacccaatttaaaaatggacagaggatctgaatagacattactccaaagaaaatatacaaatggccaaaaagcacatgaaaaagatgctcaacatcattagtcactaggcaaatgcagatcaaaacaatgcaaatcacacccattataatggctacaattaaaatagacaataacaagtattggagaggatgaggagaaattgaaacctcatttaagctgctggtgagaatttaaaatagtacagttgctttgggaaacatctggcaattcctcaaaaggtcaaatacagaggtagggtatgacccagcaactctacccctaggtatatacccaagagaaatgaaaacacagcccacacaaaaatttatacattaactattgttctgcttactcataataaccaaaaagtagaaactatgtaaatgtccaccaactaacgaatggctataaaatatgtgatatggccatccagaaatggaatatttgacaataaaaaggaataaagttggccaggcacggtggctcacgtctgtaatcccagtactttgggaggccaaggcaggtggatcacctgaggtcaggagtttgagaccagcctggccaacatagccccagaccaatgcaaaacccatctctactaaaaatacgaaaattagccaggcatggtggcacacacctgtaatcccagctactaaggaggctgagacaggagacttgcttgaacccagtgggtggaggttgcagtgagccgagatcgtgccattgcactccagcctgggtgacagagcgagactccatctaaaaaaaacaaaagaggaataaagtatataccaaacatggttcatggaccttgaaccttgaaaatattatgctaagtgaaataagccagctgcaaaataaaaacatatattgtacgtggctgggtgcggtggctcatgcctgtaatccctgcactttgggaggctgaggcgggcggatcacctgagctcaggagtttgagaccagcctggccaacatgatgaaacccagtctctactaaaaatacaaaaaattagtcgggtgtggtggtgcgcacctgtaatcctggctacttgggaggctgaggcggaagaatcgcttgaacctggtaggcggaggttgcagtgagctgagattgtgccactgcactccaacctgggcacaagaggaaaactgtcacacacacacacgcacaaacaaaaaaaacccatatgttgtacaattatatttatatggaaaattccgaataggcaaatctacagcagtagaaagtataagtggtagctgagggttgaaggaaaagggagtgtgactgctaacaggtataaagtttctttaaaaaatgttgaaggctgggcatggtggctcacacttgtaatcccagcatttagggagggcaaggcgtggggatagcttgagatcaggagttcaagactagcctgggcaacatagtgggacctcgtctccacaaaaaataaaaaacttagccgggtgtggtggcacatgcctgtagtcccagctactcagaagactgagaaaggaggatcgcctaagcccgggagattgaggctgcagcaggctgagatcacgccactgcactccagcctgggtacagagtgagaccctgtctcaaaaaaaaaagttctaaaattaggccaggcttggtggctcgcacctgtgaccccagcactttgggaggcctaggcaagaggatggcgtagggccaaaagtttgaaaccagcctgggcaacacagggaagctgcacctctttttatttattaatgaatgttccaaaattagattttggtgatggccacacaactctgtgaatatcctaaagaccactgaaatgtaaactttaaagggtgaaccgtataaagctcttaaagaaaaagaaaaagcttatcaaacgtatccgtagtacagagcccactctaccccacctcagtgacacgtatccataatacagagcccactctatcccacttcagtcacacgtgtccatagtacagagcccactctaccccacctcagtccctgtgctcttgcagctctgccttgcacacacacgtgcacacaagtgaatatgtgttttgttcatttctagtaaaacggttctgtcccagggagcacacacagattaaaggaggtggtcacataaagccctcagtgtggtgccccacccagggagaaagcccacatatagtggaaatccttcttctccactccacctgtggcgagttctagataagcatcaccttcttcacttagcaaaaggggacaggaatgcttctgggcccatgcctcagggccctgtagggcttaggtaaggacccctaggaggggctgaggacaaaccaggttcttgctcacggcattgatcccttccacaggaccagctaggggcctgagcaagcttcctgtaggattcacaggggctgaccacagatggaaggtgacggcagtgaggtctggggccagaggctgggcctgcaacccaagtgccctccctgtaccatggacacacaggaggacccagactgctgcaggcaaaaccaactgtgcctgtgatcaatcgatgagcaaccaccccacccctacaccctaggacacccaacagaggggttccagagtctgtgatgctctcctctccaagtctctctgccagagtggctccacttactagggccttacccgggtcttggccttcaggaaaacatggctctccatatccttgctggatttactgtgtgccacaccagctttcctcatggcatcctcgctgaaacacaaaaggagaagagacgtttgcacacaccagtgactccaccgctgcagggccctggccaacaggccctgcatagcagctgcccctggtgacaaggtgctatcgccagcacaccagcctggctgaggtccaggagaggcatatgggaaggggcactcaacagagagcaatgacaggccactgagcagggtgatcagaaaaaagggacaggaaaggtggtcgccatgaagcaaagagagagccctggcatgaagggacggggcgggggaggggttgcccctagggatggctcacaaccagttcaggatcaaggaagtacgcattagactactgggtggccagctggcctctatttcctgctctctgagtggcctgcgttccccatgaactctgccagatggtagcaccctggttctagactcgattactcctataaaatgaaggggccacatgaagtcatctctcagtccctcccaaggcaagggtctgtccctatgtgggacaatgcaggtcctatatgtgggatcaaagagacaagctccaacttcacttctagctagagacaagaagagaaagaccacataaatgtgaaaaatatctttaaaaacccatttaccaacaattttgtactaagagatagaatcctatgaagagtttttcatcacactgctgctccacggggataaagagccatgtacatcagttaaggtggagacccctcgaatgcagcacatgctgccccacccacccccacccccacctcccacactcacacacagaaagacaaaaacaagtgtgaatctgttagaaaggcctggcctgtggctcccaggggtggactgctctggtgtgctcactgcctgccttcttgccagtgggatgggtctcttccttgcctggcctcccaccctgggcttgctgataaagaaacaagtggccaggtgcagtgccacacgcctgtaatcccaacactttgggaggccgaggcgggtggatcatctgaggtcaggagttcaagaccaacctgaccaacatggtgaaaccctgtctctactaaaaatacaaaattagcagggtgtggttgcgcatgcctgtaatctcagctacaaaggaggctgaggcaggagaatcgcttgaaccgggaggtggaggttgcagtgagccgagattgcgccactgcactccagcctgggtgacagagcgaaactccatctcaaaaaaaaaaaaaaaaaaaaaaagaaagaaagaagcaggctgagcacggtggctcacgcctgtagtcccagcactttgggaggccaaggcgggcagatcacgaggtcaggcgagcacgaccatcctggctaacacagtgaaaccctgtctctactaaaaatacaaaaaattagctgggcatggtggcaggcgcctgtagtcccagctactcgggaggctgaggcaggagaatggcatgaacccgggaggcggagctggcagtgagcggagattgcgccactgcacttcagcctgggcaacagtgcgagactccgtctcaaaaaaaaaaaaaagaaagaaagcaaaagaaaaaagaaacaagcaaacatgtcagggctctggggccttgcctctgagtgaattgaataggcccagtccagctcgtgctagaaagcattctgaccactccaaacagcaaccagccaacctcaggaaactgaaggaatgtacagacggggctacagcaatatgactgtgattcttaaagacatcacagaaaggaggtttaatgctgagaggtgcatacatctgtcttaatgtaaaaagaaaaacaaaatgacattgacctaccaccctgctagattcaaaaagcactcttgggctgggcacgatggctcaggtctgtaatcccagcactttgggaggccgaggcaggtggatcacctgaggtcaggagtttgagaccagcctggctaacgtggtgaaaccctgtctccactaaaaatacaaaaattagtcgggtgtggtggcaggcacctgtggtcccagctactcgggaggctgaggcaggagaatcgcttgaaccctggaggcagaggttgcagtgagccaagatggcactactgcactccagcctgggcgacagaatgagactcctgcactcttggagttcctacctccctgtctgcttcctgaagcctgaagggaggcgaggaggcagcaaggggtttctgctcacaaggcatccaggtgtggaacagacaagtaagaaaggtcaccagggccacaaaagatgagagagttaacaatccaggaggataatgacaaccaactcacgcgcggcactgggtcagagtcctggggaagcgaggcatgggtgggctgggaggaccctgtactcatgctctcaggttagcatggggcagggtctccacacccagaggctgagacgatagctgctaggccccaagaagtcagtgagcatttctgatagaagtggctgcacaggcctgttttctgaaggttgcctcatctgtgcccctcaaggcaggtatgcccttcaaaggcatacttgttcttcccaccttccttttttctttttcttcttttgttttttgagacaatgtctcactctctcacaggtgcagcgcagtggggcaaacacagctcactgcagcttcaaactcctgggctcaagtatcctctcacctcagcctcccaaatagctgggactacaggcatgcgccaccacgcctggctaatttttttattttttactttttttgtagagacagggtcttgctttgttgcccaggctggtctcaaactcctggccttaagtgatcctccaccttggcctcccaaagcactgggaccaatagggagactcagggaagagcagtagaaacagcaggggagcatttgcaggccaagcaggacggcctggaggctggctgtgtaaggagtggggaggctgtgggtggcagatgtggccaggagtcagagaggaagaagggtgcagaagagtctggggagtgacaaccagttacacagatgggctctgtgcccaccagcagcgatcagagagcaaagccaggctttgatacaaaagcagtccttttgagctgctactggccgtttttgagagtgtcagcagactggcaggccccagacagacactgtcttggtgcagcagagacacctggcacagtcagagagacaagatctagaaacacagcttagtgcaatagctctgaggtggtgggatgaccaggttgaagaaatatgcttggtgagctgaaggcaaggtggcaccatacaccaggggatgtactggcagacgggccctgtcctgtcctgggtaatgtcacagatgacatggacactgtgggcaccgtcagctactcagagcctgaggagcatggaccaagctggaggccagaaacaggcaagtcttgacaggccaacaccaggaaaccgagttggggtaaatgtccagttccacatgagcttcggagggtcagagtggggccaaggagcaaggtgctcctccggcaaggcgctcctccagcaaggctaccgctcagaacagcagcactgtgccatgtcactcccacatctctcccacagcatccacccagggaggcccagcaggtttggtggccagtaacagaccctgtgtggttttgcagttctgacaactgtatttttgaaaatgtctttgctcctgtttctagtttgaagatcaagtgtcacaaaatagagacaaagcgaaaaagaacccaggaactctgcagctaatcccccacacttccctgcagatgcctgccctttcctctccagctggcctggcgcttttcagaggcatcccctgcctggacattgactccaggagggtacccatttcacactcctgctgaggtcaagtccccttccttcctcccttagacctaacacacccgctgcgggaggctgcaggcaggacccaggcccaccttcagaacagcactggctgctcccaaagcccccttctgatctccctgagctgggctctgctgccatccccagcatgccttcctgagcagccagacccgaatggctactcctcagtctctgtctcctgaaaacaaaacccttcgagccactgtcacgaaatgaaaggaaactatcacacaaggagacagcccccaacatggagtaaggagcacagcctgagacaaagaacagagaacccacatgtcacagtgagctcttcccccacacaagcaagccgggaagacgagggcctgtccagccagaggaggacaaagagcagactggtgtcagctcacaagggaagacccttgatggctgtcctgccacagtcctgtccaacataagcaacaggttcacaaacagtacaggcctatgaggcggccaccaaagaacccaaggctgcctgggtggtgctcgctctagctgaggaagggggctgggggccactccctggttgcgaccagccagacctctgaacacaaggactgttaccggctcagagcacacagtcccttgctgtgaactgggctccaatgctctgcctttggccatggtctagctggttgccatagctatgtctgtgtactcagtcagggttcaactggtatctagcttagactgaagcctcccaggggaccgattcatcattacaggcccttggagctcccccactaaggggtctgaggatgtccttactgtccagaactgttcccagaacacagtgtgtcttaatggcattgcccgaccctgcctgagcagccagcagggatacatcaagaaaagctcttcgtgtcttcatctcccagcaccaagtgcccatcccagaaacttgggaactcccttcactttctgactgccacctttaattctccaaagttcaaatctttgccccaactcccactgcatctgtggcaattcctcccaaagggcctctgtctcccgttcccattcctacccccacgccctcgccagctccccaggtcacatgactgccagtgagcaactgccactgagtgtgggaagcaacccaggcccctgcttgctttgagcctcgctcctcaccagcagagcaggcagcctgtccaggagcccactgaggagcctgctcctgcgcctgccccacacactctccccagggccccagggatgatgacctactacctggcacattgcctgactatcccatcaggcctgttagggcctcccaccctgcttccacccaggcacccctgctgtcggctgcacagaaaccctgtagccacctcacccatgtctgtggcacttcctggaggaatctctggtttctgtgtgccagccccactatactaagaacaccctgagagcagagacaacggcgtccacttttgtgtgcagtgggcagtcatcactgccaggcacaataactggctctttttaacacaaggagtggtactgtcatgcattttgatgggacacgacgtgcagaacggagaatcagcgtggcagccatgggggaatccaggcctcaaacaggcacgtcctggcagtggaggccagggtgcctgggagaaggcgtgtgctggggcaggcagctgggcctggcaggaagcagacaggggaggagggacctgggctcaaattccaacctagccactcaccagctctgggtcttgggagaggcactccctcccctaaagcgtaacctcttcataaaggaggggctctgagaggctgtggccaggacgaaggtgcacagacagggccaggcagtgaggagaggcccactgttggcctggtctgcagggcttctgcccagcatgggcctgttgttcctcacctccttcctattccaaattgagaaactggcaacaggagtccagtcccagtccttgtaatctgaatgagactaagataaagcaaaaaactggcaaactgagcttcctagggaaggagcacagggcatcaaacttaaagcctgctaaggccagggaggcctgaggcaagctgccccggtctgccctcaacccatctggcagcgcctccctatccttcctttgcacaaagggtggggacagtgccgacctcacgggtagccctgaggatgatagtagttaatattataaggcactggacatacaggaagtgctaggtatgcgttaaagaaataagtcaggcaacaacctgcccaaatgtgcaataggatgcatcccaaaacacctccgccatgtgttgaggttattgttgccccctcctcagcagacgatggcccaatgagcatgtgcagctccctcaggcagagccaccctcccattggagctctgagtcacctgcagtgtaccctgaggccagctccaccgcccgcaagaaggacactcacacaggcatgttgatgaggcatgaactggcctccccaccccaactcccgctctgctctgctccacgccctgactcttccttccacaaccgccctggttcccaccaaggaccctctcccctctcagtgaggcctctcccctgaccccaccctctttaccactgctccccctgccacactgccaggcccccttccctggtccaactgctttcccattgctgaatgagggcatgaattcccaggacagccagcttctctgtcctctgctggtgtctaaagcaggaaggtgcgttcctccctggggcacagattcaccctcctgacctcaggggggcaggatgattcctctcagccgatttatgttctgctcgaaggaaacttctgtgagtttcttctaattttctaattttgagaaacacaacatctatcaatcaagtgaactctcatagggcagaataaatttttggcagctccacttcaccccacccaagaagcctcccagtaaattgctgcctgtgtgtgcagcctgcttgcccacctgggacaggagcccacagcttgtatgtgggaccctttaccctatgtgtttaaaaacctaaatcacagaggaccacaagacaacagaaggagagttatacaatatcaggatgatggtttcctaagcatgtcaccagaagcagacactataaaggaaaaaagattttcccatattaaaaaaaagatttggactaggtgtggtggttcacgcctgtaatcccagcactctgggaggcggaggtaggtggatcacttgaggtcaggagttcgagaccagcctggccaacatggtgaaacgtctctactaaaaatacaaaaattagctgagcacagtggctcacgcctgtaatcccagcactttgggaggccaaggcaggtggatcacctgaggtccggagttcgagaccagactggccaacatggtgaaaccccatccctactaaaaatacaaaagggcaaggtggtgggcgctgcaatcccagctactcgggaggctgaggtaggaggatggcttgaacccgggaggcaaaggttgcaatgagccaagatcccaccactgcactccagcctgagcaacaagagtgaaactctgtctcaaaaataaaaaataaaaatacaaaaattagccaggcatggtggcgtgcattataatcccagttactcgggaggccgaggcaggagaatcacttgaacctgggaggtgaaggttgcagtgagccaagatcaagccattgcactccagcctgggtgacaagagtaaaactctgtctcaaaaaaatatatacgtaaatataaaaattagctgggcatggtggtgtgcggccataatcccagctacttgggaagctgaggcaagagaatcgcttgaaccagggaggtggaggttgcagtgagccaaggtagcaccactgcactccagcctgggtaacagagtgagactctgtctctaaataaataaataaataacagatatgaacctccaagttgaaatgaggaacaaagcctgcacatttaattcccttccatcttaaaacctgactaaaaccacagaaaaaaaaaccaggaagaatggaaatggtggcctcaacagccttttagaagctggaaagctgatggcccagtggtaacgtacacagcaagaggaccaagaaaccagagtcctaagtaacagtgaggagggggtgcgcccacccagtgacagccctaggtctttgccaggttgaggccaggctgcaccaagtgctctgggacagagggtgaaagatatccctgcatccctcactccccaactttacactgtgggtagctactccagcaccaggtgaccacaggaggtttactctctggaaaagcatgaaacggatagtcactggactagggggccaacccacccagttgaaaaggcacaggtaggacactgagagaggtgggttgtgtggtcatctgtgctctggtctaagtgactagatcgatgcacgctaactgccgagacccactggcccatcagcctcctccatcgcagtgagcagcatgctggcagccaggtcttcacccacagcccagtgtctggaagaccatgctctagggcagggtccccaagccctgggccacagaccagtacaggtctgtgggctgttaggaaccaggcctcacagcagtaggtgagcagagggtgtgcaagcattactgcctgagctctgcctcctgtcagataagtggtggcatcagattctcataggagcacgaaccccactgtaaactgtgcatgtgagggatccaggtcgcatgctccttatgagaatctaatgcctgatgatctgaggtggaacaatttcatcctgaaaccatcctcatctgccggtctgtagaaaaattgtcttctgtgaaaccggtccctggtgctaaaaaggttggggaccattgttctggaggaaggactcagaatctgcagccagatgagccttcaatgaagttcccagtcgacaagctccacgtgctggaagagactcctaggctttggagggtccctctcagagtgagcaaccagccaagggcagccagacgccataacatggccaataaagaccccacaagaaaagagtaatttagcggtaacagaaattcagcaagaagaaggaaatgtagaatttattaggccaggtgcagtggttcgcacctgtaatctcagtactttcagaggctgaggcgagaggatgacttgaggtcaggagtttgattttttttttttttttttttgagacggagtctagctctgtcgcccaggctggagtccagtggcacgatctcggctcactgcaacctctgcctcccacgttcaagtgattcttctgcctcagcctcccgagtagctgggactacaggcgcgcgccaccatgcccagctaatttttgatttttagtagagatggggtttcaccatattgaccaggctagtctcgaactcctgaccttgtgatccgcctgccctcggcctcccaaaagtgctaggattacaggtgtgagccactgcgtccagctgaagtcaggagtttgagaccagcctgggcaacatcacaagatcccatctctacgaaaaacaaaaatatttgccaggagtggtggtgcatgcctgcagtcccagctacttgggaggctgaggtgggaggatcacttgagcccaggagttcgaggccatagtgagccatgaacacatcactgcattccagcctgggcaataaagtgaaaatttatcaaaaaaaacggtagaatttattataatatatataaatattatactacattgtatccatttaacaggaatgggtgctataaaaagggaaaagtcagattacaaaaaaggaaaaagaaggagttcttggaaataaaagcatgttagcagtgaaaggtcaaagaaaaaattgaggaaatcacttagagaggagagctaaaagtaaaagagatagaaaacaggagataaaagataaaactagaggcccaaagagtgaacattaaacactccagcacaggaagtgtagggagtgagattcccctgaaatgactcaaaggaacttcccaagtagagcaggacttgggtttagggatcaagacaagtcatatgaggctgagagctagcacctcaggagacagaagcacaagccagcacaagggcagcgcagtgtaacatcattttaaattccccagttagcatgtcccaccagggggcctagatgcactcaaactggcatggtctccagaaagttaattcccaggagtcccttctcaggaagctggcagaatgagggaataaatcacaaaggatgagacacaggatatagaaaacaagggacccaacaaaggaagacaacagtcccagtctgggcagacaagcacgctgagggctgtcacaccacacctgcggccactgcctagagggttccagaagggaggtccaagagggtcaccgcccacctcctttgggaggccgaggtggatggatcacttgaggccaggggtttgaactgaaactgacagctcactagcactgagcctgaagataactgtactgagaggcaaccggaaaataaaggaagaataagaatagatacacagaaaactgggcatagtgttgaaaaggcaattctttcctaggaaaaaaataacaagcaattgcagtacaccactatgctcagctgtgaatatcatttgtgtaggcagaaaatgtaaacattcattaccgatttatgcagaaagtagaatactggaagaatgagggaggagaagcagagataatggcgatggaagggagctacagagcaagccaacataatttgtaaaacgccaagttgcaaaagcagcatgtgcctattacctagaatcagaggtatatgccggaagaaagctcagatgtaaaggcagttgctacctctggggagaactggcagaatgggaaccacagtagtttcttgtctttttacagtttatgtgatatattatgttgataaaatttaaagtaattaaaaattaaatgaggccgagtgtggtggctcatgcttgagcccaggaattcaagattcaagattggcctgggcaatatagtgaaaccccatctctacaaaaaatacaaaaacttagccagtcatagtggtgcatgcctgtagtcccagaaactcgggggctgaggtgggaggatttcttgagcccaggaggcggaagctgcagcgagccaaaatcgtgccactacactacagcctgggtgaaagagtaagaccctgtctcaaaaaaaaaaagaaaattaaaattaaaattaaatgacaaaatgcacataaagagtgtcgtagagaaatactcagcgaacaatagctattaagaagggtcacgtggccgggtgcaggggctcacacctgtaatcccaacacttcgggaggctgagataggtggatcacctgaggtggggagtttgagaccaccctgaccaacatggagaaaccccgtctctactaaaaatacaaaattagccaggcgtggtggtgcatgcctgtaatctctgctactcaggaggctgaggcaggagaatcacttgaacccgggaggtggagtttgcagtgagctgagatcgtgccactgtactccagcctgggcaacaagagtgaaactccgtctcaaaaaaaaaaaaaaaaaaaaaaagagaaaggtcatgtttggccaggctcaatggctcatgtctgtaatcccaaaactttgggagaccgaggtgggtggatcacttgagaggccaggagttcaagaccagcctggccaacatggcgaaaccccatctccactaaaaatacaaaaattagctgggcgtggtggcccacgcctgtgggacagggcaaaactatgtcaaaaaaaaaacaaaaaaactcatgttcacctttcttttgtttttgagacaggctctctgtgttgcccagggtggagtatggtggcgcaatcagctcactgcagcctccgactcctaggctcaagcaatcctccctcctcagtctcccgagtagctgggactacaggcctagctaattttttaaaattattttttatagagacaggatctcactatgttgcccaagctagtcttgaactcctggcatcaagcgattctcccaccttggcctcccaaagtgctggattataggtgtgagcaactgcgcccagaccactttcacctatctaaaccttcctgtctcagtcaacacagggacagtaagtttctcctctattagcaatttggacccccaggagcgtctcaaaaaattgccacaggccagggaacagtggctcacacttataatcccaggactttgggaggccaaggcaggcggatcacgaggtcaggagttcgaaatcccgtctctactaaatcccgtctctactaaaattacaaaagttagctgggcatggtggcaggcgcctgtaagcccagcgactccaaaagctgaggcaggagaatcgcctgaacccgggaggcggaggttgcagtcagccgagatcgtgccactgcactccagcctgggtgacagagctagactccgtctcaaaacaaaaaacaaaacaaaacaaaaaaaacctgccacatattccttctgcaagtggccccacagtcagagtatggatggagtttgaagggacctcaggatgagtgaggccaacggcacaggcaaagcagttcctcccacccccaccccaagccccaccaatctgagaggtgccttctggctgcagctcaaatgcctcaccacactcccagccagaaaagccccttccctgtcctccatcagtgcagggcttgttctcacccagccttctgaccttcactaggtctctagacagctacagggtggcatcccacactgtccttggacttcttccaatcctgcaaccaatttactgccccagtgcccaggtgctttcatctctaaggcaggaaatgatgagataccgattgttcagtcatcaatgtaaccaaagcaaacatctggcctctctatctctcaggcagctgggagcacatttgtcaaactgtatcccaaacaaactgtaactttttcctttactgaaacttctacattctggttcttttactttttaaagaaacataaaagtgtttttttaacaagataaaaatatatacttcagaatttaactctccacccacatgtaggaatgggtattttggtcctgcagaatgaaaatctcgaatcataccaatacaggagacttcaaacactgtacacccctctgggctgcttgatgacgctttcttgcctctatcctcaaggtctctcaactcccagtaaacaagatcattgaaagaactaacctgcagaaaaggctgctgcccttcaaactgtgtactgttgtctaagctagttcagaagaatacacgagcttccttcacatactccaatctgttggtttgacttctgaagaaccagcagagttggaaaggcctcgagatctctgtcctggtgctggcctggggctcccctaggtctcgcctgaaagtgtcccattcaccaccaggcaagcatgtggcaaggaggagatctgccaacccaaatgctgatctcacatggctctgtggtatttggtgggggtggggaagctcgatcttttagagatctgcactcaagtactcacagttgaaatcatctggtgtctgggatgtgatttaaaatagtccaggaggtgatgaggaagggtgggtgaagcaacactggccatatgttgctaactctcaaagtagttgggagaccacttttctattatctctacttctgggaacacttgaaaaagtccataatgaactttttttttaaaaaaaaaggaagtcaaatgcttatctcaagcccgtgggatgattgtgcatgatccacacctcatgtgaacctgggctgtgagcatgcaggtcccagccagactccatccagggagagaacacaacctaagccatgggaaacctataactcaaaactgaactcacagtctcagcctagtttcactttaaaaatacatgtgtatatatatttacatatttaaaatgcatacatatcaagctataagcacacacaagactggtggaaatatatcaatatgtcagtaacagccagctctggagagagtatggaaaacaccttcctgtttttcagtcttctacaatgttatccggaatggaacgaagtactacacccacaagtcctgaaggtactgaccaaaacaggagggagagacgggaccggggctgctgtgactggaggctgatggggctccaccgtgccccatcctctcatcccacagtcttccttcacatctgctctgcccaccacagccctgctctggagttctctgctctgccacttctgccatccccacctaggcagacaggtttcatccagcctccaggacggcccacccacttgctcctgcagcaggctgctcttcccaggtttgcttcccccatctcccactgactgttggaaatttcacccacacccactccccacatcatcaccttacacccagccctcagatcagtagagaggctgtggcaggagaactggtggagtgcataccagtgcctccctcctccctttctcctgcaagctcatatacgcatgcacacggaatacgagcattcacacatggaatcaccaaatcctaccacttatttccttatgagcttcctccctcctagatcagcctttccattccttttttctttttttaatcatcctttcccttcctactgtcactgcacccagtaaatttcagcgtgcattcaaaatcaacgagagtgcctgttacagacaggttccttgacaataccaggtgttggcaaggatgtccagcaagtggaactccctcacattttgctggtgggaacgtaaactggtaccacttgggaacactgttcagcagaacatgctaagagacacatcctctgacccagtcctttatttaacttctaggtgcacagcccagagaattaagtgcatatatttaccagaagacatgaccaaagccattcctggggttgccttcatgtagccaacatctggaactaacaccaaagttcattaggcacaaaataaaagagttatctggaacagagtcctccatggaataacacgtcataaacaagaacaggctggtcacggtggctcacgcctataatcccagtattttgggaggccaaggcgggtggatcacctgaggtcaggtcaggagttcaacaccagcctgcccaacatggcgaaaccccatctctactaaaaatacaaaaattagccaggcatggtggtgcacgcctgtagtcccagctactctggaggccgaggtgggagaatcatgtgaaccctggaggcagaggctgcagtgaggtgagattgagccaccacactccagcctaggcaacagagaaagactctgtctcagaaatacataaataaataaataaataaataaataaataaataaataaggccaggcgcagtggctcacgcctgtaatcccagcattttgggaggccgaggtagggggatcacggggtcaggagatggagaccatcctggctaacatggtgaaaccccatctctactaaaaaaaatacaaaaaaaaaaaaaaaattagccgggtgtggtgatgggcgcctgtagtcccagctactcaggagaatggtgtgaacccgggaggcagagcttgcagtgagccaagatcacgccactgtactccagcctaggcgacagagtgagactcagtctcaaaaaaaacaaaaacacaggctgggcatggtggctcatgcctgtaatcccagcactttgggaggccgaggtgggtggatcccctgaggtcaggagttcgagaccagcctggccaacatggcaaaacccagtctctactaaaaatataaaaattagctaggcatggtggtacgtgcctgtaatcccagctaatcgggaggctgaggcaggagaactgccggaacctaggaggcagaggttgcagggagccaagattgtgctactgcactccagcctgggtaacagagtgagactccatctcaaaaaaaaaaaaaaaaaaaaaaaaaatagaacaactgctgcctgtgaggataaatgaggataaatttcacacatgatgcacacaattgcacagaggactgtaatcccagcactctgggaggctgaagcaggtggattgcttgagcccaggagttcgagaccagcctgggaaacatggcaaaaccccatctctacaaaaaacacaaaaattagcagggcatggtggtgagcacctgtagtaccagctacttgggaggctgaggtgggaagattgcttgagcccacaggaggtcgagactgcagttagccgagattgtaccactgcactctaccctgggcaacagggcgagaccctgtctcgaaaaaaagatggcacagagtgtgattgcacagagattccaaatgtctcggctggccatggaagtcagaagagtggtgcacagtttgccctggctgggtgcagatctggggagtatcaacagttctctggtggcacactcaagattggaagtatgcgtgtcgttcactgtgatagggattatacctcaatttaaacaccccatgaaataagcaagagctctgagcctgtgcctcaggaccctgccctgttctttggttggcctgaatgcctactacagagcacttggcagggacttctccctcacacgaatcaaagcagactgacagcacttgcaggacgtatggtgacccaccgaggcttctgaggacgaaccctgagttctacttcacaacaggggctctgtctcacacatagcagactcatcacttcctcaaaggtcatgtctgatgaggaggactgaaaggaagcttggaaagagcaaagaacagaagagaagggcagcgggcacgtgggatgagtcacttcttaacctacaagcactgctttcacccagcccccagagcccaccaacataagaagaagcaaggggtacgtaggctgggaagaacagaagttccaggggtgggggccttgctggtcccctgcctttggcccagatgtccctcattccccttcagccctccagctcacacttcactcttgtgtgagcccctatctctcccccagattcataggcagagctcagagaagctgctggggccaaggattaaaagtgaacaaatcctgccaaagagaagggctagttaaaaaaaaattaaaattaaaaagacagaaacaaataaaaggaaacgaagcccagaaggaggaggcccccagggagtatgggaagatggtaaaagtgagaatgagctggtgaatcccagggaagaggatgcctgagtgcttttactgtccttgcaactctctgtacatttgaaatattctcaaaataaaaacctcaggccggatgcaatggctcacgcctgtaatcccagcactgtgggaggatgcggcaggcagatcacctgaggtcagaagtttgagaccagcttggccaatatggtgaagccccatctctaataaaaatacaaaaattagccaggtgtggtggtgcaggcctgtaatcccagccactcagaaggctgaggcacaagaatcacttgaactcggaaggcggaggttgcagtgagccaaggtcaggccagtgagccgaggtcaggccactgcactccagcctgggcaacagagcaagactgtctcaagaaaaaaaaaaaaaaacaccctcaaaataaggagacatggggcttggaaagaaggtaaagcatcttctccaaggactcactgccctaaataacagagttattgtacctcaagcccttaacccaatcacagggcctctattaacagccctgcacctagactagaaagagagtcattactaaagttgaggcgaacatctcccttatggggtgatggtttagaggtaattatgccttggctgctattctattcccctctgttctctagcctgtactcccctttgtctttaaataaatgtctcagggccaggcacagtggctcacacctgtaatcccagcactttgggaggcggaggcagcagatcgcttgagcccaggagttggagaccagcctggacaacatggcaaaacccttactctacaaaaaattacacaaattagccgggcatggaggcacacacctgtggtcccagctacttgggaggctgacgtgggaggatcgcttgagcccaggaggtggaggttgcagtgagccacaatcacgccactgcacttcagcctgagtgacagagtgagaccctgccaaataaacaaacaaataaatgaatgtctcaaaaagaaaatcaaccatcacaagctgtgagggaaaaaagttcaaaatgagaagttcagaacggtttaggcagcactgatggacaaaaccatggcaggctttaattaaagccagcactgctttccacaaccctacatataattattatgtacttcatctaggccaagatattgtgctaagaactataagagacatagagctatgagtccaggtcccacactcaaggaatttccaatgctgttggcaaggcaaaaaatagttaatctgttcagttcgtgtcaggatgcactcaatgagggctctggagccaccacaggctgagctaaccatcaggggtcatctggaggggatgaagccaaggtcaaagcttcaccagggaagagggtcacagagacagaggaagagccagacactacagcatccagaaagggcatggtgtggcacaaagctctcgtgccaacatgaagaaaggtaacttggaaggacagtatcaaactgaaagggaaagggcctcaagctcccttgcagggatggaaaggatggaatcatcctgggaaggctggtctggcattgagggcccaggtgagagaagtcaccaggcacgcaagcctgggcgacagggcgagactccatctcaaacaaagaaaaaattaaaatcattcataccagttaaagacatctgtttaataaaactcagcctgtaccacgcatcctgcttggtaacaagcgcttgtcgatgttgacgcattatggcagtccctcacgtcaatgtcaacagcagcacagagcccatcacctgcagctacaactctaaccaagctcccactgttggtctgtttcacaaatcccactcctgagacaatgatgcggcaatgagcaccctcatcaccatcaggctttgaatactttcctgattgcgcccttggaggaaatcgacatttttaaggtactgggataaacagtattgccaaaaggccttccagaaaaaaaatggatctaatttaagtgcccccagctgagctgactggttgcatcttcctgtggtgtttctgccatctctacctgaggtgaatgtcccctcaggacagcccccatcaccatagcagctgaaatgggcctgcagcagtactcaggaaactggcactggacagatctaggaatccccctgctacagcagtcctgagaggcaggaaatgattgattcaagctcctgccctgacgagttcagactaggaggagataagccttcaaacaaaccaagtgcaacctggaaactcctcaccaagcctgtgaaaagagcagcggggtgggggcagtgaaaagagcagggtggtgggggcagcagaaggcccagtctccttggagaacggctgcactgctcagccacgaaaaggaaggatcttttaggtaggcaaacaaactggacacagagcagggagtaagaactgagattgtctgaggatccactgccagcttggtatgatggagcacaggtcaaggaactggcaggcaggtgcagacactgcacgaaggatcaagactaagaacagaatccacagacagtgggcagccactaaaacagtctgggcatcaaaataactggggatggccaggcgtagtggctcatgcctgtaatccaacactttgggaggcaaaggcaggaggctcacttgaggccaagagttcaagaccagcctgggcaacaaaccaagacctggtctctaccaaaaaaaaaaaaaataagaaaattagccagcatggtggcgcctacccttagtcccagctacttgggaagctaaggcaggaagatcacttaagcccaggagttggctgcagtgagctatgattgtactgctgcactccagcctgggcaacataacaagaccctttctcaaaaaatagtaataataattgtgtggaggtcaagtacatgagacaagagttgataatcactgaagcagagtggtgcgtatatggacataggggtctttcttctatttggttttatgatttaaatttttcattttgaatttttaaaaattcattaaaattccttaaaatgtttgccctccagatatttaacagaaattactgtcctaaggaatgctttaaaggaggctagtaccccacagccctgccatgatagtggcagggagataatcacgtggtcatggtccttcctacctcgggatgcccagcatgggtccttgactggccacagccacagcatcacaaacaccagtaatagctggaagacctctggtcagggtggatgtcagggcctgcaactgtggtaggcatgtggggtcacttacaaaagggacctggtagggctgggggttaaggtctggggggtactggttggcagaggccaaagatcaaaaggggcttgctggctggctcttcctctgctgttagggtccaaaaaacaaaaacaaataaaaggggtttgtctgtcttgtcctgctgtggttcagcaaccattcatttatttacttatttattattattattattattattatttattgagacggagtttcgctcttgttgcccaggctggagtgcaatggcgtgatctcggctcactgcaacctccgcctcccaggttcaagcaattctcctgcctcagcctcctgagtagctgggattacaggcatgtaccaccatgcccagctaattttgtatttttagtagagacagggtttctccatgttgaggctggtctagaactcctgacctcaggtgatccgcccgcctcagcctcccaaagtgctgggattacaggtgtgagccaccgcgcccaacctacttatttatttttaattttttttgtttgttttgagacagagtcttgctctgtcaccggctagagtgaagtggcgtgatcttgactcactgcaacctccgcctctcaggttcaagcgattctcctacctcagcctcccaagtagctgggactacaggtgtgcaccactatgcctggctaatttttgtatttttagtagagacgaggttttattatcttggccaggttggtctatatattttttttttttgagactgagtctcactctgtcgccaggctggagtgcagtggcgcgaccttggctcattgcaacctctgcctcccgggtttaagcgattctcctgcctcagcctccccaccgggactacaggtgcccgccaccatgcccagctaatttttgtatttttagtagaaatggggtttcaccatgttgcccagactggtctcaaactcctgacctcaagcaatccacccaccttagcctcccaaagtgctaggattataggcgtgagccactacgcccagccttcgtaaactttattatgagattttttggcaattttttttttttagctcgtcagctatcattagtgttagtgtatcttatgtgtggcccaaaacaattcttcttcctacatggcccagggaagccaaaagactggacacccctgatttacaacatgtagagtaactctaagcagcagtggcctctcctctaggtctcattttcctcatcttataaatgtgagtaacatgtacatctactgacaaagaaagcatgaagaggggatgagtcaacatctgtcaactcctgcaacagggcttggcatagcatgcctgccgcacgtcagctgctgttgagaaagccctgaactcctgagcagatgactgagggctcaagtcccctcaggtcactgtcacgactggcctagaggctcaacaaccacttcctatttgcccatcaggagcagccctatggggcactggggctatgaaagtgaagagagggacagacagggcccctagcctcaaggaatggacattctagcaataggttatacacagacacctgtaagccagtgcagccatttatgtgacaaccaggctatgaagctggaaaacaagggctggagctgcaccagaagggcacagagctgtgagtgggaaaagccacagaaaaagctccgccaaggctgactcactggcttctgcctatggcacgaccatgacccacaggcagaatctgggcttgcaagtttaagggcactccctatccttctgaagacctctccagacccttggaagttgctgttcagttgtatgttttgttccttgtgttgtcttacttggagctcacgtctctctggaggcttcactagaagaggtggctgacctggcagttccagctccattccatgctccccctaagccccttctggcacttcatcagatactggactgtccttccccagctgtgtcacctcctctctgtattgttttgcccaatggacatctatttatttcatctttatatgtgcaatctgctgtacagaggggtgggagggataaaagtctcaagaataggatcacagaaaaaccaaaaagaattgaaagaaaatagctgataaggtccttttgttcattcacagcttaaatattttctacaaacctgtatgacaggtgcagcactagtcattgcagatgcactcttgttctctgagagcctatagcccagagacaggctcaacattaacccagcaatcccatgaggaaggtccaagccccaaaaaggccagttaaattggttctaagggtggcttatcctgcagtttctgcagggagagtagatgttcaataaagagtcaacaaaggcaagcacggtggctcacacctgtaatcctagccctttgggaggctgaggcaggtggatcacttgagcccaggagatcaagaccagcctgggagacatggtgaaaccctgtctcttacacaaaatacaaaaattagctgggcctggtggcatgcgtctgtagtaccagctacttgggaatgctgaggtgggaggatcgcttaagcctgggagccagaggttgcagtgggccaagatcatgccactgcactccaacctggaggagagagcaagattctgtttcaaaaaagaaaatgccaacatgaagctactaacaatttcccaactacctccccacaggctccaataagggtcatcaatttccctaaccaggcttggggtattggggtatcacccttattctccaagactatagatctcctactcctgcaagggcacaggaggtggtggcagggagctcaccactgagtcccaagacctctgcaaaggcttgtacagaggtctcttcatttttcccttctaccacacctgtaaaacagattggctttctaccatttcattgatgagggacacgattaagaaaggctaggccaggtgcagtggctcacgcctgtaatcccaacactttgggaggccgaggcaggtgggtcatgaggttgggagttcaagaccagcctgaccaagatggtgaaaccccgtctctactaaaaatacaaaaattagccaggagtggtggcgggtgcctgtaatcccagctactctggaggctgaggcagagaactgcttgaacccgggaggcagaggttgcagtgagctgagatcgcaccaatgcactccagcctgggccacagggcgagactccgtctcaaaaaaaaaaaaaaagaaagaaaaagaaaggctaacaagtgtaacaagtggagaaagcaggggctccagagcttcacaatgtacactggttcaggtaaagaataccactgcactggagaatcacttgagtccaggagtttgaggctgcagtgagctatgatcataccaactgcactccagcccaagtgacaaagcaagaccctgtctcttaaaaaaataaaaaaataaagaataccactgtaatacaagaggtgacccggccgggcgtggtggctcatgtctgtaatctcagcactttgggaggccgaggcgggtggatcacgaggtcaggagttcgagaccagcctgaccaacatggtgaaaccccgtctctactaaaaatacaaaaattagctgggcctggtggcgcatgcctgtaaccccagctattcgggaggctgaggcaggagaatcgcttgaacccgggaggcagaggttgaaggaaccgagatcacaccattgcactccagagtgagactctgtctcaaaaaaaaaaaaaattagctgggcgtggtggcgggcgcctgtagtcccagctactcaggaggctgaggcaggagaatggcgtgaacctgggaggcggagcttgcagtgagctgagattgtgacactgcactccagcctgggcaacagagcgagactccacctcaaaaaaaaaaaaaaaaaaaaaagaggtgactcacacagcccccaagaaaatactattccactcctcaacaagtgttttgtataccaggtaccaagcttcataggtatgaggtcctatgggaaactaaaaagggctgagataaaacatatcagaggcggtgaccaactttagatcaagcagggaaggatcctctgagtatctgatactgagcagacacctaaaagaaggagctagtcatgaatacagtggtggggaggagtctactcatttttcaataccttaaacacttgataataaattggttaaaaagaaagagctcaggggccaggcatagtagctcacatctgtaatcccagtgctttggaaggctagtagggaggatcatctgaacccaggagttcaagaccagtctgggcaacatggtgaaacctcatctctacaaaaaatataaaaatcagtcaggcgtggtggtgtgtgcctgtagtcccagctactcagaaggctacagtgggaggatcgtttgaccctgggaggtcaaggctgcagtgagctatcatcgtaccactgcactctaacctgggccacagagcaagatcttgtctccaaaaaaaaaaaaaaaaagcttagaatgttcaagaagctgaaagaccagagaggtcagaacacggtgggggtaggagaagagatgactataccaggtcagggtgaggggctgggagggtgggacatctggagttttattctaatgctaagaaaagtcactgattgttctgcagcagggcagtggctacactttaggcctcaccctcacttgtgctgttgggggaagaaggatgggactgggaagagagcaggagaccacagcccagaatgggcccagatgaggtggaggcagtggagggctaagaggctgaactggagagtccctgcaatggctgtctagtcatagccagcctcaactcaaaatccctttttctcagtgggagccaggagactagactatataccagctcatgctctggggcattgttccctaggctcttggtagagacagataagtaaccatcaaatgttttcttctctgtcaaaactcagaatgctttttttttttctttttttgagaagggtcttgctctgtggcccaggttggagtgcagtggtgtgaacgtagctcactgcagcctcgacctcccaggctcaagcgatccccccacctcagcctccagagtagctgggactacgagtgcacgccaccacacccagctgattgttgtatttgtttatgttacctaggctggtctcaaactcctggactcaagtagtcccagatctcagcctcccagggtgctgggattacaggtgtgagtcacggtgccacaagcaagacactttctctatcccttcatcaactataaattacttgggtataaagcatttcccaaaatggccaaatttaaacaacagtgtaaaaacatgggaggaagttaagagttaaaggtatgtctagaattctaatgcaaatctttttttaaccctatgagcacaataaatcaaggcaccaagaatcacgactttcaacgtgaaccctagagagaaagtgaaccctagagagaaaacagacaaatttgagaactgagaacacccacatcacctagggaaggcaacctctgaaactgctcttcccggctgtggtaggagaatgcccatctcgtgcctaatccctagaacttgtgaatatgctacattacatgtcaaaaggaattctgcagatgtaattaaaattacaaactttaaaataaagagattatcctggcttctctgtgtgcactaaatctaatctgagccctgaaaagcaggatattttctctagctgaaatcagagagatgtggcagaagaactggccctcgctggagggagacacataaaaagcatgagaaggaattcgggcagcttctgggaacaaagactgactcctggctaacagccagtaaggaaagagggcacctcagtcctacaagctcaaggaactgaatatggccaacagcataaatgggcttgcaagcaagttccaccccaaggcattcagtaagaaatgcaccctgccaacgtcttgatttcagccttgataggccttgatagcaggagacctagtggaacctacttggacctctgacctacagaaactaccaaatgataaatgtgtgttttttgtttgtttgtttttgagatggagtctcgctctgtcactaggcgggatagcagtggtgcgatctcggctcactgcaacctccgcctcccgggttcaagcaattctcctgcctcagactcttgagtagctgggactacaggtgtgcgccatcacacccagctaatttttggatttttagtagagatagggtttcaccgtgttggccaggatgggtctcagtctcttgacctcgtgatccgcctgcctcagtctcccaaagtgctgggattacaggcgtgagccaccacacctggctaaaggtgtgttgttttaagatgctaaacttgtggtaatttgttagagcggcaacagaaaaacacacaaacagcaatatcgaaaaaaataaagaactcaattctcccggaagcaaaataaagctgagttatgaagtatccagtcactcaacacccataaactcttcaatcaccctcccagccctcttaacacttcccctacccccattttctttgatgacaactcacccttccagttcttaattctgggctttcccagagaagaacccttgccctggggacttttcttgcaggaaccctgaagtgggatatctctcaagttttcacctacagataactatattttatcagtaaaacactgttcactgattgtgcaatatccccagaaatatcccaaggctattcttcccaaagcccatagctactaactctacagtccctactctttccactgtactgaaaggtttcccagcattcagcccggcttccttccttccacaatgcttcaccccacaccccacccccctccatccagttagtcatcaagaattgtctacgttccccctcctctggaatctgtcttcctctttcagtttctaccactgtctaatgcaggcctttataatctcccgcccgactaggtcatgccacaatcattttacggagcaatgtggcaggcagtgagctagcagtgagaatataaggatgaaaaaggacaggttccctactccctccaaatgttcaaactctcttaatagcttaactggtctctcttctctgccctgcatccatctccagggacagggactctaggcatattcccaacactggcatttcactactccaaagaatgccacatgccaaacacaggctcaattccttggcacaacacccccactaaagtgctagtacctgctcaccctcattccatcatctcctgggctctcttactcctcgagccccagaactctcagcctacaagatcctccctccacgcagtaaatgctcatgtttcctaactcctcagcttggaatggtggctattcacactcctacttgtctttctaggactcaatttattcgtcacctactcactagactgcccctggtctgctcaagttaaccgccgcttcgcaagaaacccctgcagtatacacattacagactgacaagactgcgctgtgacggttcctttaccatccctcaggaaaggggctgtgtctcaggcaaatctgtggcgagcacaacacgccaataagctcagttaaaaactgtcaggcctctgagcccaggccaggccatcgcatcccctgtgacttgcacgtatacatccagatggcctgaagtaactgaagatccacaaaagaagtaaaaacagccgtaactgatgacattccaccattgtgatttgttcctgccccaccctaactgatcaatgtactttgtaatctcccccacccttaagaaggttctttgtaattctccccacccttgagaatgtactttgtgagatccatccctgcccaccagagaacaattgactaattttccattaccttcccaaatcctataaaacgaccccacccctatctcccttcgctgactctcttttcggactcagcccacctgcacccaggtgaaataaacagctttattgctcacacaaagcctgtttggtggtctcttcacacggacgcgcatgaaaaaaactgctaacagaaacaagcagtcggtggtgaggggctagagttcctctgagcggggccactgaccccagctcttcacgctctcctccagaaacgacgatcgcttcctgacagcggcttcctgccatccttcggcaaagtccacattccttcggggggtcaccctcagatcctccgtcccaccgcccacaccccaaacaactaccttcccaatctcatcttacatccaccctcctcccatcactttctttcaccgttgatgcgcttttctggaagagaaaccatgaagcacccagccctgctaaacccactacagccggctgcttctctccctttccctattcagtgtggttcaaaaagcgggggaaagtctgcacccaaagcacacaaatgacgaatgagaaagctcaagacgatgattcataagccagggctcgttggtttgcagagctcggccccaggaaagcaaacgagcagtccatgtcgggaacggaggggacagacgggggggcccgagccctgggacccacgcaagtccccggcgccttctgtctcccggcgccgtaggtttctcacgggtccggccctggcctcgcccgccacgctaaggaggaaggtcccacaatccagccccctgccccgaccactactcacatttgactgaccagcttctgccggaaggcggtgctccgccagtcggtctcttgcccggaaacgtccatgcctgttccccagctcccgccgcccgtatcccgcttggccgccaccgccgccgcctcagtcacagagccaggcccaaacccggaagccgtccgcagtgcctcggccgagccggaagtgaaggagggcttgtgggaaatggagtctcgcgcacaggcttgtgggaaatgaagttccccgccggggacgaagcggtctcggttccgcccggctgggagacacacgcccctcttccagtgcagctgtcggacacggcaggtgctcccgcagcagacctgcgcctgaccgcctgcattttctgcaactcttcagtgtgctggccttatctagtccctgagatccagacccctccgggatgccaggccaagctgccagctatctatagtaatgctagggagagagtgtttatttatcaaatatgtgtgggtacctactgtgtgccagtgcaacgtgatctgggatctgctttcatgcaactgcctgctagcgccgcatccgaagagcgaccagatggactctcatcaccgcttcactcttcgattttttgaatctcacatctcacaatggctgtatttgggggttgggaatgtgaggcccctaaaccacgttaattaatttttagacatgggctttcccttttgaccagcagccacgtccccttcatggagaactcagcctagctagttgctggaggccagatgtcaaacgaatttgataggtgaaggtgagcgagctgaaggtgggatgaggggttatgggggcctgagaatgcttttaggaatgtaaaagttctgcctccttggaactatggggcctttatctgctaccctggggagggaggtgacgtgaggaaaatctggagcccaagtggtcaataagcaccaggtggacaccaaccaacatgggcctcaggagactgtggactggcacctactgaagcctaagtgccaggcccctgctaggcactgtacaccccttacaccccttgttactgtgccccagacaggaggttgaaggtggtagagagtgggtgggagaggagtgagcactctccccaaagaggcctctcttgccaacagagtttcatgtcttgtgttgatgtgagagctgttcatgttttcaaacgttttctgctctaatactcccaaaatcgttattgttttttttgaggggggggggatagaatttagcccttgttggccaggctggagtgcagtggtgccatctcggctcactgcaacctctgtctcccgggttcacgcaattctcccacctcagcttccccagtagctgggattacaagcgtaccccaccatgcctggctaatttttgtatttttagtagagacagggtttcaccacgttggccaggctggtctcgaactcctgacctcaggtgatccacctacctcggcctcccaaagtgctgggattacaggcatgagccaccgtgcccggtggcaaaactaattttttttttttgagatggagtctcgccctgttgcccagactggagtgctgtggtgacatctcggctcactgcaacctctgcctcccgggttcaagtgattctcctgcctcagcctcccaagtagctgggattacaggtgcctgctacgaagcccagctaattttttgtatccttagtagagacagggtttcaccatcttggccaggctgaaaactaatttttaaaaactctatctagagtgatcatcttgaccggggttgcccaggacatccaaggttttagtgtttttttccttgttttattttgttgttgttgtttgtttgtttgttttttgagatggagtcttgctctgttgcccaggctggagtgcagtggcacaatcttggctcactgcaagctccgcctcccgggttcacgccattctcctgcctcagcctcccaagtagctgggactacaggcgcccgccaccacgcccagctaatttttttgtatttttagtagagacagggtttcaccgtgttagccaggatggtctcgatctcctgacctcatgatccgcctgcctcggcctcccaaattgctgggattacaggcgtgagccaccgcgcccggcccttggtttttttttttttttttttttttttttttttgagacagagtctcactctgtcgcccaagctggagtgcagtggcgcaatctcagctcactgcatcctccgcctctcaggttcaagtgattctcctgcctcagcctcctgagtagctgggactacaagcacctggcaccacatctggctaatttttgtatttttggtggagacagggtttcaccatgttggccaggatgttctcaatctcctgacctggcgatccacccgccttggcctcccaaagtgttgggattacaggcgtgagccaccacgcccagccttgttttctttttttttgagacagagtctcgctaggtctgccaggcttgagtgcagtggcgtgatcgcttactgcagtccccgccatccggggttcaagtgattctcgtgcctcagcctccccagtagctgggactacagtgcgccaccacgcccgactcatttttgtattttattttattttatttttagtaaagatggggtttcaccatgttgcccaggctggtcttgaactcctgacaggtgatccgcctgcctcggcctcccaaagtgctgggattacaggtgtgagccaccgtgcccagccccaggtttaagttttgaaagtcctgtgttctggctgggcatggtggctcacgcctataatcccagcactttgggaagctgaggcaggtggatcacctgaggtcaggagttcgagaccagcttggccaacatagtgaaaccccgtctctactaaaaatacaaaagtagccaggcatggtggtgtgtgcctgtaatcccagctactcaggaggctgaggcacgagaatcacttgaacccaggaggtggaggttgcagtgagctgagattatgccattgcactgcagcctgggcaacaagagcgaaactctgtctcaaacaaacaaacaaacaaacatgttaataggatacttaggacaaccctcccccttctgcactatggttgatggagacacagacacataattcacagacacagacagagagaggcctggaactttgccaggagtttatcatcacagtaaaattgagtgactattccctttggtattttccccagagctctttttctacttgtccccgcattgggttggtgcccagggcagtgatccctggtgacagtctggatgggtgacctggaaaggtggaccaaggaaagtaaggggccacaggaaggttgatcctgaagtggacttgccctctcttgacactgtagaccctcctgggatccccagtctggatgttagtggtttagatgtctgagaataagtgatggaggaagccgagggtatgcagaggccagacctgcatcccacactatgttctggggatcctcatctcgggggagatcctcactgctcatgtggccatgtctctagcctgcgggttcctgcaggctaccatgccaaggctggttccactcaatggccacatatttcctggacaccattctgggctctgcaggaggtaggagctggaagcttcccaggcagatcaagcttccccctagagagctcagcacaagctctgtgagcctgtggctgtctccatacagcctcacctccaatcttcctccttgctttggcactcagtccctgggaggtggtgacctgccccaccttccatcctagcaccagccagatgtaactcctctgtgtgtttggcctggagcctgtaatcacttatgtatgtggaggtagggagggagtggttattgtttcttttttttttttttttgagatggagtctcactctgttgcccaggctggagtgcagtggtgcaatcttggctcattgcaacctccagctcctgggttcaagcaattctgcctcagcctcccaggtaactgggattacaggcgcacgccaccatacttggctaattttttgtatttttagtagagatggggtttcaccatgttggctaggctggtctcgaactcctgacctcaaatatccacctgcctcagtctcccaaagtgctggattacaggcatgggccaccgcgccaagccatgcaattcattttttttttgagacaaagtctcactctgttgcctgggctggagtgcagcagcacgatcttggctcattgcaacctccgcctcccaggttgaagcaattctcctgcctcagactcccaagtagctgggattacaggcttgtaccaccgtgcccaatttttttttttttttttgagatggagtctcgcactgtctcccaggctggagtgcagtggcacgatctcggctcactgcaacctccacctcccaggttcaagcgattctcctgccccagcctcccaagtagctgggattacaggtaggtcccgccaccacacctggccttactttttatttttagtagagaccaggtttcaccatattggccaggctggtcttaaactcctgacctcaggtgatccgcccgcctcggcctcccaaactgctgggactacaggggtgagcccagccgcaattcatttttattgcacattttgctcttaggttggattgatagttttattatctttaccattcagtagtgataacataaaacttgtttgactagtccatcaattttcttttttgaaacggagtcttgctttgttgcccaggctggagtacagtggcgtgatctcagctcactgcaagctccgcctcctgggttcacgccattctcctgcctcagcctcccaagtagctggggactacaggcccatgctgccacacctggctaattttttgtatttttagtagagacagggtttcaccgtgttagtcaggatggtcttgatctcctgacctcgtgatccgcccgccttggcctcccaaagtgctgggactacaggcctgagccactgcacccggcgtagtccatcaattttcaaactagctttatttactaaagaatattccagatcatgtaaactaaaaagcagttggattagtttctatttttcttaaatttttggtaatatttagcttgtatgaatgcttatttacctccctctaagaccaataatccttttaagacaccacagacaaaagagacatcttcaaaggagggtacaatttgaatataactcctttaagggatttaaaaaatttaggctgggcgtggtgactcatgcctgtaatcccaggactttgggaggccgaggtgggtggatcactaggtcaagagatagaggccatgctggccaacatggtgaaacctcgtctctactaaaaatacaaaaattagctgggcatggtggctcgcacctgtagtcccagctactcaggagactgaggcaggagaattgtttgaacctgggaggcggaggttgcagtgagccgagatcatgccactgcactccagcctggtgacagagtgagactccatctcaaaaaaaaaaaaaaattcagttagtaatactgaatatggagatagaaaaaatattatatataatattcaaacatacatacatagatatacacaaatataaacacataaacgtaaaaacacaaagatcttatagctttcattccaaaatggtagtcgtgagtcagtaaaacacagtaatacaaactcactggtttctctctctctctatatatatatatatgtatgcatacatatatacacgtaaatacgtatatatacatacatatatatttttcgagatggagtcttcttgctctgtcgccaggctggtgcagtggtgcaatcttggctcactgcaacctccgcctcccgggttcaagcgattctccttcctcagcctcccaagtagctgggactacaggcgaatgccaccacacctggctaattttttttgtatcattaggagagacggggtttcaccatattggccaggctggtcttgaactcctgaccttgtgatctgcccgcctcggcctcccaaagtgctgggattacaggcgtgagccaccacacctggcccccagaaaaagacttttaaaagagtattcatttgcccagtttccaaacagtttcattttttctctttttatccttaggtggttgtttttgcaggattttgagtccctttagggcagggagccctaatgtttaagtgactgaagtgctgaagtggaaaaagttctggcaggttggatggagggccagagtggcctgaatggggacgtatcaaaggaatcaaggaaactggagaaaatatcgaaggtggcaaaaggaggaagggggagcagaagcaaatggaaaggagaaatctcagaggggcctgtttggggagattgcaagtttcccaaagaagccaatgaagttgtcctttatccttagcaaaaatcatggcaatacagaaaagaagcaggaggcagagccgatagagggcagggactccggaagaggggcttcagggaaccaagaagaccccaggggagaagcaggatccaatagacagaatatcaacttctgattacgccatcttcttttttgttttttagagacggagtctcactctgtcgcccaggctggagtgcagtggcgcaaccttggctcactgcaacctccgccctctgagttcaagctattctcctgcctcagcctcccgagtagctgggattacaggcacctgccaccgcgcccggctaattttttgtatttttagtagagacggggtttctccatgttggccaggctggtcttcaactcctgacctcgtgatccactcaccttggcctcccaaagtgctggtattacaggcgtaatcccagctgggcactgagccactgtgcccagccccacttatgccatcttctgatcatagagctgtaaaaaaaaaaaaaatcctttcaaatatctcattgtcagttttcagccagaacagatagtacatattcctggcagtactgaacactcttccctactaccaccctgcccacccaccacttttcttcttgtaaaccaaaggtacctaccaagcaactcagaaccaagaccaataagcattttatgacttaaccatggacaaaagagacatcctcaaggctgggcacaatggctcatgcctgtaatctcagcactctgggaagtcaaggtgggaggaccacctgaggccaggagttcctgatcagtctgggtgagactctgtctcttaaaaaagagagagagagagagagaaagacacactccaaagagggtgcacaaagattcagcactctcaaatccagaccccttgcaaagacagtcaaaagaaagaaggcacctttgggttttttttttttttttgagacggagtctcgctctgtcacccaggctagagtacagtggcgcgatcttggctcactgcaacctctgcctcctagattcaacccattctcctgcctcagcctcccgaatagctaggattacaggcatgcgccaccacacctggctaatttttttgtatttttagtagagacagggtttcaccatgttggtcaggctggtctctaactcctgacctcgtgatttgcctggctcagcctcctaaagtgctaggattataggcgtgagccaccgtgcctagccagaaggcacctttgttgacacaggtgactaaggatgtcatcttgtacagaacactgtcacgtctccagtcatggactggctcatctatcacaccaatgaatactgagacaacaaaaaccccttatagacttggcccacttacaaactcctctgtcatggtcagaaaaagagaaggttcagaaccttctctttggccgggcgtggtccctcatgcctgtaatcctagcactttgggaggctgagacaggtggactgaggccaggagttcctgaccagcttgggtgagaccctgtatcttaaaaataaaagaggccagccacggtggctcatgcctgtaatcccagcactttgggaggccgaggtgggcagatcacccgaggtcaggagttcgagaccagcctgactaacatggtgaaaccctgtctctactaaaaatacagaaattagctggcgtagtggcaggtgcctgtaatcccagctactcaggaggctgagccgagatcccgccattgcactccagcctgggtgacagagcaagactccgtctcagaaaagaattaaaaaaaaaaaaaaaaaatcaccctgcgcaacatgatgaatccccctctttactaaaaatacaaaaaaaattacctggacgtggtagtgtgtgcctgtagtcccagctactcaggaggctgaggcagaagaatcagttgagcccaggatgcagcagttgcagtgagccaagatcatgccaccatgccactgcactccagcctgggcgaaagagcaagactattaaaacaaaacaaaaaacaaacaaacaaacaaaaaccaaactttctctttttctgaccgggacagaggagtttgtaataatgcaagctgttacttgcaaccctaacgcaagctgtcctaaagcaagctgtcacttgcacccactggctattcagagatcagggagaatattctcactggtcataaagccaagctctcaggacacaaataaaacaaacaggaaagaggtagctgtgcctgggaggaaaggatcaataacaaacagttacccctcaaccaaatttaagcaagagtcacaatccagacacaatgttttcttctgctaatttgaatttggaaaggaagggacaagaagtttttaccttccactctcagctgagtactacaggcagtgatatgggacagttaaccttggtaagaatgcttaccttttgccagttgtcccaagtggggtgtctttgccaccccacttgtttgttgggtgccagaaagagtagggggaaaaggtaatattttttcctcacgcatcacaaggttcctggttgacacccctctaacaaaggacagattaacaagagaaaagcatatcaatttatttaatataaattttatatgacacagtagccttcagaaaaaagccccagtgtctagtgaggggtccgttctctgctttttttttttgagacggagtcttgctctgtcacccaggctggagtgcagtggcgcgatctcagctcactgcaagctctgcctcccgggttcacgccattctcctgcctcagcctcccaagtagctgggactacaggcgcccaccaccatgcctggctaattttttgtatttttagtagagatggggtttcaccatgttagccaggatggtcttgatctcctgacctcatgatcctcccacctcggcttcccaaagtgctgggattacaggcgtgagccactgcgcccagccgattctctgccttgaagatggtgcttattacagtgtcctcacctggcaaaagtgggggatgagctccttcgaacctcttttatacactgatcccatggtgaggacttcaccctcatgacctaaacccctcccaaaggccctactttataatagtatcgcactgaggattcagttccaacatatgaattttgggggtaccgacattcagaccacagtggccttcttgttgctgccccaggattccttttcctctcctctctgggtccacccgtacacctggtcccattgggccttggaggtcagtcttcccctacctggagccaaggggggcctcatcttcccccagacctgctcttgctctggctcccctgtaggcagggtgggcctacttccccacccatctcctgggctcattcttcacacatcactgggcttatactggggaacctgcttccttcccaggtttctagcctgctccactctggtcttcactccctgcctgagaccacagcactgtggctggctccctactcagtcttcgtctctaccatattggcatctgcccaccctggctacagggtgccctcagggctaagtcaagcctccaaagggcagggtctgctctccaaccttcccttcaggctcagaaaattctggaaacctccacaccactcactttgaaggatctcacctccacgtttgctgacactgtcggcttcctggaatgcttttcttaatcccaaagtcctcctctgttacacagtaggggggtctcctccagaaagtctttctaggaggaagcccactcccatttggaacctctgcctctggaggccaatcccgttctcttgatccttgtctgggaccctcagttatctctctggactcagccaggacagcaattctcttccgtgtattttcctccttttacattccccttccaccaatttttttttttttttttttttttttttttgagacggagtctcgctctgtcaccaggctggagtgcagtggcgcgtgatctcggctcactgcaacctctgcctcccgggttcaagcgattctcctgcctcaggctcccgagtagctgggactacaggtgcgcgccaccacgaccggctagtttttttgtgtgtgttttggtagagatggggtttcaccatgttggccaggatggtttccatctcctgacctcgtgatccgcccgtctcggcctcccaaagtgttgggattacaggcgccagccaccaagcccggccccacctttctttttaaccatgagccatctccagccacatcctccccctaccactctctccacccttcacagtccctctcaaaaccacagtgtgggacactccaaccttatcccatcaggaggctctgtggctccaagctctgggcgcagccattacggatacgcctcggaggatgggacctgctcgaaggtgaggtggagaacaatgaatgccaagacccgcgcacggacctctgggaccaggctttaagactgggaattagatttactgcaaaatctcagtaaaggaacgggcacacaaactagcacctgttcactctggcggtgttaagcgattctccccgatatcccgcagggggcgcgctacggtcagcggcaccgaccgcggagggagcggggaaggagcaggccgcgggagggagggaatgagcgcgtgacgaagggaacaagtggaggagaggaggaaagaagggaatcaaagagggagggaggcaatgggagaagaggagagggagggagggaaagaaggggggaaatgagacagggagggaaggaatgagagagggaggagagaacgagagttaaggagggagggaaagggaatgagagagggaggggatgagagggggagacagggagggagtgaatgagtgagggaggaagggaatggtgggtaagataggaagggaaggaatgagagagtgaaggagggagggaatgagagggggggagtaagagaggagagaagagagtgaagaagggaatgaggaaaggagagggaggatatgagcggggagggagatagtgaggaagggcaggaggaagtgagtcgaggaatgagggtaggaccgaggcaaggaaagagtcaatggattcagacggggcgactctcggcaaattcgctcattcgttggttcggccccgccaagtgccaggtgccgcgctagtgcggggactcactgagccttggcgatcgctgctgtcctccgcagagcgccggagtggagccgccccctgtctccccgccccagggccgcccccgcgctgctacccggccaggccgggaacccccgggcctacgtctggcccgcccggcgcctgcgcggcgcacccacgtgacggcccaggcccccgccccgccggctcctctcgcccagcctcccgcctcgcgcctcccgcctcccgcctcccgcctccctccagctgcgagtgcggcctcggctggcggcggcaccaggtcagctgcgaggcgtgagccgaacgggccgggcggcagcgaacgcgggggtcgggcggcaagcaggcatcgctgggccggggacaagctagcggcgcggagtccgaggggcgcgggggcgggcgcgggccggaggctcgggggcggcgacctgaggagagcccgcggcctgacgtggcggggacgcggccggcgggatccccgggcgcgggcgcgtaggggccgggatctggcgctcggccaggggccagggtgcgaggcctcctcagcgcggctgctggcgcgccggcctcctggcacccgggcgggccctgttgcctgcggcaggtccgaatgcggccttcctggccgcgaccctccgcgctggagcgggcggccttgcaacaggcgggcgatttggggccggcctgacgagcctcagttccctcgatcgggcccggggactgcagccgtaggagcccagccttgccagctctcccggtttcctgagaggagccggagatcgcgctgtcagtgcaaaatcaccagagcgcgaagcgtcggctgccagttctgaccattttagatccggtgcgggccgagccgagtggatctggggcgggcagcggggcaccgccaccttccgcctgggctcctcactgggcgccctcgctccggccctccgcggggccgagtgcctccaagacggctccctgggagattcttccagagcgcaccctttggaaggctgccccgctgggaatcagcacccactccctctcctctaccgcagccgccccctttgcctttgtggccgaccttgcttcatgctgccaaggattgagtttctttgaggggatactgctcgttcgggggccctacagaaggctgagggtatctactcagtaaaatcgtaccgaactgaaagttcctctgaaatgattttgactctgccatccatcacttcataaaaattcatcttgtatccttcagtttgtagctatgtggcacattaagcttcctttcttctccccactgaaacttcgaacagtacaaaacggggaacttggcttgtgatgactaaaattggggatatgagactgggggcgggcgcggtggctcatgcctgtaatcccagcactttgggaggccaaggctggcagatcacctgaggtcaggagagactagcctggccaacatggtgaaaccccgtctctactaaaaatacaaaaattagctgggtgtggtgacacgtgcttgtaatcccagctactcgggaggctgaggtaggagaatcgcttgaacccaggagatgaaggctgcagtgagccaagaccctaccactgcactctagcctacaccatatagtgaaacctcttctctacaaagaaaatttgaaaaattagccgggcgcagtggtgagctcctgttgttccagcttctgaggaagctgaggtgggaggatcacttgaacctgggagcttgagactgcagtgaaccccaagctgtctcaccccagatagccaggactacaggtgtacaccaccatgcctagttaatttttaaattttttgtagagaaagggtcgcgctatattgcccaaggtggtcttgaactccacctacctggacctcccaaggcactgggattacaggcatgagccaccatgcccagcctactttgcacttttttttttggggggggggcaaagtctggctctgtcgcccaggctggagtgcaatggcacaatcttggctcactgcaacctccacctcctgggttcaatcgattctcctgcctcagcttcccccttcctcagccttcccagtagctgggataacaggcatgcgccaccacgccccactaatttttgtatttttagtagagatggggcttcctcatgttggccaggctggtcttgaactcctgacctcaggtgatcctcccacgttggcctcccaaagtgctgggattacaggcatgagccactgtgcccagcctactttgcacattgtttttttgtttgtttttttgtttttgagacggagtctcgcactgtcatgcaggctggaatgcagtggcgtgattctcctgcctcagcctcccaagtagctgggattataggcacctaccaccatgcccggctaatttttttgtatttttagtagagatggggtttcactatgttggccaggctggtcttgaactcctgacctcgtgattcatccgcctcagcctcccgaagtgttgggattacaggcgtgagccactgcgcccggccactttgcgcattttgactgttgcctaatgttctgtcagatcactgtgccatgacatctgttctcctgagggtggacgttttggtgatttaaaaccgtatagatgtggttttaaatgttttaaatgttgcaccctgtgctgtgctccttcccagcagagaattgattcatttttcagcatatcccccttagcccctagctaagtttcttaaattggacttggtaaatgtgctttgcctgcccatggaagatgtctttctgttttaccgtacttgtttttgcagtatgggtttagggagtagctgccatttatcccttcccaagagagcagaggcactactatgctcacggaaggtgaggatccacctgggggcttgatgtctattggggtagttgtggaggtcaccctcagagaaggaggccctcttgactctgcggtggtcatggtggtgatgagaaagctgaggcgtgggtatatgagacaagtgcccagagtctgtcattagcaagtggtacagccagccatgggggcttttgagatgtttgtgagataaaacctcacccctcaagaagccggaatctccttgtcgtgggtaaataggcaggtttgggccgggcgcggtggctcatgcctgtaatcccagcactttgggaggtcaaggcagatggatcacctgaggtcaggaatgcgagaccagcctgaccaacatggtgaaaccccatttctgctaaaaatgcaagaaaattagctgggtgtggtggtgcacgcctgtaatcccagctactggggaggctgaggcaggagaatcacttgaacctgagaggcagaggttgcagtgagccaagatcacaccactgcactctagcctgggtgacagagcgagactccgtctaaaaaaaaaaaaaagggcaggtttgaatggtggggcatatttgtcatgttctctgtacaatgatagagggagaagtaatcgagctagaccttgaccaatatgggactatgagagacagaatggcctagatgggtgactaaaggtgttcaggggatgacaggtatcccttttggactaaggactgctgatggggctgagtaggtaaggcttgaaggagagcagcctggggaggatgagacaagaggtagggaaactggtaggggcatcactgctgtggtctgacccagagtggtggccctggaggagtggagggtggctgtctgagatggaggagaggtgaaggaatcagaactagtaggttcatagggcacatgggttagaaaggaaaaatattaaaacagtgaggtttccaagatggaaatggtagctttgatagtaaaattagacaagttggagggctactagctagattaggcactgagctgtaggtgaaactgggaatgtgaaccactgggaaagaaggatgggctcgagcagggtgtgtgggatgaaagagagaggtcagaaaagggagaattatcatagagcagagtttccaggcaagagaatcctaagtgagaggtggtcatggggtatacaccttggctgtggccatctctggggccttggtgagaaagatgagccagcccaggagggggaaaggaatgggtgggtggctggatagaggtcccaggtcctggaggcagactcaggggcaggcacagataactgagtgtgtttgatgggaagcagtagagcatccaggggatggggttgggggtggccctgagcctcagtagtgaagagagagacctcttctttttggcaagttttatatcagcatatatttttcattttttcttttaaagatatataatcatgtgccacacagtgatgtttccgtcaatgacagaccagaccacatgaaggatggtggtcccatatttttactgtaccttgtctgtgtttagatacacaaattccattgtgttacagttgcctatagtattcagtactgtgatattgtgaaatatatatttggtcttgtctcatttcttggcatacaacttctaaaatctttggactttccagagtgatgcctttttgtatgctggccagcagcccctaggtagcttcaggatgggggctggtgacaggaaaggccaaggcaggcataagagggttgggactttcagcctcacctctcaacctccggagaggggagacaggctgaagattaagttcatcaccaatggccagtgatttaatcagtcatgcctacataatgaagcttccataaaaattctgaatgactgggtttggaaaacttctggatagttgaacacatggaggctcctaaagagtgatgttcctggagagggcctggaagctctgcaccacttcccacatgtctggccccatgcatctcttcatctgtatcctttgcaataccctttataacaaaccagtagacatgagtattttcctgagttctgtgagtcgctctaacaaattagttgaacccaagaaggggatcttgggaacccaatttatagcctattggtcagaagcacaggtgaaacaacctgggagactcagccctcaacctgtgggatcagacactgtctccaggtagtgttagagttgaattagagcaggggtccgcaacccccaggcctcagacctgtatcagtctgtggctggttaggaaccaggtggcacaacaggaggtgagtggagggtgatccagcattaccacctgagctccacctcctgtcagatcagaggtggcatcagattctcataggagcacaaaccctgttgtgaaccatgcatgtgaggggtccagattgtgtgctccgaaagagaatctagctaatgcctgataatctgaggtggaacagtttgatcccgaaaccattccccgaccccgtggaaaaattgtcttccaagaaagtggtccctagtgccaaaaagattggggactgctgaattagaagacacccagctggtatctgtggcagaattgattgcttgcttgttaatggggaaaaaccctcacacatttggtcacagaagtctcctgtgtttgttgttgtggtataagaggagaggaaaaacagtgtgtttttttcattcagaactacagtaacatgctgtacaagtatgtagcttaggagcaattggctgtaccttatggcctagatgtgtagtagtctctaccacctaggtttgtgtaggtgtaccctttgatgttcacacactgaggaaattgcctccagcgatataagtctcagaatgtatccccaacattaagtgatgcatgactggaggtaattggagaataaacatattttggggagaggaaagtaggatgaagtgaggtggagaagacagatgttcacatcttgtagctgactgtgctgtgcctacagagcctgcagcttggccatgcctcacagtgtgggactggccactccctgacctgaacagctggctatccacagtcacttttggttgctccatggcaaaagtgcatttgcagtaggttcattttactgattaggttttagaggctccaattcaaatcagtttgcggtttttgaacgtactgactcaattattagaagataatctttaatttaaaaggcaatgcagatgaatttaaatgcatcaggttcaatcacagttactgtgcttgactctcagaatttcagtaaaggaaagtaggccctggaaatgccacccccttggcacccacctcccagactcctggctgtgtgtctcctgaccactactcaggtcttgccatttttatgcatccattactatgaggaagaacccaattttgttcattcaatgggagggaggaagagctcttgagaacctggtgtgtgcttatgcttcatgttcattgttttaccaattttagaataccccaatggggtaggtacttttatctctctttttaaaattggggagctcgaggctcagtttggtcatgttgtaagtccctgtggagttgggctccaacccaggtcagtctgtttcccaaaacccttctgtttgactttgccgctgaagaagatacaatgagatgaagagtcttgggcatgatggcacacaggtcatcaggaagaaggccatcaggaagttggactagaggtgggaggggagaaggaattaggggatttggaaatagagggaaaacaggtgagcctgagggaggcacaggagcaaggggagcaacagagctggccagtctgtgtgtggtggggctgatgcctgcctgctcacccctgtcccctgttttgccaactgtcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcaggtgagttcactagagctgtttgtaagaagaataacaaaggtaatcctggctctgctagtaaaggtactggcggtgacagtggctggtctcctgctcacctcagagcctcccctactccttgtggctatgacttagtcaacaagtgtgagagacagaagggggtcttagagttcatttttcattcagtgatcctgtttcttgggctttgcctcctcttctcttccctctcttctcttccttttcttttccttttctctctcttttcttttctcttttctttcctcctttctctcctcccctcccttaccattcctcccctccgtcagtaattattgctgtgtatgcatcaccttctggctcacacctctcatccctcaggtgttagcctctggccctcccagtgagctctgtggcccctctggggtttcttatggcctccttcgtgaccccatcccagcacttggcacagtgtgaggaaccactggcttatctgtcttttccactgggttggaatctgtctcttatccctagcacctgacatggttttcacatattcaaacaatacccatggcttaaatgaataaatttatgtacacagatagcagatcaatacaccatttgccctgttgtctgcactgctctgcactcaaggaggtgggtgtcaccacccttatttcacataggtggcatgagcctgagaaggactgagggccactcgtggtccccagcaaggttgtcatgggactccaagcctgaggtgttccattctagctctgattctgttcaatcattttgtcttcaaggcttagttgtagttctctctctctctctttctctttatctctctctatttttttaattaggaactatcaagcaaaatatgtatggtttaagtgccttctgtctccaaaaggagttttggagaatgtgacccagtggtggcttggtgcagatgtgtccaggagcagcagaattctttcagttcaccagggaaattcagctgaggcctttaataagcattaagataacatacaggacagtgggtagggtagaggagctgagggccccctgcaggggacttaggacctgtataggagaggatggccagaggctgtggagcctatgggatcccctgggctcaccctctcagcccttcttgatttagtgtcataccactctttctgaagatgacagtgtaggcagcctttcgctaatctgtcaaaaaccttatgtggctttccacgtcctccaggagcaatttctagccctttccacagccccccttgggtaaacctcttatgagaggtgtcctgctctccgggatgattacaatgcatcactaacaccccctgcatccctccacttccattgggaaggggagcgggagagtggcaacattattggaagagcccagagtcatttcacaggggggtgtgtgtgtgtatgtataaataagaaatagaggccagtcacggtggctcacacctgtaatcccagcactttgggaggccaaggcaggtggatcacttgaggccaggagtttgagactagcctggccaacatggtgaaaccctgtctctactaaaaaaaaaaaaaaaaattagctgggtgtagtggtgggcgcctgtaatcccagctacttgggaggctgaggcaggagagttgcttgaacacaggatgcggaggttgcagtgagccgagattgtgccactgcattccagcctgggtgacagagcaagaccctgtttcaaaaaaacaaaaaagaggctggatgtagtggctcacgcctgtaatcctagaactttgggaggccgaggcgggtggatcacctgagattagtagttcgagaccagcctggccaacatagtgaaactccgtctctgctaaaaatacaaaaactagcggggcgtggtggcacatgcctgtaatcccagttacttgggaggctgaggcaggagaatcacttgaacccaggaggcggaggttgcagtgagcctagaaagaggccaggcttggtggctcactcctataattccagcacttcgggaggccaaggagggcggataacttgaggtcaggagttggagaccagcctgacccacatggcaataccctgtctctactaaaaatacaaaattagctgggcgtggtagcacatgcctgtaatcccagctactcaggaggctgaagcaggagaattgcttgaacccgggaggcggaggttgcagtgagccgagattgcgccactgcattccagcctgggcaacaagaatgaaactccgtctcaaaaaaaaaaaaaaagaaaagaaatagaccattcccaagtgttagcatgtttattatttgttttagttacttgtgaaatgttaaaatgataaaggactatttttttcccagtatgactggtaaatatgtgtgagaggcttgtaatatttgatatgggcaagggtagagagaagggcatttaggggtgggctggcccatagtttagggccctgcagttgtatgttgggtgtctaggtgtcattcctgtgggacgatgcacccagtgctgagacatggtgcaggacagagcctttctgtgttatccaatggagctacttgcaaactgggcagtgtggtgtgtctactgatagggagtgaaaaacctcaggacctggtggaagatgatcccaaccatgaagatctggaaggatcttgctgcaccgtggggactcagcaaagggcaaagggagagggaggctgaatttcttctgtttactgcattgtctgaattattttacaaagaacataaatttctttttttttttttttttttgagacggaatctcactctgtcacccaggctggagtgcagtggtgtgatctcggctcactgcaacctctgcctccgggttcaagcaattctcctgcctcagcctctcgagtagctgggactacaggtgtgcgccaccacgcccggctaattttttgtatttttagtagagacagggtttcaccatgttggccaggctgatctcgaactcctgaccttgtgatttgccctccttggcctcccaaagtgctgggatgacaggtgtgagccacaccacgcccagccttttgtttgtttgttttgagatggagtctcgccctgtcccccaggctgaagtgcagtggggcaatctcggctcactgcaacctctgcctcccgggttcaagtgattctcctgcctcagcctcctgagtagctgggattacagacgtgtgccaccaaacccggctaatttttgtatttttagtagaggcggggttttgccatgttggccaggctggtctccaactcctgacctcaggtgatccgcctgccttggcctcccaaagtgttcggattacagacgtgagccaccatgcctggcctcttctctgccttttctgtcctgtggaaatttttcttctttggcccacctgagatgcctcctcctctggagagctttccctaattgtcccttgctgtttcccaggtggaggaatctcagttttcctgaagggcagagagctgtactgccctgctgcaggaagcctcctgtgctctttctgtgtactctgtacatggtttaggaattggatggccagactgcattttctttttttgacttttgttaataacttttcattgcacacttactttggctcccctgaccctacacccaccttgtatgctttaaccttgtatgcttctgaggtggtttctcctctcctcctggacccttatagtctgaagagcccaaaggctctgtcctttttatacaacctccatgggtcacctcgtccctcccttagttttcattccatctgtgaattataaaagactgcttagctgaactcaatgtctgttactttaaaagtttggatacaattgatgattttatttttaaaaaattaatagcactttatccccaaaagagagagaaagttgtattccccacaaaacacaaagcccagatgttttccagggtaggtgtgccttttatgaaaagactccaatgccatttaaattttttcagagcagtttcagaaaaagaaaaaaaaattttttttaattagctgggcatggtggcgtggcctatagtcccagctacttgggaggctgaggagggaggatagcttgagcttgagaggttgaggctgcagtgagccatgatcatgccactgcactctcgcttggatgacaaagtaagagacctcttttctcgtaaaaaaaaaaaaaaaaaggctgagcacagtggctcacacctataatcccagcgttttgcaaggccaaggtgggcagattgtttgagcccaagagttcgagaccagcctgggcaacgtgacgaaaccccatgtttacaaaaaatacaaaaattagagctggtcacagtggctcatgcatgtaatcccagcacaatgggtgcccaaggccggcagatcacttgaggccaggagttcaagaccagtgtggccaacatggcaaaaacccatctctactaaaaatacaaaaattagctgggcgtagtggtgcacacctgtaattctagctactcaggagggtgaggctcaagaatcgcttgagcctgggaggtggaggttgtagtgagctgagatcgcgtcactgcactccagactggatgagagagtgagattctgcctcaaaaagcaaaaaacaaacaaagctgggcacggtggctcatgcctgtaatcctagcactttgggaggctgaggcgggtggatcacctgaggtccagagttggagaccagcctggccaacatggcgaaaccccgtctctactaaaaatacaaaaattaggtcatcagcaaagcctgagtcctgtcctcttgctctcctccccggacagcatgagcttcaccactcgctctaccttctccaccaactactggtccctgggctctgtccaggctcccagctatggcgcctggctggtcagcagcgtggccagcgtctatgcaggcaccgagggctctggttcctggatcttcgtgtcccgctccaccagcttccagggctgcatggggtctgggggcctggccgcggggatggctggggatctggcaggaatgggaagcatccagaatgagaaggagaccatacaaagcctgaatgaccgcctggcctcctacctggacagagcgaggagcctggagaccgagaaccggaagctggagagcaaaatccagaagcacttggagaagaagggacccagatcagagactggaggcattacttcaagaccatcgaggacctgagggctcagatctttgcaaatactgtggacaacgcccgtatctttctgtagatcgacaatgcccgtcttgctgctgatgactttagagtcaagtatgagacagaactgcccatgcactagtctgtggagagcgacatacatgggcttcgcaaagtgattgatgacaccaatgtccctcagctgtagctggagacagagatcgaagctctcaaggaggagctgctcttcatgaagaagaaccatgaagaggaagtaaaaggcctacaagaccagattgccagctctgggttgactgtggaggtagatgcccccaaatctcaggaccttgccaagatcgtggcagacatccaggctcaatatgatgagctggctcggaagaaacgacaggagctggacaagtactggtctcagcagattgaggagagcaccacagtggtcaccatgcagtccactgaggttggaactgctgagatgacaatcacggagttgagacgtacgtccagtccttggagatcaacctggactccttgagaaatctgaaggccagcttgtagaacagcctcagggaggtggaggccttctatgccctgtagatggagcagctcaatgggatcctgctgcacctggagtcagaggtggcacaaatccgggcagagggacagtgccaggcctaggagtaggacgccctggtgaacgttaaggtcaagctggaggctaagatcaccacctactgccgcctgctggaagatggcgaggacttcagtcttggtgatgccctggacagcagcaactccatgcaaaccatccaaaagaccaccacctgccagataatggatggcaaagtggtgtctgagaccaatgacaccaaagttctgagacattaagccaccagaagcagggtatcctttggggagcaggaggccaataaaaagttcagaggtcaaaaaaaaatacaaaaattagccaggtgttgtggtgcatgcctgtaatcccagctacttgggaggctgaggcagaagtaccgcttgaacctgggaggcggaggttgcagtgagccgagatcgcaccactgcacaccagcctgggcgacagagtgagactccgtctcaaaaaaaaaaagaaaaacaaacaaacaaaacaaaacataaattagccaggcatgcctgtagtctcagcttctggggaggccgaggtgggaggatcacttaaacctggggaggtcaaggctacagtgagccatgagttgtgagtgtgccactgcactccagcctgggtgacacagcaagaccttgtctcaaaaaaaaaaaattggtttcatgctagggaatctgtcttactagttacatgccagggaatcatggcattccatcaattcatgacaacccaacatatctgcatacgtgtctatatagcatatctgcagacatggtgagcaggcatgtgataacattcagcatccattctcacagttaaaaagttttttgagcagggcgtggtggctcaaacctatagtctcagctacttgggagaataggccggaggattgcttgagcccagaagttctgggttgcagtgtgccatgccaacagggtatccacactaaatttggcatcaatatggtgaccttcctggagcagggttgcctaaaaagaggtgtgaaccggcccaggatggaaatggaccaggtcaaaactcccatgctgttgagtagtgggatcatgtcactgcactgcagcctggacaccatagcaagggtccatctctcaaaaacaaacaaaaaccaaaaaacttttggggctgggcagggtggctcacacctataaccctagcaccttgggagactggggtgggcagatcagttcagtcctggagtttgagattagcctaggcaacatggcaaaaccctatctctacaaaaaatacaaatattagctgggcacagtggcacacacctgtagtccccactacttgggaggctgaggtgagaggattgcttgagcctggaggttgaagctgcagtgagccgagccaagccaagatggtcccactacagtccagcttgcgcgacagagcaagactccgtttacaaaagaaaaaaaaatttttttttaatttttttttattttgagatggagtctctctctgtcgcccgggcgggagtgcagtggcatgatccctgctcactgcaacctccgcctaccaggttcaagtgattctcccacctcagcttcctgagtagctgtgagtacaggtgcatgccaccacacccggctaatttttgtattttttgaaagagacagggtttcaccatgtcggccaggctggtcttgaactcctgaccacaggtgatccacccaccttggcctcccaaagtgctgggattataggcgtgagccaccgtgcccggcctatttttatctattattattttttagactagttaagtgcagtagtgagaaggggggacagagacgaatgagtttgatctgttactgactatgaacaatcaactgaaataactcagctaactttggcccagccaaacgtcttaaagaaatgtttggcgtaggccgggcgcggtggccaacgcgtgtaatcccagtactttgggaggccgaggcaggcggatcacgaggtcaggagatcgagaccatcctggctaacatggtgaaaccccgtctctactaaaaatacaaaaaattagccgggcatggtggcgggtgcctgtagtcccagctactcgggaggttgaggcaggagaatggcgtgaacccaggaggcggagctcgcagtgagccgagatcgcgccactgcattccagcctgggcgacagagcaagactccgtctcaaaaaaaaaaaaaaaaaaaaaagtttggcgtaaactcattaagccacggaacccacccaaaactcaaaattattttcgaggctaattatattttttatcctagtgtgagtctttatacttttttggggggcatattaaggtgtttgaagaggaggcaccgacccagatcccgtgggatataagatcctatgtggcatgtgtacagtatttctcacgttggaaccttctgaattctaaaatacacttgatttaaagagtttggacaagggatcgaggacctgaacaagctgacccaagaaatatttttctcccccatctcacaccagaggcagcatactggtttgccattctgtacctgtgacatcctggaggtcccaggcaccagcagtagagatggccctcactctctgtgctgtggagtgttccgtgctgtcgatgtcctctatttatttggtcattcccctgctactgggtacttggtgaacaattttttaaaattgtggttctaaaataataaacacaaataacacttaccatctagttcagtaatattacgattattcacattattacgaaacagatctccagaacttttttatcttacaaatctgaaactctatacccactaaaccacaactcccttttctcctttacccccaggccctggcagctaccattctactttctgtctctatgaattaaactattctaagtacctcataagtagaatcatacagcattagccctttatcacttgcttatttcatttggcatcgtgtccttaaggttcatgtgtgttataacatgtgacctgatttccttcattttgaaggctgaatagtgtgccattttatggatataccacattttgtttgtctattcacctatcaagggatacttggtttgcttccatctcttgtctattgtgtataatgctgctatgaacatgggtgtgcaaatgtctgagactctgctttcagttctttggctatattcccagaagtggaattgctagatcattctattgacaattttctgaggaacatagcagttgcaccacttttcattcccaccaacagtgcacaagggttatagtttctccacatccttgctaaagcttgttattttctggttttttgtttgttttgttttttgagacaggattttgctctgtcacctaggctggagttcaggggcaccatcatggctccacctcctgggctcaagcaatgcttctgcctcagcctcccaagtagctgggactataggcatgcaccaccatgcctggccagttttttaaaaaaattatttgtagagacagaatcttactatgtttcccaggctggtctcaaactcctgggctcaagcaatcctcccacctcagcctcccaaagtgctgggattatggacatgagattatagatgtgaaccaccatatccggcctactttttgtttgtttgttttgttgtttttttatagtggtcatcctaatggatatgaggtgtgaacaactttttaaaacttttaagtctttattttgacataattcctgacttacagaaaagtagtaataatttttttttaatatatttttttaaaaattggccaggcatgatggtgcatgcctatagtcccaactacttgggaggttgaggcagaagcatcacttgagcccaggaggttgaggctgccgtgagccaaaaatgaattttttttttttgagacagaatctcactctgtcgcccaggctggagtgcagtggcatcatctcggctcactgcaacctccacctcccaggttcaagcaattcttgttcctcagcctcccaagtagctggaattacaggcgcctgccaccacacccagctaatttttgtatttttactagagacggggtttcaccatgttggccaagttggtctcgaactcctgacctcaggtgatccgcccacctcggcctcccaaagtgctgggatacaggcatgagccaccgcgcccagccccaaaaatgaatgtttaaagaattaagtttgggaggctgggcatggtggctcacgcctgtaatcccagcactttgggaggccgaggcgggaggatcacgaggtcaggagatcgagaccatcctggctaacactgtgaaaccccgtctctactaaaaatacaaaaaattagctaggcgtggtggcgggcgcctatagtcccagctactcgggaggctgagacaggagaaaggcgtgaacctgggaggcggagcttgcagtgaaccgagatcatgccactgcactccagcctgggtgacaaagcaagactccatctcaaaaaaaaaaaaaaaaaaaaaaaagaattaagtttggggcgggcttggtggctcaatcccagcactttgggaggctgaagagggtggatcacctgaggtcgggagttcaagaccagcctggccaacatggagaaaccccatctcttctaaaaatacaaaattagccgggtgtggtggcgcatgcctgtaatcccagctactcgggagactgaggtaggataattgcttgaacctgggagctggaggttgtggtgagccgagattgcgccattgcactccagcctgggcaacaagagtgaaactctgcctcagaaaaaaaaaaaaaaattaaatttggtaaaatttttggtgaaaaagaaaaacaataaaaaggagtgactatatattttatttttcttttgggctcttttttctctctgatttttattttgaaatatttaaatcctacagaaaagttgaaagttaagtatagtgaacaactgtgctcttggcttaaattcatcagttaacattttgcatattcacttcagagtaagttatagatatcatgacaatttatctctaacaacttcagttcgcctctctaaggatgaggagattctttgacatacctgtaatactatcatgatataagaaaatttatgattgagccatgttccatggcgagtgcttttagtcccagctatttgggaggctgaggtgggaggatcacttgagcacaggagtttaagtccaacttgagcaacgtagcaaccctgtctctaaaaacataaaaatgaaaaagaaatgtgtaatcattctataatttcatctgacattgagtccacgttcagattttcctaattgcacccacaatgtctcatatcttctttctcctccctccattcatgatccatgcagtgaacttttttgtgttgttttgttttttaagagacagagtctcacttttttgcccaggctgggcaatggtgtcatcatagctcactgcagcctcaaaatactgggctcaagcaacactcccacctcagcatttcaaattgatggaattatggatgcgtgccaccatgcccagctaattttttttaagagatggggtctttctgtgttgccccatctggtctttttttttcccttctttttctttttcttttgaggcacagtgttgctctgtcacagagtagtggtgcgatatcagctcactgcaacctccgcctcccaggttcaagtgattctcatgcctcaaccacccaagtagctgagattacaggtgtgcaccaccatgcagctaatttttgtacttttagtagagatgaggtttcaccatgttggccagactggtctcgaactcttggcctcaagtgatctgcccacctcggcctcccaaagtgctgggattacaggtgtgagccatggtgcctggctgcccagtctaatcttaaagtcctggcctcaagcagtcttcctgccttggcccccgaaaggattataagatttttttttttcttaaaatggtaaaagtttgtgtccggccagacgtggtggctcacacctgtaatccagcactatgggaggccgaggtgggtggatcacatcaggtcaggagttcgagaccagtctgaccaacatggtgaaaccctgtctctactaaaaatacaaaatagccaggcgtggtggcacatgcctataattccagctacttgggaggctgaggcaggagaatcgcttgaacgtggtaggcggaggttgcagtgagccgagattgcgccattgcactccagcctgggcaacaagagcgagactctgtcacaaaaaaaaaaaaaggccgggcgtggtggctcacgcctgtaataccagcactttgggaggccgaggcgggcggatcatgaggtcaggagatcgagaccatcctggctaacatggtgaaaccccgtctctactaaaaatacaaaaaattagccgggcgacgtggcgggcacctgtagtcccagctactcgggaggctgaggcaggagaatggtgtgaaccccggggggcggaacctgcagtgagccgagatcgcgccactgcactccagcctgggcaacagcaagacttcgtctcaaaaaaaaaaaaaaaaaaaaaaaaaaatctgtgtcaatccaagcacccacaccctgctcagggcgggcagtgcttgaaatgttgccatctccactgctgccaatatagtcccagaggtgccagcagaagaatcagacagaagtacatgcacgagcacagtcctggaaagtccaggagagccagacagaccactgtaaagagcatgggaaagtgccccgagggcttggccatgcatggagtgaaatgtctgggaataaatgtaacaaatatgtgccagatctgtaggaagatgacttataagacttccaaatggacccagaggatggctggacagttaaaaagatccactgtgtccattataaaaatgctatttatctctacattaacctagatgtttaacataaccccctaaaataccaagagggtttatttggggcaattacagaaacttgattctaaaattcaaatgtaaaaagctagcagtggccaggaaattgtcgaaaacaaaagtaacgaaaggagactattcctgtcctatgtgataaagatagcctcaaaaattagaggaaggggctgggtgcggtgactcacgcctgtaatcccagcactttgggagcccaaggcaggcggattacaaggtcaggagttcaagaccagcctggccaacatagtgataaccccatctctactgaaaatacaaaattagccgggtgtggtggtacatgcctgtaatcccagccactcgggaggctgggaggcaggagaatctcctgaacccgggaagtggaggttgtggtgagccgagatcgcgctgctgcactccagcttgggcaacagagtgagacttcgtcttaaaaaaaaaaaaaaattagaggaaggagggaagacgacagagttgccatctagaaaaacaaagttggacccttgcttcataccttataccaaaataaattacaggtggatcaacagttttaaatgtgaaagattcaataataaaaacactagaggaaaatatcggaaatgttttctgaataatctcagaaagaaaaagcctttctaagtttgacacaaaactcagaggcaagtaaatggtaaatttgacaacattgaaaacgaagataggttggtccgaaggtagtgtgagttacctcagttgattgttcacagtcacagatccaactccaggttctactttttcaccttctcactactgcagttgactagacttgtttaaaaaaaaaaaaaaaaaagacaaatttctgcatggcaaaaaagcaatacaaaatcaaaagatcggggaaactcctcatcaaagaaagggcagatttcttcaaattgataagacagtctaacagaaaactgactaagaatctgaactgttcagaaaagaaaatggaaatggctctttaacatataaggagattttctgtaccttatgtgataaggtttttcccttttgtggtggtgagttagagctggtgtcttcctgggttgggggtagagggtgcaggcaccaggccctgctatcaggaatgatataaaaacagcaacttgacaatactatcaaagtataaatgtatgtaaacccttcgacccagcaactgtatttgtgggacttaatcctggcatatgcatactcagcatgttgtaagggtgaggatgttcatcatgtgaaataactggaaattacaagtaacctaaatatacccctgtagaaatgggttaaagaagtgagacagctggctgggcgcggtggctcatgcctgtaatcccagcactgtgggaggctgaggcgggtggatcacctgaggtcaggagtttgagaccagcctggccaacgtggtgaaaccccatctctactaaaaatacaaaaattagccgggcatggtggcgcaggactgtaatcccagctacccgggaggctgagtttggagaattgcttgaacccgggaggcggaggttgcagtgagccgagattgcaccattgctctccagcctgggcgacaagagcgaaactccatcttaaaaaaataaaataaaataaaaaaagtgagacagcctttgcaaagagtgaggcagtcttgcgtacatgggcatggatcagtctccaagctatattgttaagtaaaaaccgggctgggtgcagtggctcacgcctgtaatcccagccctttgggaggccgaggcaggcagatcacgaggtcaggagatcaagaccattctggctaacacggtgaaacccggtctctactaaaaatacaaaaaattagctgggcgtggtggggggcacctgtagtcccagctacttgggaggccaaggcaggagaatcagttgaactcaggaggcggaggttgcactgagccaagatcgcaccactgcactccagcccaggcaacagagtgagacttcgtctcaaaaaaaagaaaaaagccaagtgagatgtggaatatgactgccctgaggatagtgtggccctgggaggggaactgactgatggtctgggagcagaggcaaggggactttcaccacaacctatactgtattttttttgtgtgtgtgacagagtttcactcttgttgcccaggctggagtgcaatggcacgatcttggcccactgcaacctccgcctcttgggttcaagcaattctcctgcctcagcctcctgagtagctgggattacaggcatgtgccaccatgaccagctaattttgtatttttggtagagatggggtttctccatgttggtcaggctggtgtcgaactcccaacctcagatgatcggcctgcctcggcctcccaaagtcctgggattacaggcgtgagccactgtgcccggcctaacctatactgtattttaaatctggtagcatgtatatgtattacctagtcaaaaaaataaataaaatgtaaaaatagcttctcttataatcttcatgttgctgtcatatttaaacttcagccccagttgccagcctcttacctccaaacacctaatcagtgtctacacttggaggtttcacaggtatctcacactgatcacacaatcacgggactcccagctgtccagattttcttccatcagtaaagggtcctcttcggcccagcagagggccttgagtcctcccaggtcctcctagattcagtctgtcagtaggttctctgtgccgtgtcccagggtagtctcagctactgctttctagctgcaatgccctccccagggccagggtcacccttggcctccaggcccacaggaatctcaggcctaattggtcttccaggggctcctcctccagcacctgagtcggaaagccagtcagttcacatcactctgtgggtaaattcctcaagagcatcccataatgctcagatttcaatctggactgtacctaccctagaggtagggggacctggctccaaggcctgcctgcccatcccactttctgctcacttcgtcatcatcttggctgccttgcatgccaagctctgccttgccccagaacttgtacacctgtctccttcacctggaactccctccccggctgcctacaccctctcagccttatccttaggtctcagttcctcagatggggctttccctgctccttctcatcattccacctacccctcttctaaccagtgactctcaggtcagatgccctgctgggttccttcttagcatttatttatatatgtatatatgttttttgagacagagtcttgctgtgtcacccaggctggatcgcagtggtgtgatctcggctcactgcaacctccgcctcccgggttcaagcgattctcctgcctcagcctcctgagtagctgggatgataggcgcccgccaccacacccagctaatttttgtatttttagtagagacggggtttcaccatgttggccaggctggtcttgaactcctgacctcaggtgatctgcccgccttgccctcccaaagtgctgagattataggcgtgagccaccacgcccggccaatttttgtaatttttgtagagacaggatttcaccgtgttgcctaggctggtcttgaactcctaggctcaagggatctgcctgccttggcctcccagagggttgggattagaggcgtgagccaccgcgcccagctattttaccagtttacttcactataactccttttgctctttgttttttgttttgttttgctttttgagacagtcttgctttgttgcccaggctggagtgcagtggtgcaatcttggctcatggcaccctccgtctcccaggttcaatcaattcttgtgccgcagccaccaaagtagctgggactacagatgcacaacatcatgcccggctaatatttgtatttttagtagagacgcggtttcaccatgtgggccaggctggtctcgaattcctgacctgaagtgatttgcctgccttggcctcccaaagtgctgggattacaggtgtgagtcaccgtgcctggcctccttctgctctttgaatgatacttggcatttggtaggaactccataaatatacattgaatgaaatgacttttattagtttcccattaattaattcattgctttgaaatgtgctctggagttgctactgctccgatccaggaactgcactgatgaacacagcagaagcaagctgcttgtggcctcacctcccgaagctcacatgggactccttgggcccatgaaaagggaaacaggacaatttccaggatggctgcccagacttcgtcaggatccttttgtgggatggctcatgcatgcacacagttcactcagagcacagagtgggtcagcccactaccagggccctgccaccagcgccaggttcttctctgaatgctgtcactcttggcaacatgggcttaagtccctgttggtataactccattttcttgtgtcttcactttgcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcaggtgaggcatgtctcatctagcaaggcagacccacacccaggtggggttccctgagatgcccatgatgcctgccgggcactagcattggcttgaagatgggtcaggaatgtgaggagaccaagcagtgacgaaggccatgaagtggggaagactctggagttgttcctggagctcaagcagagccgctctagacaccccaggcctctgcctttgccctcttctctattgctggttgtttccccactgtctgagtctccctgtcattgaaagcatcctgcacataagcaggtaggctgacccgaggctgcatgtggacgtcctgtgtgctctggggtctggcaatggggagcatccaccagcattgctgccagggcccttcctgcctgtcccctcactgggccacttcagtctcttgaaaacttatgtgttttgttactgaactttatctatctatttgtctgtccatccatccatccatccatgcatgcacgcatccatccatccatccatgcatgcatgcatccatccatccatccatccatccatccatccatccatccatctatccatccatccatgcatgcatccatccatggtggcaggcatccatccatccatccatccatccatgcatgcatccatccatccatccatccatccatccatccacccatccatccatccactcattcaatttattggagacaagctctctctctcttgcccaggctggagtgcagtggcacgatcacagctcactgcagcctcaacctcctgggctccagcaatccttctgcctcagcctcccaaatagctaggacctataggcatgtgccactacacctggctaatttttaaattatttttatagagatagaggcttgctttgttgcttaggctagtcttgaacccctggcctcaagtgatccacctcagccttccaaagtgttgcgattacaggtgtgagccactgcgcctggcctattttttttttttttttaaagacagggtctcactctgttacccaggctgtaatgcaatggcatgatcatagttcactgtagcctccacctcctaggctcaagtggtcctcccgcctcagccttctgagtagctgggactaaagatgcgtgccattgtgcctagctgatattatatatatatatatttttttataggaatggggccttgttatgttgcccaggctggtctcaagctcctggcctcaggtgatactcccaccttggcttcccaaagttctgggattacaggtgtgagcctctgtacccaacctgttattgaactttaagtacttgttttcctgcagaattcaaaaagttttctgaggctttgacagtgtgacttatgttttggatgattattctcagtggtgtgggtgcagttacacgggactgggcctgcaggtgcctttgagctatcaggcagaggcctgataggagttgacagtcacctcttcccacatttcttaaaagtgaaacaaaatgctatgctaagttcatcattctgacctttcttcccatgagagcaggtttgacgcaattaaaaaaaaacaactcaagtcacaggaaaaccaacctgttcgggggcatgtggaggtgccaccccatgtgacagggccctggcagcctccctgtgccctgttctcagattggtggataggacctggatgctgggtgggttgatctgagatgactgacttgtctcaccatacctgcatggtgagtagatggagttggcttttacaacaaaagaatttccccctgttcttttatttagagatctcttctgtccccacatccctgtcattgttgctttgggaaccctcatccaattctccaccctggcagcagttaactcctgattcagctgcctctgaaacatctcccccagcatggctcaggtccagctgtcctatctcctcctccacacctgccactctcccggagctcccctgtcagtccccctgctctgtgtgtcctgtgaccatcctgccagttccctgggctcaacctcagtggctccttgagcccgtccaccttcttaattccctgcgtccatgtgaggacaggtcatccttctcggtattgcttgtagccatctctgttctgtgtttccatttccttcccttttgcctggcctccatctgtatgtttctgccatttctttcttctccctgcagtgatcacacacactgaaaccagatcatctttctaacatcactttccctctctcaccagtcagcttggaggcctgcagtctctctctgttggtttggccagtgctcccgacagccctgggtcatctcccccagtgcctcagaggtcatctcagaggcagcagcctatcttagttttttaacatatcaggcttctgggccaggcttggaggttcatgcctgtaatcccagcacttttggaggccaaggtgagaggattgcttgaggccaggagtttgagatcagcctgggcaacaaagcgagacctctacagaagcactttaaaaatagccgggcatggtggcatgcacctgtagttccagctactcgggaggctgaggtgggagaatcacttgagcccaggaggtggaggcttcagtaagctgtgatcaccacaccactacatgccagcttatctcaaaacaaaaaacaaacaaacaaaaaaaaacaggcttcttcacaatattgttttatagcaggttttacttggcataaccatgtcaagtccataggcctgtagaatcatgtatgttcacatagctagtgacttttggaggcttcccccatgtgttgtgccctgcagtaggcctgggaccagattcttcacggtgtccccagaggcctgagtctgattcccagtaacactgtcctattgggttaccccaagcaaatgcagtcccttctgtgagcctcgtatggggcttttgcacatcctgagcccaggctggttcctctgtgagatttcactgaacagaaggcccactgctctaaaaataggactgaaaggagagtcagcagggtcctctcaaggagctgctgctgcccaggcttcttcagggctgtttgtgctcacattctgcccaaaacttggtcttcaggaccctggcccatgacaaaccagaattttaggaaaacctagtagtttgggaagaagtggcaaagcagaagactggcaaaaagggaaaaaagaaggtcaagtgaagctggtcagggcctagcaaagcaccatggggatacctcatgtagggcacatacctgcctgacatttggtaggtctcatccagctcttagcatgtcaccttgcaagcaatattagatgtcttttgaattttaaaaaagttatagttagtgtttattgataagctttaaataccttggccgggcgccgtggctcacgcctgtaatcccagcactttgggaggcctaggcgggcagatcacgaggtcaggagatcgagaccatcctggctaacacgatgaaaccccgtctctactaaaaatacaaaaaattagccgggcgtggtggcgggcgtctgttgtcccagctacttgggaggctgaggtgggagaatggcgtgaacccgggaggcggagcttgcagtgagccgagatcgtgccactgcactccagcctgggcaacagagtgagaccccatctcaaaataataaataaataaatacataaataccagcagaattattccatgtgtaatggttaatttattgatgatcctggataagccaggtattcccatttttagagaaactgatttattgcattgaacacatggctggagttggtagcaagggggttcccacaagaggggaccccacagcatcctgaaatggagccgttttgggattccaaagaaagaagcatcaaacaccagggtgatctggccagagcgtttattaggggaacttatgtatagagtgatgtagcatgtcctcaagacagacaagggaaaagagaggctttacccaggcttgcccacagagtgggttagtgtatggagtttctatgagggtttaaggaatttgtctcagggccagaaccagtttttccttcagtgttttgggtaacaaccttgatgcctttatcagtgcctgggaatgttcaagggcctggtttgggttcaagcctgctgggagaacctgcagctgtctgggtcacagagaggtcaaggtactcgtcattttcaatctgaacatggaaagaaaggaggtgggcactggggggccccactgaaactctaaaatcctgctttcctaaataatttatcaacacctggtttgttctcccaggcagttttccctagggcccttccctttgtctcctattctcccaagatttggttgtctgttcacagggtggcctttaacagcctgctggttgtggccttgttcccacctccctccagtgtcattctctctcttgccgtcctttcaaaccactagtgcttccccatggctgggaagggttgatatggccacctgggagcccctgcacttactggagtcaagtgggtcttgacccagctgggaacctcaagaaccctgagtcagggatcacttgagcccagaagcttgagacttcggtgagctatgatcttgccatggcactgcagcctgggcaacagagcaagaccctgtctcaaattttaaaaagaaaaaagaaaaataattctaaatcaggttcctgggtgggtattggttaggtgtctgagaggctctgagcacttctagggaaccagggtggatgttctggcgggggaaaaagccaggtttgtttctggtcccagcgcttttggagaggcaggctcttccagagaatcctagggtagggatggggatggtcttaggtcctttccaaaccacagatatatgacacagtgaccatttgtgctgcttcctgcttttctggagagccagtacttctttttttttttttttttttttttttagacggagtctcgctctgtcacccaggttggagtgcaatggcgcgatctcggctcactgcaacctccgcctcctgggttccagcgattctcctgcctcagcctcctgagtagctgggattacaggcgcgcgccaccacgcccagctaatttttgtatttctagtagagacggtgtttcaccatgttggtcaggctggtctcaaactcctgacctcgtgatacacccaccttgtcctcccaaagtgctgggattataggcatgagccaccgcacccggccgagccagtacttttgatctaagagggaactgacatatatcaagggtccactcctatgtgctctctcattttcatcatgttcctcttcactttaatgatccccgttttatagatgaggagactgaggcttagagaggttaaaaacattctgtacgggaggctgaggcaggagaatcatttcaacccgggagggggaggtgttagtgagccgagattctgccactgcactccattctgggcaacaagagcgaaactttgtctcaaagaaaagcaaaacaaaaccaaaaaaaaacatgctgtatatcctgtcacccagtatgtttccaaaccaggacttaaacctagtctgcagtaagccccagtctccagtgtgtcagaaaaggtcggggacaattaaggaggacttcccttctgctttgcctggcccacaacagcccgtatttctgccatcattctctctcccacccccagatgctgttcaccagcccaggcttgaatgggtgtcattctctctgcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtaggacagggtgctagctggtccctttgtcttcaggtgatgagagggtgtggaagtcatgggctgagagagctggtcaggttccccccagcctttcacatgagcatcacttgccattgtggaatgaagtctaggtgaattcagagaaggtggacagcagtgagataagagaaggggacatgtggatcgccttctttcctgcatgtcccctactcctcagaaacccacttaccctggacccttgctcagcctctttggggtaggctaggttgcgagtgcattgtgcaggaggagacgggaggggagaggagcccacagcaggaaaggcagtcggactgggatggagaggacctaggagcagtgccagctgagcagcctcgccctccatcatgctctctctgagctttgatgcatgttgtttcagtttcccttcaccagtcagctttgctcttctctcttacctgcttgctaatggtggaacaggcttcctgctgctgtgcctgagcagcatgcggtcttcagcccaggggcgtggtaaaggccaacaagcatcaccgagcctcatgctacatttccgctctgccctgcagtctgccacgcacttggcacaatttcccctgggaagaggcagttttcccaagagagagttttgtggactgctgtggtccgtaggatgcgcctggctccatcagtcacttaggctgtgatctcacaaatccatttctgggcagagcaagggacagtggttcaggcccacaagactcagctaccattagatttccagggacccctccaccttaccttggtgcatgtgagaaatctccctacccttcatgctgaaagatggagctgtgttggagagagagagattgccaactatttccagcagccatgagctagatgctgactgagttcatgttcatgtttctattttctggggtcagggtggggtagggcctggcctggccatgccacttggaatcaagcatagtgatcctggccaaggaggagaaggccatttctcagcgacctctctactgctggccccaggaagtgatctcctttgttaagctgatgagactcagaggttggcaataacacattgtggttaaatatgaggaagggcaggtttcagaaaaaaggaaacagctaccttcatttcctctctaaacaaagttgtgcccccagtgggtgtggccacactaggtttagacttccctttggccaaaccttaaaccttcttttttagggggctcggtttcccagttggggggccaaggccagaccaccctgctgagagtaacctacagacctgcaaagccaatctctccagagtgttttggcttctggcccttagcagaaggtagagacagctgtgtgcttggcagtaatgctggatgtttccacagagctgtccctaggggggtgacagcttgggattctgcctgcccctgtcctctgtccacctgctatgggccattgatctcactttcacttaaagtaggagtctgaatttccccttgtgaaggggtgtgagaccaaagctgaactctgggtaatgctaatattagaccctgtaaccaataaccagtcccaaactcctgtctgagagtaggatcacaatggcaagtggggtcggcaagacctgccttgagagagtaggtatccacagagtggaggtggcaggaaggaccacagccctactggttaacccagggatgtatcatctctccagaatgaaggcatcattaaccttccagtggactcaaaacttccagatgaatccttaatttgaatattctaagatttggttctttctctgctttctcatttcatcagccttagaactggtgaattctaaaagctataggcttttagaatataaggaaacaagattttgcagtaaattaggctttgcattttgaggagttattacttaccaggttatatcttaaagcattggtgcagaaaccgcatatttaaaaacctttcctctcttggagcaaatggtgtttgtctccaatatactactttttctctttcattccttctttctttgcatctatattatctgcatcattccttgtacctttcccatagccatagccctgtggattactgaacaccaactacatggtatacctagtagtagctggttacatgttgctatgtgccctgaccctacttaaaataataatttaggctatgtgcagatcatgtcaataatcccagcactttgggatgctgaggcagcaggatcttttgagcccaggagttcaagatcagcctgggcaacaaagcgagacctcgtctctaccaaaaaaaaaaaaaaaaaattagctgggcctgatggtacgtgcttgcagccctggctacttggaaggctgaggcaggaggatcgcttgagtccaggagttttagacttcggtgaactatgatcatgcccctgtactgtagcctgggcaacagagtgagaccctgtctctaaaaaaaattttttaaataataatgtaatttttccttcggcatttcatggctgctaatattttaaagtaaatttaatttttttttttttttttttgagacagagtctcgttctgtcgcccaggctggagtgcagtggcacgatctcggctcactgcaacctctgcctcccgggttcaagccattctcctgcctcagcctcctgaatagctgggattacaggcgccgaccaccacgcccagctaatttttttgtttttttgtttttttgttttgagatggagtctcgctgttttctgcccaggctggagtgcaatggtgcaatcttggctcaccacaacctccgcctctgaggttcaagcaattctcctgcctcagcctcccgagtggctgagattaccggtgtacgccaccatgcctggctaattttgtatttttagtagagatagggtttcaccatgttggccaagctggtcttgaactcctgacctcaggtgatctgcccacctgggcctcccaaagtgctgggattacaggtgtgagccaccacgcccggccatttttttgtatttttagtagagatggagtttcaccatgttgaccaagttggtcttgaactcctgacttcaggtgatccgcctgcctcagcctcccaaagtgctgggattacaggcatgagccacccaccgtgcccggtcagtacatttaatttatttaaaaaatttaatagacattaaaacattaatagtcatgaaaatacttaagtcatggaaatatagaagaaaaacagtctactgaatttttttttttttttttttttttttgagttggagtctctctgtcacccaggctggagtgcagtggcgtgatctcagctcactgcaagctccacctcctgggttcacaccattctcctgcctcagcctcccgagtaggtgggactacaagcgcccaccaccacgcctggctaattttttgtatttttagtagagacggggtttcaccgtgttagccaggatggtcttgatctcctgacctcatgatcctcccgccttagcctcccaaagtgctgggattacaggcgtgagccaccgtgcctggccacagtctaatgaatttaacaagaattccagaatatttttgtaccaactctagggttcatgtctgagtttacaataggatgatacaaatctgagttaaagtgactctcctagtcagtttcagctgctataacaaatactatagatggagtgacttaaacaacatacctctatttctcactgtctggatactgggaagtccaagatcatggtattggccagtttagtcccggtaaggtcctttccgtctgtgttctcacatggtggagagaaagagctgtagcctcgggcactaagcccatcatggggctccaccctcatgacctgatcacctcccaaaggccatgcctcccactaccatcacaatgggggttaggccttcaacataggggttttgggggaatccaaacatctagtccatagcaataagtaaaattgtttatatctttatatgcaaaaataaagcttatttttattagaaaaatattacttgaggacttattctcataaagtagaaaattaattcaataaagaagaagagggatacaggacacaacagggaaataagaaatcagtgtaactttggctatgtctaaattattgacatatggtatcactgttggtgtctttttttttttttttttttttttttttttttttttttgggggatggagtttcactctgtcgcccaggctggagtgcaatggcatgatctcagctcactgcaacttctgcctcccgggttcaagtgattctcctgcctcagcctcccgagtagctggaactacagccacacaccaccatgcctggctaatttttttatatttttagtggagacggggtttcaccatattggacagtctggtcttgaactcctgacctcgtgatccacccgcctcagcctcccaaagttctgggattacaggcgtgagccaccacgcccggccctgtgtgtgtctttaaatttgaagccacaaatccacatgaactcagcttaaaaagctgtgaggacaatagactcgaaggagcaaacaggagcacatggagggtcctatctcactctggttgcagacacttggggtgcagatggtgattgagccagactgaacacaagagaggagagacttgtatataaaggaggaaggcgcacaggaaaggcagtgaacagcaccatcccagccagttgacggggcccctgtgagtgctgtgccccaatcctggactgctggtcccctgccagaccttcttctggcttgtgccccaggtcatgcaggtctcagaccctgccttctcaggaggcctttcctgatcactgcaagggagctctgccctccccaggccccgctgaccagcaggtcactcatcttcttacctccctttctttctttcacagtgtctgtcattatattaagcactcatttgctctggttagcctgtttccattctgcaggggaaggcagggccctgacctcttgaggctccctctggatgtagtgctgagcactgtgccccatccacagtgggagacctgggaatgttggtagagtgaatgaatgattcattgctggtaatcttactcctttgtttaattcattcagcagacagaacataatctgtcctgagccagaggctacactgaggtctaggaatatagaaatgaaccatgatccatcagaacccccaagttaacaaggacacttttcatgctcgtcttttatgattcttcttgatagcttttctaggcaggtgatatcacctcattggacaggtgcagaactgagcgaatcccaagagattaaaactgatgcccaggcacacccagctagacagggaagagcccaggattcacaccaggtcagggagacccaggtgtgtgttccctctcttgttggccctgccttctgaggctcctgtttgctgcattcctggtaggcggcggggaggggctggccacactgcaggggctgcaggaagcaaaggatgaaactgatcttttcactaaccagcatagggcacaggccaaagaaaactttggttactctcttgtgagccagttgaagttagacttgttctctttggaataggtcttcctctgcagaaataaaaacacttgtctgaaagaggctgtaactatctgtgggctgttgggcaaggacacttcagatactggctttgagctcactgggtcctggcccctcatggctctgtgatcatctctgctccacattgcaggccatgctccctgttggtgctcagcccaggagccctccttgggtcctggccagactcctccaccctcgtgggcctgccgcaaccagtctagtgccttttctcccatgggggtccctggaatctcacacaccctgcccttacagagcctgcagtccagggtgggagttaaccctttccactttcccagagagggagaccttgagtggaggggaggtcaggaaacgcggggctggcagcatggtgggaggaggtgaaagtacgatgaccagagccttgtgtgtgcggctgttgacaaagctgagggtatgatgggtgctgtgtgcagggcgtgcctgagaagaccactcctgatggagtgctgggggaagttcaaggcttggaggccaatgagggggctgatggcacccatccagtggagaggctgtatttggaggccctcctgagtgggagcaaggctatgtggatgatgagatgaggtaagtgagatggaagtggctgtacgaacagccattgaggctgaggcaggaggattgcctaagtccatatcccaggtgtcaagaccttgtctctatcaaaaaaaaaaaaaaaaaaaaaaatagcgggcgttgtggtgcgcacctgtagtcccagctacttaggagactgaggtggtaggatcacttaagcccaggaggtcgaggctacagtgagccatgattgtgccactgcacttcagcctaggggacagagagacctctctccacaaaaaaaaaaaaaaaaaaaaaaaaagagccattggacagcccaggtggacagttaggtggaaacacaggaggctcctggccattccttccatgctgtgtggtggggagcacctgtgctcaggtgtgtaacagcctgtgggcctggctgtagatcggtgtgcactggtatgtggggtagttggggagggttcaggctgggctgaggcaaagcagaaatgggaccagaacaagaggtgcaagcctgcggagcagcctccctgcctagtcagtgctgtgctttcctcatgtctcggcacaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtaaggaagccctcgaagaggggccttctcctgcctaatttccttccccaggatgtgcaaagagtgagaggcctaggtgtcaaggcctgtcccaggtcagagaaacaggctcagtgagcagaatccatgcttctccagagaccctgcattgaatgcattgatgaggccccatgaggttcagccagtccacctggggaggctcatcaaggatccagaccccattgctcagaattgtgccccacttgtgagtcttacatgctgagaccttgtcacaccaccttggccctggcaagctgcttaaaccttgtagttcaaatgtggatagaacatttgctctttgtgcagctgagacgagctgggacacttccagagatgttaaacaggaagggaccctgagagctcactggcctatcctcagacctcttccctctaggtcccctgaagggtggcgccttccagagccaagaaacactctaaggttttattttttatattaaatcctatgtttgaatattgggacaacttgaaaaaaaaatcacgtgcatcctatataataccttggtttattccaatttgaagatgtttaaaattatgttcattatggaaaaatgatgttttagggaggtgcctctcttttatcttacgactttggggtactcaggcctggtgtaacaaccagacatgggatcccagggaaggaacaggccttgctggccccctacttcctgggtctcagcctccgagaacagggcataccctagcagtactaggggtaccctagcagggcaccccgctagtactggcatagcatttgtggagcacctgctatgggccaggtacacctttggggataaccgagcacctgagaggcagaggatggtatggggggcaggttctacctgcactgcctcagggagtttagcaagagctctggcctttgtaagcctctttccagtatctctcatgacccccaattcccccagggacttagactttgacttcaggggtcagggctagtgtctcctcaatggatccagctcttctttatccaggtcattcacacagcccacacagatttctgtctcttgggcagctgtgagctgcaagctgtggcctgctccttgctctcagcttctttggggagaaggaagcctctttggaaggacactccgtacccccatcctggggaaaggagcagattttgcatggagaagatcaggaggtccttgagaccaagtggacaaggagggctcttgggttctgttccaggaagggtgttgggggaagcctcctaggtgggtgttgtgggaggggcttagcagtttctttgtctgcggcagctggggaagcagcagttctccagcttggccacagaggggcagccttggctttcaaccagctgcatcgtggctgccggtgttccttcatgcacgcattcattccgcaactactaagcaccatgtaccaagtcctgggaatccagtggtgacaagaaatgagaaagactccccactccatggtgtttacagccttgtaggagaaaccactcttaaccagaaaacagatcagtaaagtggttacaattatggtaagtgaaatgaagagggggctgaactggaggatttccagggagggggctctggtaggatgaatctagagggactttttggggaatgtccatctgaggagatgtcaattagacctgccatttacagagggaggaaatgttactgggaatgtgtcctcggttcttgtcttcttggttaagactttaagcaagagacatgcattaacgaagataagtgtaaggcagtttattgcaaaagtgaaggtacattctgaaggccgagtcagagcaggctgctccagaataagatcgccccaactggcatgggaaacctcccttacaggaggcttacatgattattcataaatgggcgggaagaggtgttactcataagcatgttttgtttgggtggtcttctagcagcgcatgcactgtggctctacgtgctagtgtatttatcgcatgtctcattagcatcttaaatcttcacccaggaggtgtgttttttaccactgcagtgaacaaaaggttactttcgaagcaagcaaaactggggcaaactatacaacacaggctcccgggggtggaaagttccttgtggggttagttcctacttgagctggataagcttaactgaaagaggggttgggacttttgaaaccccaggtgtggttaacatgtctcagaggtcatagtccctctggccatgctaggggctgaggccaacctggagtccacttccctgctcatatctaaccatctgcctagtctagcagaaggaccttccagggcaggagaggggctcacagcttttcctgagcaggagaggaagcatggggcatgcttgtagaagaaggaagcccaaggatcaagagcagagcaagcgaggctggccctgggtcattgcgtggtctgggctgaagacagcagtagcctgtgctggcacacagctgtggagctggagggagatgggagggttcagagtgtagcgtggaggtaaactgatcaggcttgctgatggatcagatgttggggaatgaaaaaggataggtcatgttggcagggcgcggtggctcacgtctgtaatcccagcactttgggaggcccaggcgggggggatcacctgaggtcaggagttcaagaccagcctggccaacatggtaaaaccccatctctactaaaaatacaaaaattagctgagcatggtggcaggcgcctatagtcccagctactcaggaggctgaggcaggagaatggcgtgaacccgggaggcagaggttgtagtgagctgagatcacaccactgcattccagcctgggcaacagagcaagactctgccaagactccgtctcaaaacaaacaaacaaaaaacctcacaggattggtacactgaatattacaaaaagccgatgaaagaaataaaagaagatgtgaatagatggagagacataccaagtccatggattggaagagtaagaatagtaagaatgtcagttctttcccaacccaattaataatacatatattaatacagaattcctcatattgatatagtattaatacaggaatactagtattcctatcaaaatttcaggaaggttttttgtactattaagggaaaatgaaaattgaagctgaggtttggatatacccctaggccaactgcctgtagccatgtaactgaaacttaagctttcctccctcagtgtgatagctttacaaagaaagcttatgcagctccacatgcacagtagggaacaatattcttcctcattcatgctttataaactgtgttgtaactgctgtgaattggggcttcataccacttccagtttggggtttcctggttcatgaactcttcttttacatgcacaataagctttttaaaaatttttttatttttattttttttgagacagagtctcgctctgtcacccaggctggagtgcagtggcatgaccccggctcactgcaacctctgcctccctggttcaagtgatcctcctgcctcagcctcccaagtagctgggattacaggtgagcaccaccatgcccagctaatatttatatttttagtatcatgaaggtttcaccatattgcccaggctgttcttgaacccctggtctcaagggatctgtctgcctcggccaaagtgcagggattagagaagtgagccatcacatccagcctaaaatttttttttattgctggtcgcagtggctcacgtctgtaatcccagcactttgggaggccgaggatggtgtatcgcttgaggtcaggagttcaagaccagcctggccaacatggtgaaaccccatctctactaaaaatacaaatattagctgggtgtggtggcacacacctgtaatcccagctactggggaggctgaggcacaagaatggattgaacccaggaggcagaggttgcaatgagccgagattgcgccactgcactccagcctgggcgacagagtgagactgtctcaaaaaataataataaaataaatttcaaaataaataaaataaattttttaattttgatttgattttacttgtgacattagatgtaaatgagattattctgaaatgtatatataaaggcaaaggaactagaatagctcaaataattttgaaaaagaacgataagatgggaggagtctgcccaatttcaagattactacatagctacagtaatcaaggctgtggtatggatacagtgatagacacatagatcagtgaaacagaatggaaaacccacagacctgagtaaatatgcccagtcatgttacacatgattttggacaaaggtgcagaaacaattgagtggaggaaagatatctttcagcaaatagtactggagcaattagacatgcgtcggcaaaaaaatggatatcaacccaagtctcataccatataccaaaatgaattcaaaatggtttatggagttaaatgtaaaaccataaaacttctagaaaaaaagaagaagaaaatcttttttttttgagaccattgatttttaatattttcttaaaaaaatacaaaagaaattaactctgtagtacaggtcagtacacttcagggaaagagggaaaaatggaatttcagagcaaaggttgtttaggttatcacattcccacactcccaatacccataaaacaagaatttcactccatgacacagaggaacattgaatgatagctcagaaatgttgatagctgaggtactgaaactaacaaaaggattttggttgtccttgattattctgtcctgtaatgaataaaatctacactaaaggacaggtaaggaaaacttatagcagaaaaaagactaaatgtaccaatcacagcagtacaaaccactccttggcagaagtgtgcttctaaaagaatggggcagtaatcaggtagctgaactactaggctactgtcactcccagtccatccccaaataaatagtgtggaagtgtaatagtgtagtagtatttgattcaacaaagaaaggctttcacccccattcaaggttaacactgccatggctagatgacccctggcaggcaataagatgactgtaaaatcacaggtacttctagtttatccccagttatactgaactcccacatttatgtcatcttctctcatcccaacattggttcactcttttatgctgtctccagtgtgaaagaccttggggaaataaaaagatcattcaaagaatatacccttctcagtcttccaggttatgtaatacttcagtgctgttctaggttcactcacattccatcaaattcagtttaattcactgattctaacttcaattctgatatacaaaccctgacctccaaaagaagtgtcagatgagtatctctcccttgcccccaaagttttgtggggctctcccttttgtttccctttagaatggaactgtgttgcccctagctacctgtagattagaaaatgtatttgttcctggaaaaaaaaaagacttggattttaccaagtttacttaaattggtatctttccaatcatctaggctggatattgctcacatctagtaggctatactcaccttagttctttgcaacatatgaggcacaacatacatatagtacaccaagcacgtggtaagttagaaatgacaggaaagtgctccccaaagtagtgggagaggtaatgtggtctctcacatccattcaatgtgcattcttttccctggagtatctgttacccacccttctcaggaacaacaaccaggacgagggggagtatgtgtcaaataagtacaatcatcactgcactggtgcctgtaatcaccctgtgcacatagtgagaaacagacattctagaaaggattcttgattctcccactaactgtccactggactggtcactagctctggatggtgctccaacaatggtcacttcttgtggagaacacacacaccagcatcacagcgctgggttcccatggatgtcacgacttcccagctgttgatgatagggttgtaacattcaatgctacttagcagggacttaccttcatatcctgcaattgcatagagtctcccccgaagcactgtggcccctacatagcatcgtggagtggtcatactggtggcagttgtccgggaatcagtgcgaatgttgtatgcttcaacggaagaaaggtgggctgtaccatcaaatctccccaccacataaatacggtcattcagcagggctactcctgcaccagaacgcttggtggccattggtgtaacattagtccagtgtcctgtatgagggtcatatttctcaactgaatttaagatattcaagccgtcatatcctcctagacagtggatcactccactggccactacgagtccggcaccttcccgggctgtctgcatatctcccagcatgctcctctggtcaatgtttggatcataccgctccatactggtgtgacgcctgcttccatcaaagcctccagagacatagatcaaatctcccagggtggtggctccagcaagacctcatcagacattcataggggccacagaataccagaccccatcctcatctgctgtgtagtctagacattccactgaactaaggctggaacgaccatcacagccaccaatgacgtagatctggtcatgtagggacactgaggccacataacatctcttacaagtgatgcttggcaaaaagctccactcctgagtcttggggtcatatttctctactgcatcgatgggagactgctggcttccgaagcccccagccaccaaaagcacttcattggctcctaggcgagcccttgtcctgggtccctgcatctgactctgaagttcaggcctcagatgaaacttctttgcttcatcaaccagatccctgcattgtaaaccatagtggatgaaaggctcagcatctattacatctgtgatatacctgagggttagcaggggcatctgcatatactgtagcaggctgggcaaggagtctttctgctctttcttggcatgcttcacccaactgatgacagcctcaaagactggttcttcaggatccacctgaatttcatcgcacttgattagcttttccacctctccttgcctcagaagaatgaactcttcatgctgtaccacttcaggaaaattcttctggctaaaaacctcagctgcttgtgtcaggtcaacacaattgtgggtttcagcaaaatccctaatacccaggcaattagaagggtccaactgactttctaagaactcacagcaggcttgtttcacacctttcaactgaagcagacaggctgcaggaagcagttcctgtacattctccatgtcacatgtactgtttccgtgtacacaaagtccaataaaatttccatggtagaggcagtcaaaccttggatgtcaacatagggtttccccttctataaaggtcactagtgaacatggcacagaagtaatcactacaggcagccagcacaatctcatgggcaggaaagtctttctgctctactcaatgtcacatcacagaaggtattgctcttcccaacggagttcattgaactgaggattgatttagcatgagtatttgtcattatgtctttgggggccataatgcctcccataaagcagtgcggagaaagaacaaaaataggtccttggattctgcaactctgcttctgatcccacacagccgcgccagggcctgtccccagcctgtggggatggagtggggtgcgggtccagcaggtggctcaggaggagccgaagcgtcgccgccgccgccccggcccggaggctctggagctgtccgggtctgctccctgcggccacgcgacgtgatgaccagaagaaaatcttgaggatctagctagggctaggcaaggaattcttagacttgaccccaaaagcatgagccataaaaagaaaaattgataagctggacttcatcaaaattaaaaaatatttgcaaaccacctatctgacaaaggactagtattaaataaatacatatataaacaactcttaaaactcaataaacggccaggtgtggtggctcacacctgtaatcccagcactttgaaaggctgaagtgagcggatcacgaggtcaggagttcgagaccagagaccagcctggccaacatggtgaaaccccatctctactaaaactacaaaaattagttgggcgcggtggcacacgcctgtaatcccagctacttgggaggctgaggcaggagaattgcttgaacctgggaggcagaggttgcagtgagccgagaccgtgcctttgcactccagcctgggcgacagagtgagactccatctcaaaaacaaaaaaccttggcaaaatactgcaaataaccccattaaaaagagggcaaaagaagccgggcacggtggctcacacctgtaatcccagcactttgggaggccaaggtgggtggatcacgaggtcaggagattgagaccatcctggctaacacggtgaaaccccatctctactaaaaatacaaaaaattagctggatgtggtggcggacgtctatagtcccagctacttgggaggctgaggcaggagaatggtgtgaacccaggaggcagagggtgcagtgagctgagattgtgccactgcactccagcctgggcgacacggcaagactctgtctcaaaaaaaaacaaacaaaacaaaacaaaacaaaacaaaaaacagaaggcaaaagagttgaagaaacatttcactgaagaggatgtatagatggcaaataagcatataaggagatatgtaacattattagctatcagggaaatgcaaattaaagccacagtgagagaactacctcaggatgactaaaataaaaagtagtgaaaatacgaaatactggtgactgtgcagggaaactatgctcatggattgctgataggaatgtgaaatggtacagccactctggaaaacagatctggcagttaccatcctgggtatttatcccagagaaatgaaaactactctgtatacgttagccaggcatggtgatgcgtgcctgtaatcccagctactccggaggctgaggcacaagaattgcttgaacccgggaggcagaggttgcagtgagccaagattgtgccactatattccagcatgggcaatagaccaagaccctgtctcaaaaaaataaaaaataacttatctgtacatgaatgttaatagtagctttattggtaatagccagaaactggaaacaaatcaggtgttttcaacagtgaatggttaaacaagctgtggtagatacccatggaatactactgagcaatagaaaaggaaccaactattggtacatgttgagtaccctttatctgaaatgctggggaccagaagtgttttggatttcagattttttcagattttggaatctttgcattatagttactggttcagcatttcttatccaaaagtctgaaatgcatttcctttgagtgccgtgtttgtgctcaaaaagtctcagattttggaggtactcaacctgtacatgcaacaacctggtagaacctgggttggggtagaaagccaatgtcaaaaggttgtatactgatttaattcagacaacactcttgaagttacaaaactgtagaaatagagaagagattggtggtttccagggcttaaggaagggattagggtaagggaggtgagtggatgtcaccctaaagggcagcccctcgggatcctggtggtgataggacagttctgtggctgtgtccacgtcagcatcctggtgaccctgtgatatagtgacacaggctcctaccatgggggaaagaaggcacgtgagacctctgtatttttacttccaactacacgtgactacacttatctcaaaatgaaaagtttaattaaaaagaaaaacctcggctgggcgtggtggctcatgcctataatcctagcactttggaaggccgaggcaggtgggtcacgaggtcaggagatcgagaccatcctggccaacatggtgaaaccctgtctctattaaaaatacaaaagttagctgggtatggtggcgggcgcctataatcccagctactcgggaagctgaggcaggagaatcattcgaacccgggaggcggagattgcagtgagccgagatcgtgccactgcactccggcctggtgacagagcgagactccgtctcaaaaaaaaaaaaaaaaagaaaaacctccccagacccctactggtgataggagaagacccaaaccaaacccttggtgtgtgttcttcctccccactgctccgtccacctctctagactcttgtgtttttgccacccgcatggcctcagtgttagtgacttgcccagtaacatagctctggagcctccacaccctgaggggctcctctaccctcaaaacacccagggccttgccttggggccttctgttggcctgctgggtgtgagtgggtgggttccggaagtggtagggccagggtaagaggtgcccatgatgggggcaggctgggccctatggagatagcccaacagagggagggtaaaaagcccacagaaggttcaggaccagaatcaagaaccatgtgtatttttctccccacatcatgagtttagtgtcagatattatttacaaacattttaaaagcagggtcagcaggcccggaggattgcatgtccagtgggagtgggggaggggtggaggccactgagggtgggtcagcggtccccagggttctgtggcttcttccagactggcttggaaaaaatgcttttattttcttggagttcccccatgcagatgttaactttaggagcaaaggaaagacaaaggctacatttcatttctgagtctatagatgtatccgctattgggaagaggttagaggtcaatgactaggacagtatgtcccatgagaatcgagggaggattcttgtctgtatgtgagtgggaagtggtgaagcctcacagcgttgtcaggcaggtgtggggtggtgattggccttgacagagtacccagccacccttcctcactgccctctcacgccatttctcctggtggctccacacaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtgagtggggcccggggcagtccacacccgtcatcattcccaagcctctcagttgttattgatggaaaatgtaattgaatcatgtgccttttaaaaatagactattttttagagcagttttaggttcacagcaaaattaagtggaaggtacagtttccatacacccccttttccccccatacacatatagcctccccactgcagacctctcgctccagaggggtggatgtgtcacagttgttgaaactgcattgatgcatcaccatcaaccagagtccacagtgttcactcttggcacattctataggtttggacaaatgtcaccatgacagtatcacacacatacacatctacctttgcttattactcttaaaaacttttaggccggatgtggtggcacatgcctgtaatccaagcagtttgggaagccaaggcgagaggatcacttgagctcaggagcttgagaccagcctgggcatcatggcaaaaccccatctctacaaaaatacaaaaattagccaggtgtggttgcatgcctgtactctcagctacttgggaggctgaggttgggggatggcttgagcccaggaggcagaggtttcagtaagctgagatcacgccactgcactccagcctgggcgacagagccaggccttgtctcaaaaaaaacaaaaaaaaacaacaacaaaacttttagatccaggctggcagcacatacctgtagtcccagctactcaggaggctgaagtgggaggattgtttcagcccagagttggaggcttcactgagctatgatcacaccgctgttccccagcctaggtgacagaatgagaccctgtctctattcaaaacaaaataaaacaaaacaacagaacaaaacttttattataaagttaatataaccacattgccggaactttaaaaaatagagatgggtggccgggcgcggtggctcacgcctgtaatcccagcactttgggaggttgaggcaggtggatcacgaggtcaggagttcaagaccagcttggccaagatggtgaaactccatctctactaaaaatacaaaaattagccaggtgcggtgatgggcgcctgtaatcccagttacttgggaagactgaggcaggagaatcgctggaacccgggaggcagaggttgcagtgagctgagatcacacgactgcactccagcctgggcaacagagcaagactccatctcaaaaaaaaaaaaaaaatagagaagggtgaggaaaagcattcataatcaggcccctgcagtactgtttttcagtatgaccattttcagcattgaccgtgtatgttttctgcctgattgtagtcaaagagcatcccattctgagctgggcacagtggctcacacccgtaatccctgcattttgggaagccaaggcaggtggatggcttgagtccaggaactgataccagcctgggcaacatggtgaaactccatctctactaaaaatacaaaaaaaaattagccaggcatggtggcttgcacctgtggtcccagctacttgggaggctgagggagaatcaactgagcccaggaggttgaggctgcagtgaaccgtgatggtgccactgcactccagcctgggcaacagagcgagaccttgtctcaaacaaacaaacaaacaaacaaaaaagagcatcccatatcccattctgcttctctcagtgacttttgtcctgggcattttccagattaacactcaatcttcatcatcccctcttgtgtctaagttttaactattccaaataacatgacaagtaatagttgctttgttgagcttttcaggtattttggattatttccttaggttcatgcaacagttctcaaagtgtgattctcagactaacagagtctgcatcacctgggaacgctgtgttacgaggcacctcagacccactgattcggaagccctgagggtgggtcttggcgatctggcttttaacaggtcctctgcttgtgagatcctctgggccagcacattagttttctattgcttcagtaacctatcaccacaaacatagcaacttaagataaatttattctgcattcataagtcctctgacatgggccttgccaggctaaaaccagggtgcggtcagggcatctttcctttgtggagaccctagtggggatctgcctccctgctcactctggttagaagaattcagtccctggcagttgcagtcccatttccttgctagctgtcagttgagggccttcttggcttctagaggtccccacttttcctggcttggggacacttcgtcttcaaagccagcaatggcaggttgagtcctcctcacttctcagctctcttgtctggctttacccttcctttttttcttttttttttttttatgagatggagtcttgctttgtcacccaggctggggggcactggtgcagtctcagctcactgcaacctctgcctcctgggtttaagcgattctcctgcttcagcctccggagtagctaggaggactacaggtgttcgccaccacacctagctaatttttctatttttagtagagacggggttttgccatgtcggccaggctggtctcaaactcctgacctcaggtgatccacgcacctcagcctcccaaagtgctaggattacaggcgtgagccaccacccccggcctccccttccactttttttgtttgtttgtttgagacagagtctcgctctgtcgccaggctggagtgcagtggtgctcttggctcactgcaccctttgcctcctgggttcaagtgattctcctgcctcagcctcccgagtagctggggttacaggcatgtgccaccatgcccagctgatttttgtatttttagtagagacgaggtttcaccatgttggccaggatggtcttgatctcttgaccttgtgatcagcccgccttggcctcccaaagtgctgggattacaggcgtgagccaccacgcccggcctctccccttccacttttaagggctcatgcaattggatggatcacctggaaaatccaggaaaactgccccatctcagggtctgcacccttaatcctttttttttttgtattcttgtacccttgatcctatctgcaaagcccctttggctgcttaaggtagcatattctggagattaggaactagacatctttgggggccactattctgcccaccatagctagagaaccaaaaacggctaatcagtcaagaaggtaagatttttatggctcttaatacttattgccaaattccttttctggcatgtcagacagatacatagtagtatggctttaccacaccctcaacagcattgggttttgtgattttccttctctgcagtggttgctagttgaaaaatttgtctctgatgttttgattttgcgtttcttgaattactagtaggttgaacatttttccatgtctttgtttactgtttggacaattttgaagacaagagaatattgatgttgactactccgcaaggaattacttccactttctgtctcctccccctgtcctactgcctgtgttgagtgctgcagaaggaggttgaagacatttcagtggagtccatgtctctcaggcagcttcgtttcctggaggggagagaagcagtgccctcagacatggggaatgaccacatgctgatgggggcacagccacacactcgggggcagagactggcttagggccgggtggcctagaggaagggctgggctggagcaaagccagagagaataggatcattctaggggagggcccaaaagacagcctcctgcagactcggccatccctgggtgagaaagcagcagcctggcccatggacaggatgtttcaacactggccctgtgccatccttccagggggcctgacctgtcagaatggtgggtaactgttgccaccttggtcagtgggcttgtgggggagctggcagcctcgtcccagtgggtgctgggctttattctagccttggctttgcaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtttttctgtagccacagcctcagttcctttccacagtgcacccaagctgcgtccccaggaagcgtggcttctggggtcagagctgccatctgggagaggctgtggaagcccaggccagaagccaagtggcactgggaagaccctgcctgagagggaagcacagtaaactccacaagctaacagggcactcagtgggaaagctggaactcgccctggtctggtgacaggtggttgtgcagccacttgagtgtcttctctggtgtggaacttgtctcccaaccagggcagcacgcagagtttcagcccagctcgttaggagtctctcagcctgagggtcagggaaccagagcttcagcacctgggagcggggcagcatcagggggtcggtggggggggcccctctggcctgtgcccggctcctcccaacctcctgaagctgagtgtgctggggaggggagctgcatgtgctacaggtttgccaggtaacccttaggcacccagtctcaaggaccacactggcacagcagctgggaccctcccctgttcacctgtccccatgcttttcttgccctcttgagactgccaggcttagcctgcaccctgcatggatgggctgtgagcccacaccagcctcactgcagggctgcaccacacgaagctttcttccatcctgatgccctcatagggtctgcacctgcagactcctactatgagccttgtgcccagagccatcccgcagacagggctgtaacttgccaaggccccatcctttcccagttgactgggcagagcatggggacagccatgtgttcctgctggcatcctgtcccggaagagaagggggcagtgtgtgctccttgatgggaggagaggggatggggacgggggactatcagtcactctgggctctcctaaatggataccccaaggattcttgagggtagagacaaagccctcagagttggcctgtgcccccagggctgtggtatgtgggtgtgtgtgtaacctgaagaccttcctcactgtcctgggccctgagtacccctgaggaaacatgacattgccttggggtggcagacccagtgttgagccctagtggggcgggatggctatacactccagtgtcatctccctttctcctgagggtgaggcgcaagagcatgggttcagagtaggaaccccactctgtgggtctcagacccagcacttcctgtgtctctgctaccacctggcaggccagggcaatagctcctgcagacctcagaggtttctggaaaggaggagcaccagacatgccccaccactctccagtgcgtcctgacaacatgctggctggcaacatctcacctgagccaccagccacagccacaggtttgcaggaggcctctggtctgcaggggcaggaagggctcactgaggtcctgcacagcctggggaggggtggagagtgccttggagttgggcgcagcctggccctgccactgtcagccttggggctaagctgggtttctaagggttacacctgataccccggagctgaggcagcccaacttgtgctctccagtgtggctaggctcttggtccctgctttcatgcaaaaccctcctcagccttcaaagtccacttccttctggcagccatcctggccaaaaccagcaggccagggctccgggctccagcagtttgcctgcgtggtggtcaattgtctgtgggttccttctacatcctagtgccatgtggatgatccttcattcctcccatacttctcagtcttcccctaggggtgcagtggtggttgggagaaatgagggctctgcccatgacacccaaagttgccatctactgcaagggatgtatgtaccgggtcgtgaggtgagactggggatggtcctcatcctgagagcagtggtggatagccacatgtgagattaaaaagactactctgggtggcagacaggggtgggcagagatctaagacatttaggaggtcctgggggattggggggcaccatccaggtggtgccctccctggacaggtctgggggaaggagaaaggtgatggaatttgatatgcctattcatgacctccatccagctgaggtgagtgtcccctccagcccagggggtcagtgcctctaaagccaggagctgggctgggacagaccttgcagccactgggacctctgctggcctctattgggagccgcaatccggatcctccgtgggaggggccccagcactgggagggcattgctgaggtcagggctgtgcccaggctgagctgcccagaagtggttggcctgtttatttgtccccaggtagttgcattcgtgtccacactagttccacttctctttcagcccaccccacctccctcctgcaccagcatggctgagtgaggggcctgctcctccccatcccactctctgcctgtgccagcctggtgatgcccatggccttgggcctttcagtggctcctcctccaagccccctcctccagccccacccttcggggctatctggccacacctggacagagtctgcctgccctccctcagtgagcctgtgggccgcatgtggcctgctccccaaagaacggaggtgcccgctccctgcttaggccttctgccagctctcaagtccccaaaagacaaacatcctcactaggacctggctacacacgggacatttgtgctccctgcccaacttccagagtcggtctgccccagttgccccccggggacccgcaccctgctgcctcccagtccaagtccagcttccccgctggctccctagggcctgtccctctgtcttgctcccttcccacaccttccttctgctctgtgctgttacccaccttacctgatgcaggagttcccactctctagccccagcctctcctggaaatccgacagccagcagaatccaccgcccaggctcccccagcccccttcactcctcaactaggactgcagggtttccatcccgggggtctccttctgtctttacctctacttcctaccgcagtccacagcctggccattctacttcctctgtatctctcccatccgtccctacggagaccccttcccccaggcctctggtccggaccgagtctaccacaggcctcaagcatcctgctcggtccgccccttgcgagctctgagtgcgcaggagtgcgcagggggagctgaccgcacaccccagcactacaaggacttcgcggtggggtgctgtggagttggctttcggcctcgacctgggctgtctgcgggccccactcccttggccggttccgaggcgctgggagcgggggtgggcttgcggagtcgcgtccgtgtccccgatccgccttcccgtcccgggcctggcctacgcagtgggcgcgcaggggcggctgcttcggtagatgtctagggagcggagggaaaggcgcgggaaccggggattcctcgggcggaccctccctccaccagcgctcggcgggcctcctccaagttcgcccccaagtttgcgagcggccaaatgggggcgggggctgcgcggaggggcggtggctaggccggagggtggggtctggagcgcggggcgggcgctgccgcctggccggccgcggctggcccgggatcagggagccgatgtggaatttcctgcccggctcggcgcccctcctgccgccccccgcccggcctcgcactccgcttccggccgctctcgctgcggccgcacccgcgcccgtgcccgccccgcgcctgccccgcgcctcatggagggcgcagggccccggggggccgggccggcgcggcgccggggagccggggggccgccgtcaccgctgctgccgtcgctgctgctgctgctgctgctctggatgctgccggacaccgtggcgcctcaggaactgaaccctcgcggccgcaacgtgtgccgtgctcccgggtaggagccggcctggctgggggagggggcgagagggacgctctgggcagtggtgtggcggcgccgggcattgggagggggctaccggaaccttcctacgccaagtgtgggccccttcggctccctagccagcgcggctccgttccaggcccagcctcggccatgggccacgacagtgcatcccagggaaccctggacgagaagtcacctgaggggaggatggagtgccgtgggcacccaggggatgacacgcgttgtccgggatatcaggaaagacctggaaaaagggacccttgaccgagttgtgaagtccacggggaaaagctggggaagggcattcaagccaaaggaactgcatgtgctaaagccccgcactagtccgactggagccgggagtgggagtgaggaggaaggtcaggggaggaggagcggtgctagccggggaggtcctggagcaagccagacttggaaagacagattcgcgtcttagagcgggcgcgggtgggagggtggtgacccaggcgagcgtcgaggagccggcgctcgaagtggaccagaagcgggaggcggaaggactatgacaggcacaggggaccggaggatgtgggaaccctggcgacaaccaggtggggattctgggtgcaagaaggggccgcgcaaatgtggggcgccggctggggaagccagtgtgggacaggcaggcgacaggcccggccggtgggggggcgagtccgggagtttgcacggagggcagagaggtgagccccggacgccaggagttaggagctggggtcgggggagccggtgggctggccaaaggccacaaggtcaagggcatctccacgcaggggtgaggagcgggcgtgtgggggcgccttggcgcggattggagacgccgcacgggctggcagccgcagaggcggccgccgggctccgagctgggtcgcgtcggggcgcctgagccacggacccggggcaagccgagtccaggggctcggcgccagagacaaggggctgcgagggggcagcgcggggtttccgaactctggtccggaggcgcgcagacccctccccgctgcgagccccgcctccggggcgggggccggcctggcccgccatctgcttcgcatcgatgccgccgccgcggactcccgggcctccccggccccaggaatgcagcggcggcggcgggcggggcggtgcctggagagggggagggcgcgatcgccgtggtctctgtctactcactccagccctctttcccagacaggcccgggaccaggaatgggggtccggtgccaggctctagctgtccggagcctgagagccctttgctcccgctcccctggtctgcagacctcccaggaggcgcctgctccaggaaccgagcctgggtttgggttcccatcctggtgccaccctacccagctgtgtggacctgggcaagtcatttgacctctctgggcctgtctccacctctgtaaaatgggatagtgatcacaaccccctcatggggctaagtggagatcgctgtggtcatgagtggcaagggtcgatgggaaggacagccactctgggcactgcccacctggggtctgggtcatgtctttgttgtcctcccacatcttgcaaggcttccatcagcccttccctttcctgggaggcaggaggatggggagaggagagtgcaaagccagtaaaatcctatgcacctacactgtgccaggcctgtattggtgtagggaagctgcagtggagaccctgaccctgtggcagaggagacacagtccagaaaagcaagtgtgtctagacatctagcaagagctgggaggtgttgggttggggagtgctgtttcctttagggtgttctgaggagaacggctgagaaggtggtgagtgagcacaggcctgcagaagagcacggaggccctgtgggtgtctggggcaaggttcccaaggcagagggcctgtggaagtacaggaaggatccaggaggctgggcagagtccaggaggggctggcggaggagctgccagagagtgagggtgggcaggccaccgtgggctgccactgctcagaagacttgggcttttcttctgagggccatgggaccccctgggggctttgtacagagaaagggtgggatctgaccaggattggctgccaggtggcaaacacttcgcaccctggggggcagggggtggaagctggggccagttacaaaaagccagggagatggagggtggctctcacaaggctgggatagggaaggaggaagtgatcccattttagatatcgtttagaagctagagctcagcgtcttttttctcaatggatctggtgtagacaagaaagaagagtcagagatgcttctccaggtctcagcttcccagcctgaaaggacaggcagggttatctgaggcagggaagactcagggtgcaaggaggtcaagagttcaggtttgggctggttgggcatgaggcccatgaggtctccttctggtgacatcatctattgggcagttggatttgcaagtctagcattgatggggagagccctgctggagggtccaaggtgttgtcagtgttcagtgagcttcccgagggagctagtgtggacacaagagagatctgaggatggggacagaaaccagaggagaggtgtccaggcggggcagcaggagggtcgggctggtgtggggtctgaagggtgtggcaggcagagaagcttttctgcctggatttgggggagaacatggacaggtatggaccccatgagccaacttgaagatgtaagaactcacagtgggtttgaatcacagaactaatgctctacgagggagaagcctacggcatgtcttgcttgctgaggggcctgggcccagcctatggcctggcttctgagggtcttgccgacttacagggcaagcgtgggagcagccctgcagcaggccatctttccccacccgtctttgtaagatcttcagagagtgggcttgccaccaccacccggccttttctgccagcccttccaagaaggaaagcatcttgttctcagtgaacccaaatggactctgtcctgctggtgggcattagctctgctggggttaggcctgggtgcccgctaaaccagagatgaccgagtgcactcagaggcactgcagcctgtgctcaggatcctttgtgcttagtatgtgccaaaccacttcataggtcttggcgcgcgctctctttctctctgtcgtctttctctgtctctctctctctcctatctctatctctctttttgagacagggtttcactctgttgcccaggctggagagcagtggtgccatcacagctcactgcagcctcaaactccttgggctcaagcaatcctcttgcctcagcttcctgagtagctgggattataggtacatgccagcacgcccggcaaaaaaacatcttggctctcttaatctttctacagtagagccctactatatagctaaggagcctgaagctcaaagagcttaagctgcatgcctgaggtcacacagcaagtggcaaacccagacatcaaacccagctgagtgtggccctaaaacgagggtcctagccacagagccttatgtccagggcagaagggggttagtgcttccggggcaattccagcaggccacctggcaaagctccccacaggagggacacctgcagaggctctccatccagtgaacatggttcagaagcagacacaagtgggtgggtgatggccagcagacctgggtctccctgcagatgggcaccttggtgccccctgggtcagggctgggtgggtggagacagtgggggcaggggccaggaaaagccaggcctttgtattcctgtctctggtttccagttttattgtggaaaatacactggaccaattccccaaagtttgagattttatggtcctgttcgccaggtcccatctttggcctgaaggagaaccaagccttgttcaggaggaggggcctcgaggcctaggtgctctgtacaaggggtggtattctgtctagctggggaatggctggggcatcctcggaagcctgggcaggagcatgccaggcatgtactatcctgaaatgcatggtgtagggccagtctatcccatcccgctagggtcttcaggcttcctcccaaactccgccccccaccaccttccggttctagattcagatactgaatccaagcctgcttgtgaagaagcgtgctccttttctctaaagtgcgaatggctgttacatgcctttaggatcgaggcgaagttctgggtcggctgggaacctaggatcccgcagccttggtggctcttccttctcagcctcctctgcccctgaatgtgggctaaccccagctcatcccctacgaaccctctctagccatcatggcttcactcaggcagggcctccaaacctttgtgctcacacaccccatccacccagggttttagaggttgtgctctcctgaagtgctgcggtagcattgtgtactctgtaaagccaaatcaaatggaacaagtggaagacaatcagcataaacaggccgggcacgctggctcatgcctgtaatcccagcactttgggaggccgaggcgggcggatcacctgaggtcagagttcaagaccagcctggccaacatggcgaaaccctgtctctagtaaaaatacaaaaattagccatgtgtggtggcacgtgcctgtaattccagctacttgagaggtttgaggcaggagaattgcttgaacctgggaggtggaagttgcagtgagccgagatcgtgccactgcactccagcctgggcaacagagcgagactgtttcaaaaccaacaacaaaggcataaacagatgctctaatagctccttcctccaccctggtccctgagcccttttgccacagtttgactttcctcctgcacgtggaggactccccatgtgcctgctccttccctagtggctgggtgggcctcaccccacctccctccagaagcccctctgccaagtggtcacctcactgtgtctacatgccaccccccgtccccctgtccagaggctgcccctccccactggagctcaaccccaactgggcatctaggtgtgtccctgtggcccagctagtcctagtgccgtcctcatcatgtcacatcacatgacatctggatccatgacacccattaggctgggccctccacttggagggatgccctagaccctcacatttgggcaggtcctgaggcccatggtcttctccctggctgctgcctcactgctgtccttcctgggactccaaggccacttttctcaggcctaatggctgtgggaggaggacacaaaggagttaggtgagatggggtgggtggttctgggctggaaagttcttggcggtgaggtctgtttgtggcaatcctccaccgccagacgactgcctggcaggacctcattaaccacccccctaggacaggagcgcaactgcagaggcagggaggctgtgcggaggctgcggaggagcccggagcagatgggggctgggggaggggcatcgggcttagatgtcctccctctgctcgcagctcccaggtgcccacgtgctgcgctggctggaggcagcaaggggacgagtgtgggattggtgagtgggtcatcccggggacctggggcgggggagggggcggggctaggacgcgcagcagctctggcctgtctcgtccacagcggtgtgcgaaggcaactccacgtgctcagagaacgaggtgtgcgtgaggcctggcgagtgccgctgccgccacggctacttcggtgccaactgcgacaccagtgagcgtggggtcgggccggtattggtcggtggggcggaatcctggagagatggggcggggtccaaggtggggcggggtcggatccgccttcggggcgggtccccagaggtggcggctggagtgcgggacgcgggcaggttccggctggctgggggcacctactcaagcaccggggccttccaccccctccgctcctcccctgcagagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtaagcgcggtctctcggccagggagggaggaggtggaagggcgggccgccgatggggacaggggtgaggcgggtcccagccttccctagcctccgacccctcccccaggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgagcagccctgcctgcgtcggcccagacacgcagtcccccgccctgcctccctaacaaaggccccaatgtcgagggcgctgtggtccgtttgcctccatttctgctgacgcctcctcccctctttccaaggtgcgagaccaagtgtagcaatggcacttacggcgaggactgcgccttcgtgtgcgccgactgcggcagcggacactgcgacttccagtcggggcgctgcctgtgcagccctggcgtccacgggccccagtgagtgccccgggaccgggagggggttgggggcttgtacctgccacagaggggggtccagccgacgaggtggcctctccaccctgagctgggttatcacctcagccttggtcccttaccccagctagggagtgacagtaggctctttgggggcagtttcctgcctggatgtcggggagctcacgttcagcgcaggatctggtgaccagtccagcctgtgtcagtgggctcttaaggtgaccccgagttggtacagaaggaccagggacctccacttacagccaagggtctggttcagcagcccctcttcccacctagccgagtcagccccagcagtgggcgctgcggcgcggccaccacgggtcctatcccccaggcccccccactagtgttgtgcaacattcgtttccaaaacatccactacccaatatgtgccacgggcggggcggggcttcaatccctagacgacgaatgcagcgagagagagcccggttctgggaccctggaccctgggccctggccgcgggtgaggggtgagggtagggggcatcctaggggggcggctgtggcatgccttgaccctatgtcccggcagctgtaacgtgacgtgcccgcccggactccacggcgcggactgtgctcaggcctgcagctgccacgaggacacgtgcgacccggtcactggtgcctgccacctaggtaagtggatgaggggcgtcccgttaaggaatgcagggggtgccagaaaccgcgctgaccccataaccccctacagaaaccaaccagcgcaagggcgtgatgggcgcgggcgcgctgctcgtcctgctcgtctgcctgctgctctcgctgctcggctgctgctgcgcttgccgcggcaaggaccctacgcgccggtgagcccagatactgccccgctttcgcctgggttcaggccgcaccctctgggtgccaccggacccagatccaacccttccgcgcccctgccccggacgtggccccgccccttctgtgcttggctccggccgagatctaatcgcccctgggccccgccccggccccgcccctccgctcagaccccgcccccgcagggagctttcgcttgggaggaagaaggcgccgcaccgactatgcgggcgcttcagtcgcatcagcatgaagctgccccggatcccgctccggaggcagaaactacccaaagtcgtaggtaaggatgacagcgcggggtatctgggagaaacacctctcgacgcaggaagctgctgggaaatgggtgtgagggggtccagatctcagtgaggaaatgggggaccttgagtgttgatgtgcgtgggcgcgaggaggtgcgaccagagggaaggtaagaggtgtggcagctgctgagggcgaggcaaggtaggaaggcaggagtcctaggtgcgccggctgatgtgggcatatgtcagaaacgttggccctgagagtgatcgcatcaggggtgtgtggacatctgggtcccgcaggctcccccagtctgtaggagaatgctgtatatcccggccagagctgctgggggaatgcgtggccacgggagtgccctgccccacggagaggacccaccctcctgcctacatccccagcagtacccagagatcctcctggaaagtgggcaggctggtccccacccaccaacaggataggggggtggggtgtgccgcttctctccatgctgacttgcacctgggtggaccctctcttcctctctttcccacttatttctaaagatggaggggaagggggctcagactcttgggagatgaaggaaacagctgagaaaaccccttagccaagccgggcatggtggctcatgcctgtaatctcagcactttgggaggccgaggcaggtggatcacctgaggcctggagttcaagaccagcctgaccaacatggagaaacccggtctctactaaaaatacgaaagtagccgggtgtggtggcgcatgcctataatcccagctactctggaggctgaggcaagagaatcacttgaacctgggaggcagaggttgcagggaggcagaggttgcagtgagccgagatcgcaccattgcactccagcctgggcaacaagagcaaaactgtcaagaaaaaagagaagagaagagaggagaggagaggagaagagaagagaagagaaaagaagaaagagaaggaagggagggagggagggagggagggaggagaaaccccaaaactgtcgaaagaaaagaaaaagcaagcaagcaagagagagaaaaccccttggcccacctagcagcatggcatctggggacataggtgtggggagtggaccccacatccctctgtggaatggaggccaggctagccagcttctggggccccctgttgtggggtctgcatctctggaggccaggcctagggtgcagcttgctgagatgggctgagccaaagggcagccctgccactgcgcatttgggctcagaagtgctccaaggcttccttattcgcacaaggcagggcctaaaacagagcttggaggccttggtggcctgtcccagccaggtgtcttcttcagccccgtctcccacctttctggccttttctcaacacgtcagcccaaccttttccagctccctggatgcacacacttgccttgcaccttaacacatgttgtgcccatgtttcttttctgggttcacctctacccattctccagtcctggcccagtgtcactgtacctgttgagttgcctgtgccccctgcagtccaagaatagggctggtcttggtcaccccatcaacatttgtcacagcaggggctaatgagggcaccggctggggcagagtggacccctggcagctctgcctcatccttccccagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgagggtaagtaaggccctacctgggcatcactccagcccagtgaaatgttcccatggaaaagctgtgttctgggtgggacacaggagaagggcaggcagcatggagaggaaggccttggccatgctggtacctgagggttgcccacagagctgaggccatagagctggactctgctgctcagtaccggagacaggtgtggggagatgggtaggccacagcccagggttgctcctgggggaaagtaggcagagagaagtttctgggcttaggtagggggtggcagaggagacaggaggaagggatccacagagtatgggagttggatccacacacagcctttgatccacagatagcagaaaggagcctgatggtctgggattctgccctgtctcctcccttgactgtgcccccagatgccacgggcaggtgaccaactcagagcctcagaagccttatcgctctttttttttttttgagacggagtctgcctctgtcacccaggctggagtgcagtggcatgatctccagtcactgcaacctctgcctcctgggttcaagcaattctcctgcctcagcctcccgagtagctgggattacaggcgcccacgaccacgcccagctaatttttgtatttttagtagagacagggtttcaccatattggccaggctggtctcaaactcctgacctcaggtgaccgcagcctcccaaagtgctgggattacaggcgtgagccaccacgcccagctagaagccttctctcttaaagaaggataatggaacccctgtggggatgttccagcctcaaattcgatgatgcaggcgcccaaggctggaggggtgttggggcagggctgccaggccaggccaaggttgggcttcagtcgcgggaatgcgcccatcactccttgcacagcctgagttcagagtcagccgcatagcctgaggctctgaagtacacatgtgtggttggtgctctgtgccaggcacgtctagatgccagggtgacacagtgccaagggcgtgggtagaggaggaaaggtgaaggtttgcgcctggaggttggagcccctaaaggtattcctgaaggctgtgaccgccctgctcttcccttgccagaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagcgcgcgccgcgccccggcctcttggagcccacggacgccggcggtcccccgcgaagcgcgccgaggctgcctccatgttggccgctgacgtgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctcatgctctgatcacttcctgtttgcaggcttcggccaaagatgccccccagaagtaactttatgtgacgacctgtcctgcactctcccccaccccttatctcagcggggagccctggagcccaggcgtgggtctcccgggaccatggtggaagtgggctgtgtcaacccacaggcttcgtttgtttatcaagtttatgcggccccgatctggcctgccccattctggactggtcacggggaggaaggttgggtgggggcagatcaggcagagtccctgactgaaagggacaggcgatgggcctgcctcggatcccggccttttcccctggccgctgctgttaaacttgggcctcagagctgttggtggcagcttgcggggggtgcagaggctgcggccagggggccgcgggcgcttactccagccgggcctcctccagcacaaacaagccggtctcctgctgcacagagccctgctgtctgcctcaacgggttccttgtcctcagccggaaactctcctgcctgccagccccgcctgctactgcggaaggttgagggagacggagggagcgcccggggcagatcccctgcccccaagccagacccggctgcctggctatctgtgaccatctgtgccctacggcctcgctgctcctgacccgcctaccctcccgggcaggcctcctaagtgaccctcctaagccgcagaccctcaccttccatggcccctgctgtccccacactaagttcccccagctcctgcctgtctgttctcctcccacctcctgcctctgcccggcaggcctcttcttgttctcctgcatctcatcttttgatgcccagctcaaagtcttcccctgctgccaggatcttctgatcaccctgcagccgccacacagcactcattggtctcacgctggcaacttggggctctcgtcctgggcacactctcatcctctgaccagatgccccacggaggtcaactttggtcacccatcttagaggggtcacccatctcagaaggcccagccatctgagtggagactgcgtcctgccctgggtcggccgtccagagcagctggcaggacacaaacaggcagcacgtggaatgtgggatccctgcctctgggccatactgcttccctggagccagctgggcaccctcccagccatggccctgtggctggaaagcctctgctctgtttgggcactgcgccatgcgggctgctggggttaaggccaagagggcagatgcccagccgggctccgcgagggcagggcagtgcctgcgtgtgggtgaggggtgggcagtgcaggggctcagaccacattcttgtctaggcggtgcccaccccccagaacgatgaggatgccacactgctgttccctgaacccccaagccctcagctcttgctatttctcctcccccagcctggaccagcacgatttggagagaacagggatgtcccagtgaccaggcctttctggggacctctccttgcccttctctgggaagccccctaggtgtcgaagactctacctgtgggtgcctcacaaaacaggggaccccccccaacctaccaccagccttcccttccccccaggagggttccagtggctgctgggaagggagctgctgggacccctccagcctcctgcctcccaccacccgcttctccccaccccctcggggctcacagcagtgccagctcccagggcaggcgccacaaaagggaaccgcggctgctggaacctccgttgccatggggatggggaccacaggacccacatctggtagcgattgaggaggaaaaattatgagtggtggaaaacgcaaatattttttgtagcacagagcacaatggagtgggaggaatgtggggaccaggcccagcctggtggttacaagcagacgcaggccacagcacacagaggcctgcagacactaaccctacgccgcatgcacgctcctctagactcagaaacaccaacacagacacacagcccgaaacgcagacatgcacacacaaagccagcagaatctcagaaacacagagacggcacacacactgcaacagacgcccacacagcactgggcccagaggaacacagccactcacctgccaacacacacacacacacgacactccatcagacagaaacactcactctccaacacacacacacaacccaccgctcacagagacagacgcgctgtgacacacacacagccagcccactactatggaggacactcaacccacaccacgcacataaaaatggaaaaaaagactcactctgcaacatacaacatgtatcaccagacacagaaacaccaagacagagactcattgcagcacacacaccataggccacatagaaaccacaagatagacacaaccctgcgacacacacacttcaccaaagtcagaagcagatatatatcatacaaaatacacgtgcggccgggtacggtggctcacgcctgtaattctagcactttgggaggacgaggcaggcggttcacttgagatcaggagttcaagactagcctggccaacatggtgaaaccctgtctccactaaaaatacaaaaaattagctgggtgtggtggcagacgcctgtaatcccagccactcaggaggctgaggcagaagaatcgattgaacccgggaggcggaggttgcaggtgagctgagatcacaccactgcactccagcctggcgacagagtgagactctgtttcaaacaaacaaacacacaaaaaaacacacacctgcacacgacccgacacactcagatactgagacaaacacattccctgcaacacacacaaacacacaatccatgatacaccgacaaaagagacactcatcctgcagacacacatcttccaccagatacacggaaacatgagagaaacacattaaacacactacctgcagcacatagctcaccaccagacagaaatgcagacaggctgggtgcagtgactcacgcctgttaatcccagcactttgggaggccgaggcaggcagatcacttgagatcaggagtttaagaccagcctggccaacatggtgagaccgcatctctactaaaaatacaaaaaattagccgggcgtggtggcatgcgcctgtaatctcagctacttgggaggctgagctgggagaattgcttaaacctgggaggcagtgtttgcagtgagtggagatcgcatcactgcgctccagcctgggcgacagagcgagactctgtctcaaaaaaaagaagaagaagaaaaaaaagaaatgtagacacagatatgcaccctgcaccccccacatcacactcacagaacacacctcatcctgcaaaacacacacacacacacacacacacaccctctgacacacagaaacaccaagagaccctcactctgcaaccatagacaccttccaccagacacagagaaacagcaacttatacaacctgcaacacacacatgtgccaccagagccgactaaatactgagacacacacatcagccaacacacagaagtgtaaccatcctaccgacagatggcatacacagcatccatgccctactaagcatggaggcgggcacccaccctaagatgcactcactgcactagaaacagatcatgaggcccagcgtggtggctcacgcctgtcatccccacactcaggaaagccaaggcaggaggcgcacttgagcacgggaattcggatagtatctgtggtctttcaccctgcagatacacacacagacatgccaccaggcacacagaaacaccaagacacagtgggaacacgcacactggaacacacaaactcctacacacacaggagaacgcggaggccgctggcagtactgaaattcatctcagccctgggttccagggaaatggtgctcactgagaaattgcctcttcctttgcgttctgagaaatagtgagaccagaaggagcactttgcccttgtccattctaagaccccgcctccagccttccacatgagtctcttatttaccaggcccctccttcctcattagtgagttttcttcccatagcagtagcctgaataaagtcatctctttatgtgtctggtgcattccccccacagtctttgtgccttgacctggcatgggttggacttaccttcccatccccaatgactgcaagcaggtggtgagccctctctgagacccgcaagccgcccctgactggccatcagggtgggggaccttcagtgagtatgacccctggttgtgtgctcctggcttttgtccgttggtggcatagtgacaactttattttgattctttcagtttcatggtctgaacatttggtggtctctttaaacagattggtggtttatagacgtcttgtctctgttgggtgagagacgacagtgtgtggtttgagagtcttttctgtttgttcatttgtttaattgagtttagttaaaaatttgggctaagattggtggctcacatctataatcccagtgctttgggaggctgaggtgggaggatcacttgaggataggagttcaaaaccagcctggaaaacatagcaacccccatctctaaaaaaaaaaaaaaaaaaaaaaaaattaaaaatttagccaggcacggtggtggtgtgcacctgtagtcccagctactccagaggttgaggtgggaggatcccttgagcccaggagtctgaggctcaccactgtactccagcctgggtgacagagtgagaacctgtctctaaaaaatccaagaatttgtccccagtgggaagatggtttggagatgtgatcagccacatccatggatggagctgtgctgtcatttaggtaggttggattggctgtcatatgcataggtaagcgacacacccaacagttagtatgcttgaaaataggcctgttccttgggtggggctaacatgcagaggattggtaaagcctcctgagagggcggtggggtcagggctggggttaggagggcagaggtcagggctagggttaggagggcagcctgtaagagttgaaaacaagttagtgaatttgtggtggttgggctgccagggaggaagaggagtgggaagggtgggaggaaggcctttgacaggggtacagtaggaagcagggtgtagaggagtcaacctggggccagttcagttgttgtgtggacggtggacaggggtcatctatcttcgggtgaggtcattgtctccatgagtccagctgcagggctgaggtcactcacctggtaaagaagctggttggggtgagctcctgggcctccctgagtctgcagtgaccttcgcccaataatggacctcgagacataaccacagcactgtggttggacagtgccagtgaagaagccattgtcctgctgtcacattggggataccgtaattccaaagctgcctgctgcacacaccccaccagaggtattccagcggctgcttcctattaatagtctgacgtgcattgtgaggggcaaaatgtgcacacatgacactcattcgagagcctcagcagtgggcattccaattacactgctgcttcccgtgtgtgtgtgtgtgtgtgtgtgtgtgtgtgtgtgtgtgtgtgtgtcgggggggctcctttatgagttaattttttttctgaaacaaaaaaaattgcttaaattacttatttggccaggcgcaatggctcacgcctgtaatcccagcactttgggaggccaaggagggtggatcacttgaggtcaggagttcaagacctgcctggtcaacatggtggaaccccgtctctactaataacacaaaaattacccgggcgtggtggcgcctgcctgtaatcccagctactcactgcaacctccgcctcccgggctccagcggtcctcgtccctcagcctcccggtatttgctggttttagaggcggagtctcggcaggtcgacccggctggagcgcagaggctattcccaggcgcgatgccactactgacgcgctccgtttccaactggggctgcctcgcccctccctaggcggcctggtggcagaggccaccatactgatgccggcttcagtgaggacctggatcggcacagcgcactgcagcgcagaactcccggtcacgcgattctcctgcctgggcctcccgagcagctgggaccgcaggcacgcgcggcgccggcccttggagctcagaaccgcctttcggactgcatccggcaccaggcagccagcggctagtgggggccatggaatcgtgctgccatctggcggctggatgggtagctgctgctttttttttttttttttttcttctttttgaggcacggcctcactctgaggcccaggctggacgcagtcactcaataaccgctcactgcagcctccatcccccgggcccaagacatccttccatctcagcctccgaaagtgctgagattacaggtgtgagccaccgcaccgggccggtgccaccttttttttttcttttgaaacagagtatccactttatcgcccaggctggagtgcagtggcgcaatcttggctcactgcaacctctgcctcccaggttcaagcgattctcctgccttagcctacagagtagctgggattacaagcgcgtaccaccaagcccgactaatttttgtatttttagtagagacggggtttcaccatgttggccaggctggtctcgatctcctgacctcaagtgatctgaccacctcggcccaccgaagtgctgggattacaggcatgagccaccacgcccggccggtagcatctttgaagagcctaaacaagtgggggtaacagcctgggggaacttcggcgcagttctgtttgtgcggcccggtggggcctgctacggggatgtggtgtcccaggcccagattatcccccaaagtaggcatagccaggtgaggacagccagaagtcagcgacaaatactgtgcagttccatgtatgtggagtatctagaggagtcaaattcgtagagacaggcggggcgaggtgcctcacgcctgtaatcccagcactttgggaggcggaggtgagtgaaccacctgaggtcaggagtttgacaccagcctggcaaaaataccaaaaatacaaaatttaccaaaaatacaaaaattagccgtatgtggtcgtgtgtgcctgtaatcctagctacttgggaggctgagggaagagaatcacttggacccgggagacagagtagcggtgaaccaagattgcgccactgccacggcactgcactccagcctgggtgacgagcaaaactttgcctcaaagaaaacaaatgaacaaaaacaaaacaaaacaaaaaaattagcagggcatggtgatgtgtgcctgtagtcccagctacttgggaggctgaggcaggagaatcgtttgaacccgggaggcagaggttgcagtgagccgagatcacgccactgcactccagcctgggcgacagagcaagactccatctcaaaaaaaaaaaaaaaaaagaaaaaaaattctgtagaaacagaaggtggaaccgtggttaccacgggctgggaggtatgggaattagtgtttaataggaatgcagagtttcagtttcgggtgatgaaaagattctagaaatagatggcagtgaatgtacttaatgtcactaaaccgtgcacttaaaaatgattaaaatagtgctcgcttcggcagcacatatactaaaatcagaacgatagaagtttctcatggcctctgcccaagggtgacacgcaaatgtgtgaagcgttccatatttttatttttattttttattatttatttatttatttattttgagacggagtctcgctctgtcacccaggctggagtgcagtagcacaatctcggctcactgcaagctctgcctccgagggtcatgccattctcctgcctcagcctcccgagtagctgggactacaggcgcccgccaccacgcccggctaattttttgtatttttagtagagacggggtttcaccatggtcttgatctcctgacctcatgatccacccgcctcggcctcccaaagtgctgggattacaggtgtgagccaccgcacccagccaaagtgttccatatttttaaacagatatatagaccaatggaacagaacagggacctcagaaataacaccacatatctacaaccatctgatctttgacaaacctgacaaaaacaagaaatggaaaaaggattccctgtttaataatggtgctgggaaaaccggctagccacaagcagaaaacagaaactggaccccttccttataccttatacaaaaattaactcaaaatagattaaagacttaaatgtaaaacccaaaaaccgtaaaaaccctagaagaaaacctaggcaataccattcagaacataagcatgggcaaagacttcatgactaaaacaccaaaagcaatggcaacaaaagccaaaattgacgcatggaatctaatcaaactaaagagcttctgcacagcaaatgaaactatcatcagagtgaacaggcaacctacagaatgggagaaaacttttgcaagctacccatctgacaaaggtctaatatccagaatctacaaggaacttaaacaaatttacaagaaaaaaacaaccccatcaaaaagtgggcaaaggatatgaacagacacttctcaaaagaagatatttatgtagccaacaaacatatgaagaaacgctcatcatcactggtcattagagacatgcaaatcaaaaccacaatgagataccatctcacaccagttagaatggcgattattaaaaagtcagaaaacaacagatgctggcaaggctgtggagaaataggaacgcttttacactgttggtgggagtgtaaattagttcagccattgtggaagacattgtggcgattcctcaaggatctagaaccagaaataccatttgacccagtgatcccattactgggtacatacccaaaggattataaatcattctactgtaaagacacctgtacacatatgtttattgcagcactatttacaatagcaaagacttggaaccaacccaaatgcccatcagtgatagactggataaagaaaatgtggcatatatacaccatggaatactatgcagccataaaaaataatgaactcatgtcttttgcagggacacggatgaagctggaagccatcattttcagcaaactaacacaggaacagaaaaccaaacactgcatgttctcacttataagtggcagttgagcaatgagaacacatggacacagggaggggagtatcacacaccggggcctgtctgaggatggggggctgcgggaggggcagcattaggagaaatacctaaggcatgcagggcttaaaacctagatgacgggttgacagctgcggcaaaccactatgacatgtgtatacctatgtaacaaacctgcacgttctgcacatgaatctcagaacttaaagtaaaatttaaaaaaataaataaaattaaaattaaaaaatgattaaagtaggctgggcatggtggcttaagcctgtaatcctaattactcaggaggctgaggtgggaggatcacttgaacccaggaggttgaggctgcagtgatctgcaatggcaccactgtactccagcctgggtgacagagtgagaccctgtttcaaaaaaaaaaaaaaagaaagaaaaaggttaaaacggtaaattttgttatatattttaccacaataaatagaatgggagtagaggctgagagcctgttgaattaggtactgtggaacactgcaaggaagcaaaaatagcaaaatatcggccagcaaaagactgaatgggctccatcctttcagtctgcaggggctggggcccccatggccccctgggttaaggtttcagcatcgactgtgagatgtcatttgttcttttccatttgaagaacacgtcaaattgggctgttaaatggagaaacagaggggatggtcaccccttctctcaatccttgaagtccctgttttaatttattttgggtcatattaatgattttaatggcttgggcaggtcctcagggtctcatctgccaagaccaacagtaagggacaaagtgtgggttttattccaattggagcatctgtcccagtgatagaaattcaagagcagaaagaactgagaccactggaatattctgcaaagctattgcaccagtgatcaggctaaggcggacttgtttgccttcaatcttatgtcccagggaacagagagggttcctcccttacatttagtggggtctctggggaaacagtgtcaattaaggccataaaagtttgcttagtgcgtgggaaccagtggatccccgtgtttgtgagagcaattgtcctttggtgagggtcaaggagtatgctgtgtccctagcaaggctggagtggtcacggatgctctattttgggggatgtgatgtgggctcacatcttgaggatttgggtttggattctctgtctaacttgttttagaagcgcctggacctctttggggtcttaccgtaaatctgattatcggagaagcccaggttgcaaagttgccaatcccagggttggggggtggccatggaagttctgaaatgggggctctttccttgtcagtagggtttggtgctttgggatgagaagacagggtcctggaatcaatcattccaggccatcgagggcctctgtaggagtagtcacatgaggccgggcatggtggttcatacctataatcccagcactttgggaggccaaggtgggaggattgcttgaggcgaggagttcaagaccattctgggcaacacaaggagacctcatctctacaaaactagaaacaattacccaggcatggtggagtgtgtctgtagtcccagctactcaggaggctgaggcaggatcacttgagcccacaagttcgaggctgcagtgagctgtgactgcggcaccacactccagcctgggtgacagagggagatcctgtctctaaaaaaaaataaaagaaaacaaaagtgtaatcacttgactagtaaggggagctgcacagccttataatttgtaggttctcccctgaaaaataactgccagatgcttgtgtcaagagcctttcttctagaacaccacggggttcggcctcactccagttcttctgccatacttctccatctcttccttaaactctaatccatgaatccagaggaggagttggcaagctacagcctccaggccaaatctaactcactgtgcattttcttttcttttctttttttctttttcttttcttttctcttttctttcttttattttcttcctttctttccctccctcctccccttccccttccccttccccttcccttgccccttcccctttctcttctcttcccttttcctatcctttcctttcctttttgacagggtctcactctgttgcccaggctggagtgcagtggtgcactgaaccacgacagatcaatgtaatgattggtgtcagcagtaaagggtctgtctgcggcaggagggggccattttccaagccacaaatgcccaacagagcaagggaaagtgaaactgaagggttaatttggccaggtctgcctgctctgcttgcttttgggtcatttggtttttaatttttttttctcctttttctgtgaagcttaagggccacagtagctgaaagccttgccgctgaatgctgaaacttaaccttccctggctactgtatagataacatgcataagtcaccatggtgccggcttcttcagttgtttttcaggaacttgggccagctcctgtccagttcaaactggttgagaccaccaacccttcaattgggcctgcacaagtgcccgaaaggtggccttttgacactggagggccaaaaactccgcctttggaaaatgctaatgctaccctcttctgtacacgtgtcttgtgaaatgccatgaactccagccatgctcacacagaaggaagctgttacttatcttcgggggacgaaagacttaaggacttaaaaaggatccacctccccgatcagtgcccttgtgaataaatcttttcttttttgcaaaaccatgtcatagtggttgatttactgcaccagcagaatgaacacgaacctggatggcaacaaaaggctgcaggtcatgcccaagtatgccgtgggggtggggagagggcagcatgtggccacttccaccggggaagtggatcccatcttataaattattagtttgagggtcaccatgtgctagcattgtgtttggcagtgtttgaagttaactcagagccaaagtgaagcaggcacaaaagccaaccagtgcttttctcatggtgtaaatccataattcttcaacacattttgaaattcggatccaggcacattgcagatacctgtttcagtttctgttccctccccttgtagagttgcattttgtgtgtgtgtggcctcctccagggagtcccaaatccatgtcatcgtatcaccctaggacaatggctgcctcgctgactttaggggcccaggacctaagctgagagcagagatgttcttcttcttttttagtttttcgagacggagtcttgctctgttgcccaggctggagtgcggtggcatgatctcggctcactgcaagctccacctcctgggttcaagcgattctcctgcctcagcctcccaagtagctgggactacaggcacccaccaccatgcccagctaatttttgtacttttagtagaggaagtgtttcaccatgttggccagaatggtcttgaactcctgacctcaagtgatccacccaccttggcctcccaaagtgctgggattacaggcgtgagccaccgcgcctggccagagatgttcttcagtgcggcaacacttactagaacccacacttactaaaaagtccatccgctttctagctatgcaatcgggtgatggcatccctggaccctttgggaagacctacggtaaaatattcaggtccatttattaaaaaatagaattttttttttgagacaaggtcttgctctgtcgcccaggctaaagtgcagtggcacaatcatagctcactagacttgaactcctgggctcaagcaatcctcctgcctaagtctccaagcagctgggattacaggtgcatattaccatgcccaactaattttttttgtttttttggtagagatggagtcttgctatgttgtccatgttggtctcgagctcctggcctcaagtgatcttcccacctcagcctcccaaaatgctgtgtttataggcatgagccactgtgcccagctgagacttttattgttttttaaattattctatggcccatgacacagccatctgtgtcatgaacggctgtgcccagccgttcatgttcttattgttgagttttaagagtcctttttggccgggcacggtggctcacgcctgtaatcccagcactttggcaggccgaggcaggcggatcacaaggtcaggagatcgagaccatcctggctaacacggtgaaaccccgcctctactaaaaatacaaaaaattagctgggcgtggtggcaggtgcctgtagtcccagctacttgggaggctgaggcaggagaatggcgtgaacccgggaggcggagcttgcagtgagccgagatcacaccactgcactccagcctgggcaacagagggagactccatctcataaaaaaaaaaaaaaaaagaaaagaaaagaaaaaagaaaaagaaaacctctgggcattaaaaatgctgtaacaaagacagaaaatgtacatgccaaggggatatatatgtgtgtgtgtgtgtctgtgcttatgcatctgtttatgtgtgtatgtgtatgtcatttatgcatctgtgtgtctctctgtgtatgtgtgtgtgtgaaataaaccaaagagaatagtggacaaaagacaagaacagaccacacatatgaagagaaaaacaaacggccaacaagcagggacaaataacattcttaaagcctcaaaatggcagatataaaaatcaaggccggaacgaccccatgctggccagggagtggtgacagcgtcatgggaggaacatgttcgtccagggaggaacagctcacagcgtcatgtcagagccgatgggaacagctcacagcaggtccaccagatcagattccacccaggaacaccaacgagcttcagtgttcataaccttcaccagttaactgcatttctcagaacgtactcagaggaaatgatcaaagatgggaacagaggcctatgttaaataattatttataggcacaaacaatcttgatgttcaatagtaagggaatagataaattaagatacaactgtaagacagaaaatgatgtggccaattatgtctgaaaatattttataacatagaaaatgcttatcataaaatgttaaatggaaaatgataaaaataatatgtagaatatgaatctaattttttttttttctgagacagggtttcgctcttgtttgttgaccaggctggagtgcaatggcacaatctggcctcactgcaacctccacctcccaggttcaagcgattctcccgcctcaggctcctgactagctgtgattacaggcaccggccaccatacccggctaatttttgtatttttagtagagacaggggtttcaccatgttggccaggctggtctcaaactcctgacctcaggtgatctgcccacctcggcttcccaaagtgctgggattacaggcgtgagccaccgcacccagcctaattttcttttaaaagaaaaaagatatgtatacatgcatagaaaacaactgcaagaaaacgcatctaaatgttaataatggtaatgatccatgaactgattctgaaggtgtttgttttgagacagtcttgctctgtcacccaggctggagtgcagtggtgccattatgactcactacagccttgacctcctgggctcaagtgatcctcccaccatagcctccagagtagctgtgactacaggcacgcaccgccatgcccagctaattttttttttttttttgtattttttgtagagatgggatctccctatgttgcccaggctggtcttgaactcctgggctcaagcaatcttgccttggcctctcaaagtacaggcatgagccactgagctggaacctgagggtcatttttattatgattttgtgatttttaaaaattttctgcagtatacatataatattcataatcagggaaaagtttttacatacataaaagaaaaacatcaagactccaatataaagagggacaaagggcatattcaaatatttttcaaaaagaaagatcaatagactgggtgcagtggctcatgcctgtaaccccaacactttgagaggctgaggtgggaggatcgcttgagaccaggagttcaataccagcctgagcaacacagcgagaccccctgccccccccaaaaatttagctgggcgtggtggcgcacacctgtagtcccaaagtcccaaccactcaggaggttgaggtgggaggatcacctgagccagggaggttgaggtttcagtgagctgtgatcacaccactgcaccatggaaataacttcaacatccaacaaaagagtatctaagagaccagagagaacactgtgcctctgtttagaagtataacaaggacatggatgaagctggaaaccatcattctcagcacactatcgcaaggacaaaaaaccaaatatcgcatgttctcactcataggttggaattgaacaatggacacaggaaggggaacatcacacaccagggcctgttgtggggtggggggaggcgggagggatagcatttggagatatacctaatgttaaatgacgagttactgggtgcagcacaccaacatgacacatgtatacatatgtaactaacctgcacgttgtgcatacgtaccctagaacttacagtataatttaaaaaaaaaagaagtataacgaggacagtttagatgcttgaaaaaaaaatctgctacaaagctaaagagggaaaaaagataaaaactatagatacactgtgttgaaaataatgcaaagttctacatgaacaaagcagagggtaatgtatcaaagtgcaaaaggcagttttattaagaattatggggattttatttttcagaagtccacattttctgaagtgtggttattttgcctgcataatttaaaaagcatactgaaagcatttcataaacgatagcactccgtataaagtatgatcaccaagagggcagcttattcttgcttaggactaagtagaaataacattcattcaagattaactctgtcttcctgtctctgaagagtgttgggacagggagagccgccttttccagggtttgcaaaacagctccatgtgggaccaccatggagcccgtctccctgggcttcagcttcccctctccagtgggtgctgggaggggcttcttctgtgacctgggctggtgactggtgctacatagtgagaagccctgcagggcagcctcaccagcccagggtggccctgcccagccctggtcagtgaagaggagcttccagacacacccatcctgatgttgtgcccatcttccctgaatgcactgggcacctgcctggtagctcccaatttctcactaggggctaaatggcaagaggtgatgttggcatgttaggatctggctacaatgatgctgggccgtgctgtgacagctgtgggaatgcccctgactgcactgtcactaaacacacagctctgcagtagagctatttacatgagttaagtccaggaaattcactttttccaaatgcccaccacccaagattattctcctctctagcaatataataatgttcactggaaagtgatgctagtcataattcttgttttattattattctgaaaataatagtttatggaggaaactcctgattaaagccgtgtcaggagcccgtccgaggatacaacagttgatatacctccttttaatttcacacagggtcttgctttgtcacccaggctgcagtgcagtgctgtgaatcatggctcactgcagccttgacctcctaggctcaaatgatcctcccacctcagcctcctgagtagctgggaccacagggacatgccgccacatctggctaatttttgcattttttgtagagacgaggtctcaccatgttgtccaggctggtcctagactcctgggctcaagtgatccccttgccttggcctcccacagtgttaagattacaggtgtgagccatggcacccaacgatatcccttctttttattggcaagaaagatctttccccttgtcaacaacttccaggcccatcaaggaaaacaggtggcaagactacctcaaatgactctcaacactcctcctggagtgtggcccttctggggaggtgactgactttaactagaggaggcaccctggcatgcagacctgatgggggtgataaggcaaggctcccacacctggaggaaggtggtctggatctaggagccagggaggaccagggtgctttccttgttgagtagctcagaaagcagctactgacaccaaagcacatcatgttagtttcgaggtttgctccccagggagaaattcctgccagctctggggggaaccacgcacaagagctttgccacatccagcgcgtcgatgggatccacgtccctcagtccagcatcccctgcacccagcaggctgccaggcacgtagtatgtgctgagcaggtgtttgttgaactggatggccaagggcttcccctcgctgtgcagcctctggtgctcagtgaggtgcgagctccagttgaacatctccccacatttctcacacttaaacgacttctccccggagtggattttctgatgtttaatgagacagtggttctggctgaaggctctgccgcactcgctgcacttgtagggcttctcaccggtgtggatgcgctggtgcacgatgagggacgagtggcagctgaaggccttccaacactggctgcagtcgaagggcttctcgcctgtgtggatgcgccggtgcacgatgaggtaggcgtgggagctgaaggctttgccgcactcgttgcacttgaagggcttctcgccgctgtggatgcgccggtgcacgagcaggtacgcgtggcagctgaagcccttcccgcagtcggcgcacttgaagggcttctcgcccgtgtgcgtcctctggtggagggtgaggcgcgagcggctgttgaaggccttctcgcagtcgctgcacttgaacggcttgtccccgctgtggatcttctcatgcacggtgagggatgagtggcaggtgaaggccttgccgcaggagccgcactggtagggcttctcgcccgtgtggatgcggtggtggcgtgtgaggtgtgtacgctggttgaaggccttgccgcactcgccgcaccggtagggcttctcgccggtgtgcacccgcaggtgcatgctgagcagcgagctgcagctgaaggccttctcgcaggcgctgcacttgtagggccgctcgcccgtgtggatgcgctggtgcacgttgagggacgagtggcagctgaaggccttcccgcactcgccgcagaagaagggcttctcgccggtgtggatgcgccggtgctccagaaggttggtgctccaggtgaaggccttgccgcattcatcgcacttgtaagccttctcccggctgtgccagcgccggtgcagcgtgagggaggagctctggcggaacgccttcccgcactcgccgcacacgaactcgccctccccggcgcccgccccgcgctgccggcgcacctgggggaacttttctggctcacttggcgtggaggcgttttcccctgcacacagtctcgcgggggccttggttctgccctcagtggcctggacgttcttgcgtgtgtccagcaagggtcccccctcgggaacgcgttgctgggcgaagaggggacacctgagggggaattcctctacagggacgtcccagaccatggcaggtgcgggcgcccagggcgcagcctgactcctctgcagagcacctgcctggcgcccccacgcctgcgccccgccgaggggccgctccatgatgggctcctgggccggttcttctttgcaaatgccctgctgttgagagggcaccgccttcagctcccattctgtaagatattgaaaatgattttctgtgagcaagcggaaacctggcctagaattcagatttgagaattggcctggagatgcagataagcccagaaaagagaggagaggccaccagggccaaggctggaaggtgcaggcagagagaagggagcgcccaggatgagatgggcaagcaagagcgggaagaagggagaggaagaacacggaaggagctaccagagagcaaagaccgggagaggcggagaagccaaaggaatcccggaaggaacagctacaagcaccaagggggctgagaaaggggcaagcttgggagctgttgatgaggattacactcattcacggacacgtcggctgaccgactgctctgtatcaataccatggcaggtgctcgcaatacacaggacaaatacatgttttttgtttgtttgtttgttttgagaccgagtctcgctctgtcgcccaggccggagtgcagtggcgcgatctcggctcactgcaagctccgcctcccaggttcacgccattctccggcctcagcctcccgagtagctaggactaacaaatgaattaaaaattgtctgtggtgccaaaaggaaaaaagggctccccacaccccagcgcttccctttagaacactgggaattgcaaatgctttctctgtctcgagacgcatgcaaaccttttcagaagcaaaatgagcctagtccaagagtcgagtccaagatgtaacttcctgcttgtcaaaaagctacaagaggctgggcgcggtggctcatacctgtaatcccagcactttgggaggtcaaggtggcggatcacttgagcccagatcaagaccagcctgggtaacacagtgagacccctctacaaaaaatacaaaattagccaggaatgatggtacctgtctatagtcccagctactcaggaggctgaggtgggaggatcacctgagcctagggaggttgaggcttcgagctatgatcatgcaaccgcaccccagcctgggcaatagagggataccctgtctcaaaaaacaaacaaacaaacaaaacccaaaaagctgtactcttcctttaggtgaagacagttgccctgtgtgctgggttggatgtgtctcctctgtcaaagggggaggtttctttctctcctgtacaccacatctggttaaacacttattcaataagaaggctttctttcttttctatctctatagcaaggttttctgagctggcaggagattttatttctaattctgtcctccccaggcttaaaagggagcagtctagtgcagcgggcagagctgcatggtggtgctgcctgtggccccaacacatgcagaagagcagggcaagtggaactggccatggcacacatggcaggtagccaggtggagagtgaacagcatgtgcagaagctcagaggtgagacagtaagatgaagacaagacacgcagaggcaggaaggctgagaggtgaccctggcaaggtggatgggttcgaggtgaccagatgcctgactcagagggcagccggggaagaaaggccttttgcacagagggtgatgtgatcatatggtgtcttgacggggggcgggggaagcagagggcggggacacagtctcgctctgttgtccaggctgcagtgcaggggtgcaatcacagctcgctgcagcctccaactcctgggctcaagtggtcctcctgccttggcctcccaaagtgctgggattagatgtgtgagtccctgtgcctggcataatggtttgtcttgaaggtggctttggtggtgtgtaaggtggttggagccagcagttagggaggccagttagggaggccatctgaataattcaggtgaaaaatggcaacttcagactggaaccaaggctgtgaaaatgaacaggaagcagcagatctaagagccatttaggtgctaaaactgatggccctagctgttgactgaaggtggcaagagaggaaatgggggagaggatgagacctcagcaaacacccaagcctgggtggatggtggaagcttttataaaggaggaggaagggccagttccaagtctggttttagacatgcaagcagaggcccacgagatggtcagtgacacagggctgcagctcagctggtgttgctatagtgtagaccacatccacaccaagtgagaggtaagagtctagggaagttgcacagagcagagagaagaggcccaggccagaaaaaagttgttttggcagcaatagggccaacaacacagcagggcacattcatctaagggatactgtgcaatcagtaaacatcacgtgaggacgctcactatgccatggccagtgtggtagccagactccggcgtgagtgctgtgcttccgagggtgcataaggctttatttatttatttgtttgagatggagtttagctctgtcacacaggctggagtgcaatggtgcgatcatggctcactgcaacctctgcctcccgggttcaagcaattctcctgcctaagcctccagagtagctgggattacaggtgctcaccaccacgcccagctaatttttttttttttttttttttgagatggaatttcactcttgttacccagactggagtgcaatggcacgatctcagctcaccgcaacctctgcctcctgggttcaagcgattctcctgcctcagcctcccaagtagctgggattacaggcatgcaccaccatgcccagctaattttgtaattttagtagagacagggtttctctatgttggtcaggctggtctcgaactcctgacctcaggtgatctgcctgcctcggcctcccaaagtgttgggattacaggtgtgagccatcacgcctggccacatgtagctttagaagtctatccgcacacagaggaagggcccagaggaatcagtgacatggtcagttattagagaaccgtcatctctgggtggaaagattatgcaggatttcagtaacctttcagcctcattttcagtatattcatatatgaatcaaacaaaaatatgaattttttgaaacctgtaatcttgttaaagaggacaaagcaagcatcagaggctggggtgagaaataaagaccagaaagctggggctgcagccactgttgcaggttggggctgggtggtatgtggcagtggagggggatggaggaggggctgccttccccgacccccgtgttctgtgctccacagcttatcggctgcctttcccacagaaaggtgtttctcgagctttctagacacctaacatgctcagcagtcactgtccaataaattaagccgaatttaccacttatttatcaaccaactcagaagagaagtctacaaaaagaatgttggagaagaaaagcagactaccttctgctcaacacccaccccagtcccctttcccttacggagggctgccatcttggccacagcctggaagccctcgctgacgttgaccctgaccctgacgctgatgctgaccctaatgctgatgctgactctgaccctgacgctgatgatggccctgacactgatgctcacactggccctgatgctgatgctcacgctggccctgacactgatgctggctctgaccctgacgctgacgctggccctgatgctgatgctcatgctgaccctgacactgaccaacgccagctgccccttccctggtggccccctgcccccaatcccacacccccggctgcccagccaacaccaatggctcaatatttctattcctgcctccccatccccatcagcaggtgaccatttggtcccagtggccaggtttgttccctgttgtatcccagaacaggtctcagcacacaggcagtgctcagtacgtgctgaagggaggcaggcaggagggtctggcgggggacctgaaaaggggagatggagccggggcaaactgagggaggaaaataggggccataggaggaggtgccaccaggggtgctggggctggcacccttccacctgtgcctctgctcacctggacagggccctctggggacttccctctgcatgctccatggctcctcgcctcgttccagatgagagatcacatctggcttgtgcagtggaggtcctgctcgtggagagaaagtgggctgggcatgctgcagctctccaggcccagtcgaccttacaggccgccccctaacaaggacaatgcctgtgaagtggacaccctctctgggaacaggaggtcctctgggccaaaagcagtgagggtctcagactggaacccaaatcccagtgtatactctgaagaccccacgtgtgctgacgtccttacttcattgcttgaggactgttccagagccagctgggctccagggtcccaccttcttctcttctctccctgcccctatcccaggaccaggggaaacaccaagcaaggatgctaccagctcccacgctgtcccttggggacttctggcgtggccgaggcccctggccatgagtgccccaaggcacaggccttgcttcccaccccatgatatatctggcaccagggccggcactgaagggattctccttaatatctaccatgtagaagaaggctgacagccgacgcccagcctggggctggggggattttacctagggcaagaaggttctggtagttctccaacatcacatcccggtacaaggccctctgaggggagtctagttgaccccactcctcctgggtgaagtccacagccacatccttgaaactcaccgattcctgaaatgacatataggttctcacccaggactgattctgtgtccatggttccaaaggagccagagattgattaaggaccctacaagtaaagggttaacctcaggtgaccttctcccatgccagaaggttgtgctgtagacactgaccatgactgaattcggggaccaggggcagggaggggggctgggaattggcatgcattcccacaccaccttctagattgggaaagcaggtctgaatagacaccacagggccctggcaacttgcggtgggacccaggggctgtacatggctgttgtatcaggctctaagtcctgggtgagatgctatgcttcctggagtcaagaatttcaaacttaaaaatttgagagaatattaatagtacaaaaatcccagcaactctattcaaagctcagtaacgcaaaaggatccgatcccagactagaaactgttattacactctaaggaaggaaaccttgtatatatcagcaagttctgtgccccaagggactaagagaggctacctgcagtcctcacctgactgccttccaatccttcctgcctgctccccctgggcctgggcatcctggccaccacccaactccagacttgctttgatccttgaaaggatcaaatagatgccaagtaatttcactgcatcccagaacaaatcccagaaacaaggaattccaaaaacctactcaacaaagtaaaattcacaatgtccagcatccaatcaaataactaaaaggtgaaaaatattaatgaaatcagaggaattaagagtatattagaacagtatgtgtttacctcaaaagaagtcattaagggaggaaatgagaaacaaaaaagacataagacatagaaaactaatagcaaggccgggtggggtggctcacgcctataatcccagcacttgggaggccaaggtggcagatcacctgaggtcaggagaattgcttgaacccaagaggtggaggttgcagtgagccaagattgcgccactgcactccagcctgggtgacaagagccaaactctgtcaaaagaaaaaaaaaaaaaggacatgtaaatccaaccatattaataattacactaaatgcgaatagtttaaacactccaattaaaaggtggagattgtcaaactgaattcaaaaagcaagctacagaaacccactttacatacaaagataggttaaaagtgataggatagaaaaagataaaccctgcaaatactaatttaaaaaaaaaaagctcaagtgcctatagtaatagcaaagtagatttcagagagaggactatcagagacaaagagaatattacataatgataaaacagttaattcattaagaactcatagcaatcctaaatataaatgtatctactaaaagagcttcaaaatacataatgcaaaaactgacagaacaattaaaaaacaccatcattcaacttgacttaactgatatttacataacactctaaccaacaaaggcataatacatattttttcaagggcatgtggaacatttaccaagataaaccacactctgggaaataaaataaatcttggtagacttgaaagactttaaatcacacaaagttcattctttgatgacaatagaattaaatcagaaatccataatagaaagttatctggaaaatgccctaaatattaggaaatgaaacaacacattctgaaataacatatggctgaagaatacatcactagggaaattagaagctattttgagctgaataaaagtgaaaatgtgacataacaaaagttgtaggatatagttgaggcagtgcttagaaatttacaacgctgaatgctatatgaggaaaaaaggtatcaaatcaatatctatgtttcaatcttaagacactaaagtaagtaaagtaagtttcaatcttaagacaccaaggagataataaggatcagaaatctctgaaatggaaaacagaaaatagagaaaaatcaataaaacaaaaaaattgttttttgaaaagatcaataaaattgacaaacatatatttactatatggctcagcaatttcacacctaggtatttatgcaagagaaattaaaatgcacagccatacgtgtactcaaatatttatagcgggtttatttgtaatagcaaaagcctatgagtaacctaaatgtccatcggctggtgaatggataagcaaactgcggagcagtttgctccatccaatggagcaatgggatgaaatgtatacccctcacctcaaattcttatgtctcaatgcttggtaactccgagagaggttttttttttttttttttttttttgagacatggtctcactctgtcacccaggctggagtacagtggtgcaatctcagctcactgcaacctctgcctcctgggttcaagagattctcctgcctcagcctcctgagtagctaggactacaggcgagaactaacgcccagctaaatttttgtatttttagtagagacagggtttcaccatgttggccggctggtcttgaactcctgacctcaagtgttccacccacctcagcctcccaaaatgctggggttacaggcgtgagccactgcacccggcctggagagaggttctttaaagaagtaattcagttaaaatgaattcaatgcagtgggccttgatccaatataactggtgtcctcataagaagaggaaatttggacacagacatagaagaggtaagaccatgtgaagatgcggggaaaaggtggccatctacaagccaaggagaagcctcagaagaaatcaaccctgctgacaccttgatttcagatttcttgcctctggaactgtgaggaaatacatttctgtcatttaagccctcctgccatactttgtatggcaaccctagcagactaatacaaatggaatattactcaccaataaaaaggaacaaactactgattcacacaacaatatggataaactcaaaagcatatgctaagcgaaataaagcagagacaaaagaccacataatataaattccatatgaaatccttaaagaggaaaatctacagcaaaactatagtggttaccaaggggagaggggagaccactgaatgcacaggggcatgaggacatttttgggtcatggaaacgtcccatatcatgattgtggtgctggttacacaactgtatacgtttgctcaacctcatcaaattgtatacttaaaattgtacaactgtgctgtatataaattacacctcaataaaaccttaccccccaaaacactggatttcagatgaggaggtagagatgaggacaaatgctgagaacacacccctaactgaggcatgcaggcatgaaggatgacgatagccgagggaaggagaaaatgggctgaaacaaggctccaagccaggtgtgggggcacacacgttggtcccaactacttaggaggccgaggtgggggatttgcttgagcccaggagttgaaggctgcagtgagctatgattgtgccactgcactccagcctgggcgacagagcaagactctgtctcaaaaaaaaaaaaagaaaaagaaagaaaaacaaaaaaatagctccacaggtatcagaatatggtgttggccagtgaggctgtcagaggctacatggcttcagtgtggggagcaaaaccagcaagagtagggtagggtctgaggcccgcacaggcctttttgatgggtatttctggccactgggagaagtccatgtctaatgtgtcatcattctgcagggaaaggaataaaaaacccagacagtatgcattggaatcagatgctgatgtggtaatgacactagcagagaagtcagaacagaccacacaagatgtcccaggagacagaacaacttgaactgtgagtgagaatgagactgtcaagagaaaatgccaaagctgatgtgtactcaggagagtcaactggttattcaaagatctaacaagctaatattttaggaataggaataacacatgcatgagggccctaccacctagacggagctgcacagacacatacagacatacatacatgcacacacatttttttttgctgaaccatttgaaggtaagttgcagacatcatgatgtctcactctacagtcttcagcttgtatctcctgtggatattctcttacataatcacagtactattatcacatgcaataaatttcatattgatacaatatgacctaagatacagcccattttcaaatttcctcttgtcccaaactgccctttatcaatttttttggatctatcccctaagcaaggaacatgcattgcatttgactgtcaagtttcttgaggactataaagcattgtgacacactacagaagtgaggcacagctcacaatacacgttttgcagctgtttctagctggctataatctgccatcacctcttttgagtggcagactgacaaaatcacaaaatgctaaaaaaaaaacaaaaacccaaagaccccttattcctccacatctttcactctactgtgctctctttgtcaactgcacccttctaaatacaaccatggggtgaggtggttgcggtagaaaaacaaaatgaggaacagagttcacagtctgtaaaaggagggatctgggtcccatttggctgcagaagttcccagggccaattccttgctgagcccccagattctctaaatctccaggactctccatgaaggccccatgccaggggctgggtacagaggaaagcacacagggatgtgtcccctaccgccactcttaaccaagtgctgcaatccagcccttcctgagctgctccacgtgcccctgtctgattccagtcccagtaaaccaaccgtgcaaacatcctgcaccaacccctggccagcacgtggataggcaaagcgaccccatgtgagccgtcaactactttctcagattccactaaaaccactcctcagagctcccagcacagcgctgggcagagagatccccagcaactgacccactgaattggactgggcgagacattcaatagagcacatctcgagggcacacctcgggcaacatctggactcttcacttggagctgttcccactgcccagagcttcctgaggactggccagcaggtacccgggtgaaggtctgtggaaggctgacgatccagggctggggagggaatgtgccaaccctcttcataaagaaggaagaacacacagccactcaccttggacctggcttcgggaagaccccaacccgatatatcctcgagattctctttcagggaaagagcaggatcctgagaggaaagagctggcgaaggagaaatgagtcaaggtcacggctaccaggctcacggctgagcttaaagcccacctgtcgtggcacaagtgagaatcagagaggaggcagaacctgccagcaaggccaggtggggaacgagccccagtagctagcaccaacagaaacagcatcgaggaataatctgcctgtgtctcagacactccaattcatgacgaaaagagctgctacccccaatcaagcacgtctgagtgggaacaaatgattgggcgcggggaagaaagaagcaggaggccaggagcgatggctcacgcctgtaatcccagcactttgggaggccgaggcgggcggatcgcttgagcttaagaccagcctgggaaacatggcaaaaccccgtctctactaaaaatacaaacattagccgggcgtggtggcgcgcgcctgcaatcccaactacttgggaggttgaggcgggagaatagtttgaacccgggaagcagaggttgcagtgagcggagatcaagccattgcaccactcccgcctgggtgacagagtgagattccatttaaaaaaaaaaaaaaagatgctggatgcttctgggaaactggcctgatctctctgagtgtcaatatcctcaagtgcaaatccacagacatactgactacaagagtgaagctgtacctgtcttctcgggctccggggcagggatctccatggcctccacggcagcctccccaggaggagtgggcagctgtgtagcctccaggatccagggcaggccctgaagagcgagtactgctcctggggctgaggggcctgcagcggagccccgcggggcggccacgcgctcacagctgcacgatcacacgcacggagccccctccccgcgcccggctgaggtggggttcaggccggctccgcagatacccactccccacaccaggctcagccccatgctcggcgcactcacgccccggcacacccccgccacacgctcctcccggcgaacccgcgctcggagaccagggccaggcctaaggttccgcggccaggagccatcggacgcggagcgaccagcggacaggtcccgaagcggacagagaccgccgacggtctgagggaccggcaagtggacagaccggactcccacaaaaggactgcgactgccacaaagagcagcaggcggccgctgcgggaaagcgcgcctgcgcgaaataggcgcaaactacacctcccgggagcgtttgcgccgcgcaggcgtcagactccatttcctagagcgagttcgggccggtgcttgcgtcccgacgcgaacgagtatctagcacatccttctaggaaatgtagttcctgggcccacagccgggagctccggcacccaccatgctcttgcgggcggatgtcgctgtgtatctccgtgtgcggatcagtgtagtgccgctgcatgggtgtctaattgcgaggatactgggagggcggtgtccaggaactagaatttgtcctgttagttcgtccacgtccccacgtagctgggagtcgggtgggttcctgcccacatctgtctgcaggaaagactcaagcccctggtcttacggatattgggagtggtgggtctggcctcgaggggttttccaggggccctgcccccactcccccttctcgagccacatatctgaggcccatgggcgcgggtccccagaggtgggagagccttggcctagtccccccagagggtcctgtccacagttcacccctggggcgggaaaggaaggtctgggtggcggcccagtcctggcggcacagagctctgccatgaacacagtgatgacgccagcgacagaaacattgaatatgtactgagcaccaaccaaacgccaggcctacttcaagagcttggagtacatttttctggcagaatgctcacagcagtccagggaggtttgctaactactgtcatcccatttgggagatgaggaagttgtggtacaggtgcgtggggtaacgtgtcgcaaatcacacagccagaagtaggaatccagcaccgaagtgcattgccacattcctactgagaggtggtccggggtggtgcacactccaaacccttcagcctcccaccttaaccgcagcttaggcttggccacaggctctcacgtgacacctgtccactgcccacatcagcacagctgtgcccagacctcccctgcccagggcagcgcccgtgtttgattttgttttgagactgggtctcactctgtcgcccaggctggagtgcagttgcacaatcacggctcaccgtagcctcagtctctcgggctcaaactattctcccacctcagcctccggagtagctgggacttacagacatgcaccaccacgcccggttaatttttatattcagcgcccatttttaatagcaacccagtgagaggggacagcgtgctggcagtcctcacagcccttgctcgctctcggcgcctagtcggccttggcgcccactctggccgcgcttgaggagcccttcagcccaccgctgcactgtgggagccccttcctgggctggctgcggccggagccggctccctcagcttgccgagaggtgtggagggagaggcgcgggcgggaaccgggactgcgcgcagcgcttgcgggccagcacgagttccgggtgggcgtgggctcagcgggccccgcactcggagctgccagccggacccgggcagtgaggggcttagcacctgggccagcagctgctgtgctcgacttctcgccgggccttcgttgcctccccgcggggcagggctcgggacctgcagcccgccatgcctgagcctacccaccgccgtgggctcctgcgcggcccaagcctccccgacaagcgccgccccctgctccacggcgcccagtcccatcgaccacccaagggctgaggagtgcgggcgcacggcgcgggactggaaggcagctccacctgcggccccggtgcgggatccactgggtgaagccagctgggcttctgagtctggtggggacttggagaacctttatgtctagctaagggattgtaaatacaccagtgggcactctgtgtctagcttaaggtttgtaaacacaccaatcagcaccctgtgtctagctcagggtttgtgaatgcatcaatcgacactgtatctagctactctgctggggacttggagaacctttatgtctagctaaggggttgaaaatacaccaatcggcactctgtatctagctcaaggtttgtaaacacaccaatcagcactctgtgtctagctcagggtttgtgaatgcatcaatcaacactgtatctagctactctggtggggacttggagaacctttatgtctagctaagggattgtaaatacaccaattggcactctgtatctagcccaaggtttgtaaatgcaccaatcagcactctgtgtctagctcagggtttgtgaatgcaccagtggacactctgtatctagctaatctagtggggacgtggagaacttttgtgtctagctctttgggtccacgctgcctttatgagctgttaacactgcgaaggtctgtagcttcacttctgaagctagcgagaccacgaacgcaccagaaggaagaaactccgcgcacgctgcgtttaagaactgtgacactcaccacgagggtctgtggcttcattcttgaagtcagtgaaaccaagaacccaccaattctggacacaccaggacaagagccttggtggggtatagaactgttgattacacagtgcatgagtctatgtgtaagtttgtgtatgtgtttgtttctctgtgtatcttacaggtgtaggtgtgggtccgcttttgcctcacatttcttatgtgtttctgtcctggtgtgcctctgtgaaacaatgtgtacgtgcacctgtgcacaggtgactctatgagtgtgtatgtgggcactgtctcaacagttctggagtctggatacgtgtttgtgtgcaggcttgtgtacatgggacaggaacctgtacatgggagtggaacttgtgtgcacggtgtgcttgctgatgagtctaatgtgattatctgttggcatctggctgttgactaacaggtcaggtctgagtctttctttttttgtttttgagatggagtcgcgctctgttgtccaggctggagtgcagtggcgcaatctcagctcactgcaatctctgccttctgagtagctgggactacaggtgcccgccatcacacccggctaatttttttgtaattttagtagagatggggtttcaccatgttagccaggatggtctcaatctcttgacctcgtgatccacccgcctcgacctcccaaagtgctaggattacaggcctgagccaccatgcctggctgggtctgagtctttctgtataagtgcacatgtgtatgtgtgtgtgtgcctcactgtttacacagatctgaatgtatgactggcatatctgtgcatgtaactctgcagttcatctctgtagattgtggatgtatcatctatgtctgcttgcctgagtgtgttctgtgtgatagtgagtagatgccttacgccagtgactatggacggcgtcttgttcaggtgaatttgtagacctgtgtgtgtgtgtggttctctcaaagttctagtttgttgtgagatggtatgcacctcttttcatttgtggggctgtagacctcgcaggtccagttgtggctgtgtgtgtgcctgcatgtgttcttctgtatgccactctgtgttgacttccagggctcatcagtgtcagtacgtgcatccttgtgtacatgtgtatgtcactgtgggcctcatggatcccctgtgtctgtaggaaagccagtgtgagcccagggattctatattgagtgctctgtcacctgtgtctctgcaaaggctgtagggacagggatgtgttcagcctgaagggaagagtggaagggaggatgctgttactgctttctgctcactatagacttctgaggatgggaaaggcatttaccgcaagacaatttagcctaagattctcacttacataagaagtcccaggtcatgttcttgttcctaagttctctgattcctcaattctcgagggttgactagcagggctgtgtgaaggcccagtgaaataatggatatatatgcccttttttttttttcctgagatggagtctcactctgttgcccaggctggagtgcagtggtaccatctcggctcactgcaatctccgtctcccgggttcaagcaattctcctgcctcagcctccctagtagctggaactacaggcacctgccaccacgcctggctaatttttgtatttttggtagagatgggtttcactatgttggccaagctggtctcgaactcctgacttcaggtgatctgcctaccttggcctcccaaagtgctgggattacaggcatgaaccaccatgcctggcctaaaggcttttaaaattcacttatataagctgacttagttttctttaactttgtagaaaaatacaaaaatggcaatctcttttatcacacaaatgtctttttaatagagtttttttctaattgatgtattatgtatttttcattcactaattattaattgcttacatttgaagtgtttgatgaattaatatttaattgcatagatgaagatgactagtcataggcattttactaaccaatactcattggattcatgtgatgttgcaggccgaaagagggagggtcatgatcaactcggtgtaccactggaggttatatgagtaaacagtaaactgttctcatgaatgcagaatgttggcaaactgcgtctgccacccagagggaatgctgagggcagtcatgccccaggcgcggcgtttcttgagattaggcacatctgaaacctgttagcaataatgtgaacctgtgatcaattgagaagctgaccaatcattacctcctgctccctgctctttctactcaataaatatgaagggctgtagaagctcagggctgctgcccttgctcactagaagctgggagccctcttcttcttccctggacccttctttaaacagctccttttttccttggttttcatttcttcattcgtcctccttcgttcagtcccgcagtaactgcggcaaaccatggggactgccacaatgtgatgtcagggagcttttttattggtaaaagggaaaagataccacaagaatgaatgcaagaactgaaacagtggagacacctagaatgacttgtctaagatttaaatcattttgttgtcttcccagcgtacttattatcctgatcattgtcatcagcattgtttgggtccttttagcacagatttctcaaaatgggtaactccataacagttggaagcttacgaattcatataatttgtaagacggcaatttgggagtacctatctattttaaaattccaataacctgggaatttcatcccatgtctagagtcttttatgtaaaatatttccacaattaggagaaatatgtgcatggggattttctatgtagcagtgttttgatagaatagaaagttggggcaaaccaaatttccatcatgaaggaaatagtaatacactgaataataacacagtgaatattatgcaggctttaaacatcaaaaatgagctcaacttctgacttccgatgatcacattgaagtaggtcactgctggtttacatttgattttcatatgggaactccaggtgtctgccttagtgattttacatgtggctaaatttagctaatgaaaagctattcaaagtatggcaaaatgaaactttaaaacagcatcttgtcaacaaccaagtggacttgtttcacataaaaccctcacattcatctgcctgtccatcattctgtctgtccacacaggcatcatttgtggcttcatctacatctgggggcatcatccacagctgggggcttcatccatgtctgggggcatcatccacagctgggagcttcatccacagctggtttgcctgatctgtatctgagtcacagatacagattattaaacctagtaattttattgagttccactttaatagtttttgtttcaaaagttgtttgttgataatttaatgaaataaactaaaccagaattacccccttttaattatttccttgtgtcaatatagaaagagtgaagttaaggaaacactgagatgcccctgtccatgtttgtgaatgggagtgttgggtctaaagcctttctctggtaggtctccagaagattgccctgccttacgcttgccgtctgtgggttccagaggcttccatttgaaaggagcctctctccccactctgcctcaacccacaccagctctcccgtaacccactgactttgtaaacgctttcttccacctgcacctcattgaattcaatactttggaaaatagtcaaaaattctaaaaaggtgggagtgagtgtgatctggaaatccctgctgtaatatttttaagggactctgctggaaactattagtttatgttttaaataaaaccatcccttagcactagaatatcaagccattcattttttaacagaactttgagatataattcaaatacaataaatttcacccacacacagtgtacacacaattcaatggtttctaatatattcacagaggtctgcaaaaattaccacagtttaattttagacaatatcatttactgagatccttacatgcatatagatgtagatatatataattttaatatcatcttgaatattgtagtatttaatattgtactatatctatttgtgtctttatattgctttttattttgttattctgaatgacgatctccatgtacctttatataggtttaaaatacaccttttacaactgaagaaattaaattgtttctagtaaatcacataagaaacacatatgctattgttataaaaattcaaatactgcttaggtctgtagaatgaaatgtgtcaccgccagctcccagcccactcagtcgtctacatccacttacacacagatagacatgcccatgtttttacataacgtaatcctgctttgtgtgttgttccctaactggcttttccatataaaatagaatgtggtgatcattgcttatgagtgcatataggtctctctcattcttatttatagttgcatcattattcaacagggtatctgaccataatttggtcactttttcactgtggaatttttatgttggattcagttatttgttaccgttacctacactatcctgggcatacctgtatattcatctttttggtaccttagttaggtgggttttttcttttatgattgatttctaaaaataaaatactgaggcaaagtataaatttttaatattattattatttttttgagacagagtctcgttctgttgcccaggctggagtgcagtggtgtgatcttggctcactgcaagctcagcctcccaggttcatgccattctcctgccttagcctctcaagtagctgggactacaggtgcccaccaccacacccagctaattttgtttttgtatttttacaaataacacggggtttcaccatgttagccaggatggtctcgatctcctgacctcatgatctgcctgccttggcctcccacagtgctgggattgcaggcgtgagccactgcacctggccatattttgataaaaaattaaaaatctgtgtttcaaaaaaatttaatgatattatactcccaccatcagtatatgagagttcctatttccacacacccttagttacagaggaaatgaccaatgctaaccttggccaattttatgattaagaaatatttccatttttaatttggatttctccacttattagagagattgtgcatttttgcatatgtttactggccaattgtatttctcgctgagaatttcattatgatttactagttttctaattcatgtaatgatattctttatatattctgcacatttattaattccatataattagcaagtttgtttcttaaggtctgtatcataacttttattttgtttatattatctttgttttgaagaaactttcatttttacatagtcaaattgttgaacattttccctgccatttctggattttgtgacttgctttcaatagtatgtccttttagggctttattgatttgttttgtttaaagaacgtgctcaaatcttacattatttagtaattttctttctcccattagagtacatggacattactaattccagctaatgtagatcaaatgtatcatttgaatttctgtgtagtaatgcgcattgtagataagttctgatttctttattccctattagatggatattaaggttgtttttaaaaattcccaccactgatgactacaataatcatcaatatacatggatcccactgatgtttttgttttatatttcttcttttctgtagtataggattctcaaagtggtgtaactgacctatgatacattttaattataattttaattatactggcagattattttccaaaaagttgatcaattcacactcttatcaactacataagtaagcctcttcctatgtaggctaaataacactaaaagatttttttaaataaaaatgctaatttggctggagaaaaatcccataggtgctttaattaatcaatttttttctgtttcaattagttgtctattcatagcctctgtgtatgtgtgtgtgtgtatttctatttggcagtttatggttggaaagactcctaaaaaaggaaatctaaaaaacacacaaaatactaaaatatatttgatgaataagaattaaatttctgcatatccaaaaaattgctaaaaatattaaaactgtagtcaaaatagcagctcatgaaacaaagcaaacaaaaatactaaacaaaagaaacagaccaggagcagtggctcacgcctgtaatcccagcactttgggaggccaaggcaggaggactgcttgagtccaggagttcgagaccaacctaggcaacacagcaagaacccatgtctacaaaacaattaaaaattagccgggcatgctgatgcatgcctgtagccctagcttttcaggagactcaggtgggaggatcacttgagctcaagagatcaatgaagccatgttaatgccactgcactgcagcgtggatgacagagtgagatgctgtctcaaaaaaaaaggaaaagaatactctagctccacttccccaccacagaaatctaactggcaactatccacagatgggaataccctcaagaatatatatcccagaacacagaaggaatgttgcccaggctggacggagtgcagtggagtgatctcggctcactacaacctctgcctcctgggttcatgcgattgtcctgccttagcctcccgagtagctgagattacaggtgcctgccaccacacccggctaattttttgtatttttattagagatggggtttcaccatgttggccaggctggtcttgaactcctgacctcaggtgatccacctgccttggcctcccaaagtgcgggattacaggcgtgagccaccgtgcccagctgactgtctattgacttttgacaaaggcacaaagaacacgccaaggggtaagaacactctattcaataaatggtgctgggaaaagtggctattcatatgcagaaaataaaattagacccttatcttacaccatgccccaaaatcaacccaaaatggatcaaagactttaacattatgccggaaactgtaaaattactataagaaaacacagaggaaaagctccatgacactgatctgggcaatgattttttgggtatgtccccaaaagcacaggcaataaaagcaaaaatagaaacaggatggcatcaaactgaaaagcttctgcacagcaaaaggaacaagtaacaaagagataacccacgtcgtgagaaaaaatatctgctaaccatacattagaaaaggggctaatatccaaaatatatgaggaactcaatcaactcaacagcaaaagaaccaataagccaatgtaagaatgaataaaggaaccaaacacatttttcaaaagtagacatacaaacagccaataggttcatgaaaaaatgctacctcaaaggcaggtcctgggaccagtaacatcagtattatctgggagtttgttcaaaaggcaaaatatcaggccccactgcagacccacttacctggaagctgcatttgacaagattcccaggtgatccacatgcacgttaaagtttgagatgcttactatagacagcaagtacttcttcagttgaagaagctctggggcctggagctgaccagtggcaacctaaatctttaggaaaatgcaaattaaaaccaccgtgacataacatctccctctcatcagaacaagttttatgaaaaagatggaaggtaagttttggccaggatgtggagaaaggggaatcctagtatactgccggtgtgtagtacagccgcgatggaaaatggcatggaggttcctcaaaacactaaacatagaactatcatgtgagccagcaatcccacttctgggaatatatccaagggaattgaaatcagtgtgttcagggatgtctgcactcccatgttcactgcggccccatttacagtagccaagatgtggaatctgcctaagtcaatcagcctaagatgaatgcgtacagaaaaggcggtgcacgcatacaacgaagtactattcagccttaaaaagaacaaaactcagccgggagcagtggctcatgcctgtaatcccagcactttgggaggcccaggtgggcagatcacctgaggtcggcagttcaagaccagcctgaccaacatggtgaagccccatctctattaaaaaaaaatacaaaattagccaggtgtggtggcacattcctgtaattccagctacttgggaggctgaagcaggagaatcacttgaacccgggaggtggaggttgtggtgagccgagatcatgccattacactctagcctgggcaacaagaatgaaactccatctccaaaaaaataaaaaagaacaaaactctgtcattgggaatgacacgaataaatctagaggacatactgctaagtgaaatacaaataccacagaaagacaaataccacataatctcacatgcccgtggaatcttttaaaagttgaatttgggagctacccactcgggtccccttccacactgtgggagctttgttctttcgctcttcgcaataaatcttgctgctgctcactcataaaaaaaaaaaaaaagttgaatttgggccaggcgccctggctcatgctggtaatcccagcattttgggaagctgaggcaggtggatcacttgaggtcagcagtttgagaccagcctggcgaacatggtgaaaccctgtctctactaaaaatacaaacattagctgggcatggtggcaggcgcctgtaatcccagctacttgggaggctgaggcaggagaatcgcttaaacctgggagacggaggttgcagtgagctgagattgtgccactgcactccagcctgggtgacagagtgagacatctcaaaaaaaaaaaaaaaaagttgaattcattcagtagaagaataatggttaccagagctggcgaggtggcagaacaagggaatggagacttcctcttcaaaaggtacaaagtttcagccaagcaggagaaaaaagttttgaggtctattgcacagcaggagactatagtcaataataatgaatatttcaaaataactaaggaaatttttttttttttgagacggagtctctgtctttcaggctggagtgcagtggtgtgatctcggctcactgcaagctctgcctcctgggttcatgccattctcctgcctcagcctcccaagtagctgggactacaggcgcctgccaccacgcccagctaattttttgtatttttagtagaggcggggtctcactgtgttagccaggatggtgtcgatctcctgatctcatgatccccccgcctcggcctcccaaagtgctgggattacaggtgtgagccactgtgcccggtctaagagagaaaatttctagtgcatcaacttaaaagaatgccaagtaagtgaggtaacaggtatgttcattagcttgacttaatcttttcatattgtattgttaagttaaatttggtctaaaactgcctccacaattcatattagcgccaaactggaaagtccagccacagaagagtagatgagcaaattatggtactgagtagaacggaatactactcagcaatagaaaacaatgcagtaacaccaaggaacctcaaaaacattagctacaagagagtacatactgcatgactccctctatatgagattctagaaaaggcaaaactagtctacagtgacagagggcagatcaggggttgcctggggctgggtggggaaactgccagcaaagggccacagggatttccaggttatgggaatgttctgtatcatgattgaggaagtggtcatgagggtacacacatttctgaaaattcatccagctggacacttaaaatgggcgtattttcttgaatgtaaatttttctccgtaaagttgattttatttaattaattaatttatttatttatttatttttgagttggagtctcactctatcacccaggctggagtgcaatcgtgcaatctcagctcactgcaacctctgcctcctgggttcaagtgattctcctgcctcagcttcctgagtagctggaatttcaggtgtgcatcaccgtgaccagctaatcttcatatattttagtaggcacagagttttgccaagttggccatgctggtcttgaacttctgacctcaagtgatccacccgcctcggcctcccaaagtgcagggattacagatatgagccaccatgcccagcctataatgttgattttaaaacaagagaaatcaacatcaccaacaaataaattaattaattaattaaaataaaataaagctgcctccatatatagcacactgtaatctaacttaatagatgtgaaaggacaataaatcttggggccccaagaagctaaagggaaaagtcaagctgggaactgctttgggcaaacctgcctcccattctattgaaagtctcccctctgctcactgagataaatgcatatctgattgcctcctttggagaggctcatcagaaactcaaaagaatgcaaccatttgtctcttatctatctaagacttggaagccccctccccacctcgagttgtcccacctttgcttcgagctgtcctgcctttctggaccgaaccaatgttcatcttacatatgttgattgatgtctcatgtctccttaaaatgtataaaaccaaactgtgctctgaccaccttgggcacatgtcaggacctcctgaggctgtgttatgggtgcatgtcaccaaccttggcaaataaaccttctaaattaactgagacctgtctcagctattgggggttcacataggtaaacaaaacaaactgcaacctaacctgagaatatgcccttggaataagtagcccagtctcagccaatcacagcagctgagctctcagcccttcacaggctgcaagctgccaaaaacatgttcaaacaaggcaactgcagagctgtaaccaacaggctatttctcaatgaaacttacgttttctggctataaatattccctgcccacctgtggagcagagatctctgaaccacttttggttctcagtgctacctggttcatgaatcttttttctgttcaactaaactctgtcaaatttagtcaaaggcttttctctttaacagtatacatacatcacacatcacattgtactatataaatgtaattcaattgtcatttataaatttaaaatagtatatttttttgagacagagtctcgctctgtcacccaggctggagtgcagtggcatcatcatagctccctgtaacctcaaacttctgggctcaagcaatcctctcacctcagcctcctaagtagctgggactgcaagtgcatgccatcatgcccagctaattttttttttaattactgtagagatgggggtctcactatgttgcccaggctggtctcaaactcctggtctcagtggatcctcttgtgtgatcctcccacctcaacctctgaaagaactgggattacaggtgtgagccaccacgcttggcccaaaaataatacataatttgttttaaaacactagatgattttttttcaacttttattttagaatcgggggtaccatgcaggttagttacaaaggtatactgtgtgatactgaggcatggggtatgctggaacccatcaaggggatattttggttgtcaactacctgaaaaaagtatcttttcaaatcaacagctgcagcactattttaaaaaatggaaatgtaacaataagggttaaataaattttgacaaatttataaaatggaatactatggtgacattaaaaccattttagactgtttaatcaagatagagaaaactacaatattttactgaataaaaaaagaaattatagagaaatcttttttgggttttttgagacagggtctcactctgtcacccaggctggagtgcagtggcacaatctaggctcactgcagactcctcctccgttcaagtgatcctctggtctcagcctcccaagtagctgggactacaggcaagtgccaccatatccaccacctaattttttactttttgtaaagatggggtctcactgtgttgcctaggctggtctggaactcctgggctcaagcaatatgcctgcctcagcctcccaaagtgctagaattacaggcatgagccaccacaccagccaagaaatcatattgtatgaacccagctttataaaacataaactactcacacatactggtggtggagggggaaagaactgagaggaaatataccaaaaatggcattaaagggtaactctcagagggattacaaatcatttttacctttttttcttcatatgtctcttactttccaaatttcctgtaattaattaatatgcaattttaaaataagcaataattcatttagagaatagatttaacatctatattctctaattacttttgttggcagtagtgttcctattccaagttcaaaaacatgaataaattagggataaaaagaagtgttcaaatattttttcttaattcttttttttttttttttgagatggagttttgttcttttcacccagtctggactgcaatggcatgatcttggttcaccacaacctctgcctcctgggttcaagctattctcctgcctcagcctcccaagtagttgggattacaggcatgcaccaccacactcagcttatcttgtatttttagtagagacagggtttctccatgttggtcaggttggtcttgaactcccggcctcaggtgatctgcccacctcggcctcccaaagtgttgggaatacataccctaggccatgtgctttcctatgcgtcacctccatccatcctcaatagctctgtggcttcggcattgctacacccattgtgcatttttatgcgggaagtggggatttgaagtcatttttttctcccaagaaaacccatgctcttgtcatgaccccacatcagacagacttgggttcagattctgactgtgacactcattagctgtgcgaccttgggcacatcttttaacttctctgaagctcagctacttgtactaaaacaggggtaatgacagaaaaatgaggttattaagagaattggagagtacacctctggggctttttgattgtaaacaacagcaatatactctagggctaactttggagaaggatgaaaggcatttattagaagcatatgaattagctcatataactaaatgcaaagcaaacagccaggtcttggaaaggatgagagccaggccagctgaagagatctggagaatagggaggtaactgccttccttcttcaggggattcttgactgcatgaagcagctccagttgttttcggtgcctaagatgtaggcactgttacctggccctcccttacccctccaaaagcttgaaagagggtcccttcccatgagcgctgaggcccgaggcccagtagagtcagcagtggtatctctgcctttgccccaccaatgactgccagctgccagctgtcttctgccactcgctccttaggactttcattgtcaggaagtcaagcttttcaggaaataaaaagtaacctttttttttttgagacagagtcttgctctgtcatccaggattgagtgcagtggcatgattttgtcatgacaccatattccaagttcaaaaaaatcaataaattaggtccaatgattcttctgccttagcctcccaagaagctgggattatagacacctgccaccatgcctggctagcttttgtatttttagtagagacagggttttgccctgttgcccaggctggtcttgaactcctgacctcaggtgatctgcccaccttggcctttcaaagtgctaggattacaggtgtgaaacgccacaccctgctgtaagttctcttcttctttttttttttgatggagtttcactattgttgcccagaaaggagtgcaatggtgtgatctcggctcaccacaaccttcacctcctggtttcaaatgattctcctacctcagcctcccgagtagctgggattacaggcatgtgccaccatgcccagctagttttgtattttttagtagagacggggtttcaccatgttgatcaggctggtctcgaactcccgacctcaggtgatccacctgccttggcctcccaaagtgctgggattacaggcgtgagccaccgcacccggctgatttttggatttttttgtagagacacgttttaccatgttggccaggctggtctcgaactcccgacctcaggtgatccgcccacctcggcctcccaaagtactggaattgcaggcgtgagccaccatgcccagccttgtcaacttctttacctaggccttgccctcagcatttttttctcttccccttataggcctggttggtttacacaacattggacagacctgctgccttaactccttgattcaggtgtttgtaatgaatgtggacttcgccaggatattgaagaggtaagactgttcttcaggctgataagcgtttgtattatttctttttctttttttttgagatggagtcttgctctgttgcccaggctggagggcagtggcgcgatcttggctcactgcaagctctgccccccgggttcaagcgattctcctgcttcagcctcccgagtagctgggactagcccgccaccatgcctggctaattttttttgtatttttagtagagacggggtttcaccgtgttagccaggatggtcttgatctcctgacctcgtgatccacccacctcagcctcccaaagtgctggaattacaggcgtgagccactgcacccggcctgtattatttcatttttaatatattcagttattcacagtgacttggactttttgagatcttctctcaaaagctggcagaggaaagatcggcttctgcatattctggcctacacattatttctaaaacttcttaggttggtctggggtgcggcccaggtattggtacttttttttttttttttttgagctaaagcctcactctgtccccaggctggagagggatggtgcaatctcggctcagtggaacctccgcctcccaggttcaagggattctcctgcctcagcctctcaagtagctgggattacaggcgcccgccaccacacctggataatttttgtatgtttagtagatacgagttttcaccatgttggccaggctggtctcaatctcctgacctcaggtgatctgcccgcctcagcttcccaaagttctgtgattacaggcatgagccactgggcccggccaggtattggtactttttaaaagccctctttgggtgattttaaatgcagccaggattgacagccactgacttggttaaaagacagagttgggactagaccaaagtcggagaaggagtaagtcagtggggagtacacacccctccttccaccaacactcacacaatgcactctctccctctgtctctctctatcactccttttctgccctgtgctctctcctttttcccatccgaaaaatgcctgtgattaaatgaatcattgccaaaccacacggacagcctttcatgttgcctttcttcccaggacctaacccagcatgtgcctctgcagtctggagagctttaggctggacattttgctgcttgcccgagatgtggagccaggacctcgtgcatctgccgtctgctctagcacgattgctgggcagggtgcagaggggccaaggcagcagtcatgctgatccccctctctagagggtcccctgtagagcagattcactcacatggtgcttctcaaccttgaccacacattgaaataatctgaggaactgaaaaattctgataactgcccgcgccccgccccccggacccagaattctggtttaatttgtatgggagtggcctggatatgaagatttaaaatttctcccaggtgattccagtgtgcacctagctttgagaactacatgtaaggaggtttctggctgttcttgtgtggcaggatcacggtgcccaggggagctgacgagcagaggagaagcgtccctttccagatgcttctgctgctggagaagatgcaggacagccggcagaaagcagtgtggcccctggagctggcctactgcctgcagaagtacaacgtgccccgtaagataccctcccactgggttcctggctgctgatccaaaggggatgggaagcttagagagtgaagagaggaactaatgggcagtgaagcaacaagaagcaagttaggtagcctggacccctcagattatagagacatttgtgtaagaggcacacatctttggaggtgcagaattgatattatttatggacattttacttccatacctaacctttctctgcctctcagtagagtaggtgaaggcatctcctccaagcttattccaccacagttagggaactgcaggaaaacagaataaaggaataaaaaagagaaaacatgttctacaaaataattcacaaataggtcaggttttttttttagatagctatattgggatgtgcatcacatactgtaaaattcatccatttaaaaacatacaattcaaaggtttgtagtgtattcacagagttgtgcctccatcatcacaatctaatttcataacattttcatcacccccagaagaaatcctacacttacgggttttcccttgtgtataatacattgcttttctcttgctgctttcagaattctttgtctttaacttttgaaattgattatgatgtgtcttgatgtgggttgctttagatcagtcttattggtgtcctttgggcttcctggatgtggatttgtatttccttccctgggttgggaagttttcagtcattataggtatgcgttgcttaccaacagggatacgttctgaaaatgcatcagaaggtgaatttgtcattgtgtggacatcatggagtgcacttacacaaacttagatgggacagcctactacacagctaggctgcatgctatggccactgtgctcatgcggtctgccattgactgaaatgttgatctgcaactcgtgactgttatttctttggataagctttccatctcttctcactctcctccttctgggactctgataatgcctattttggtcggcttgatgtcccctaactctcttaagatatcttcactctttttcattctttttcatttttgctcctctgaatgatttccagtgacctatcttctagtttgctaatcctttcttctgcttgatttagtctgttgagcttctcttttgagctcttatttcagttattgtattcttcagctctattatttcttttgaacttttttctgtctctttgctgaaattcttactttgttcatgcattgctgtcctagacatggtaagcatcttcatgatcattattttgaattgtctgtaaggtaagtcacttatcttcatttcaccgggggcattttctggagatttatcttgttcttttgcttggaacagatttctctgtttcttcattgttcttgattctctgttattttctgtactttagttaagaaaaatacctctcccaggctgggcatcatggctcacacctgtaatcccagcactttgggaggctgaggcgggtagatcatgaggtcaggagatggagaccatcctggctaacacggtgaaaccctgtctctactaaaaatacaaaaaattagctgggcgtggtggcgggtgcctgtagtcccagctacttgggaggctgaggcaggagaatggcgtgaacctgggaggtggagtttgcagtgagccgagatcgaaccactgcactccagcctgggccacagagcgagactccgtctcaaaaaaaaaaaagaaaaatacctctcccagtcttgtcccacgggccttgtataagagacgaacttaccaattagccctgccagacactcggagcacctcttgaccttttgtgttgtccaaactgtcatctatgttcttagcggccctcaggagattagaatgtgtcatgtcctgtcagtgccccagacaggggagatagaaaccagccccttgaggtgcagctggagacgttggggcattaaatgtgtgttccagtttattctatcctcagggaaaagctgggagcatgagtttatctgccactcgctctgcaaaatgctggagagaggatctgtggcaagtgcctgcactcaagtttaaactgcacactccttcatgcattgttttactctttgtcacccccaggggcctagcaaatgctggctgttctctgcttagagacggacaggttagttggaagcttgacgctatctgttgagcaaaccagtgggagcagctgtggaggtgctcacctgcctgttcagggtctcagaggagcactggtttcctgctctgtcagctcccagatgcatagaaaccccagggcagcagctgcactgtgcagacaaactccttctagggagaaagtaggagccgggcctttttgcctgttcacgctgcactgggcctggggggatgttctttggtctctgtgcccctgtgggacttacaaatacagagccttgtcagctcccaaagctcggtggttgaggagctagaccttcatttgagaggggtaaatgtgtactcaatgtgtgaagttagagacctgattttaccatacagcagggggtgggagaaggcatgggacttgcccacaggcctgtccagactcctggaaatctattgtttacctgcctcattggctccaggtgcaggccagttattaatagaagcccatccctcgggcaacagctaggagagcccgcagacatatccttccagggaggaactgggagcctggcatttctgcctgtttgctctgtgctgagcacagctgctggaagtgctcacgtgcccgtttaaaactgcctctttgtcctctgtggtcgcagaggattcataactgctaacccatgtctgctcccagagctaggtgacccagcagccaagcccttgagtgggaactgcaaaagctggggctgcctatgtgtggtccaaaccctcccctctccaggagaaagctgggagtagggattccttcctcacagtaaggtactgtgtctggggtggggcttgtggttcgagtgtgtctcagcttttccaaccggttgcgatgtgggtgttctccccattgccccctgtgcaggcctctctcagctggtttctgggtttctttcagagggagttgatctgtgtgtagatgagagttttaccgtgtgtccatgggagaaggggagcaccaggagcctccttctctaccatctcgcttgtgtcaccctctgtgattctttttatacatagttgaatttgattcactaatattttgttgaggaattttgcatttatgttcacgggagatactggtttttaggtttttttcttacaatgtctgtctggttttggtgttaggataatgctggcctcagagaatgagttaggaagtgttctctctgcttttgtcctctggaagaggttgtagggaattggtataatttttcccataaatgtttggtagaacccatcgttcactagtgaacccatctgggtgtaactgagtactcccattttctaagagatagttatattagttttcttattactttcttttcacttctcctcttcccatccctcacccctcaccgcggccgtgtttcctgtttcctgttagccctttagaaatgcaaatatcacctttcgcctacccctctccagacattccctgctgggcaaaaggaagaatctgtaaatggaggtaggctgatggaggtttgattgagaacagggcaagatcttccagctgatctttcctgagacttggcagtagatttgcagcccaaagcatacccaccagggaactctccctgccagggggtggcttcgaaacttccaccctctaggggtttgtctttcacccactaggaaggcatggagaaagcatgcccactcggccacttttctgcccggaaaggcgccaactcagctgctgggaacttgataactgcccggtagaaaaccgccattgctcactccccccacccccacaacacaccttatgaaaatgcccctctctcctccaaaggagaaatggcacattaaaaggcaggatgtgtcttgctccttgccccaggctggcttcagaataagttcacgtttgtgtataaaaccttttgtatcacatttttttttgtatcagagttagttgagctctacacgcagtgagcagctcctcagcttttcgctgcataggtactgtgttcagctttccttccgtcctcagtctggagaacctcaaccaacctagctccaggtttatggattctttcttttgccagctctaatctgctattgacctcctctagtacatttttcatttcagttatggttctcctcaactcaagaatttctgcttggttcttcttttatagttttttctttattgatactttttatttggtgaggcagcattttcacactttcttttacatcttttgacatggttttctttagttctttgaacatattataacggctaaagtctttgtttagtaacgccaacatctagggcttctcagtggaaggttctacgattgctgttttcctgggtggccatgcttttctgtttcattgtaggtcttgtctcttttgttggaaaatgaacattttagataatgtaaggtggcaacactggacatcagagatccccacagcagggtttgttgttgttgctgttttatcgtttctgggcagttcatgattctgtattcgccttcattgctttcttgcatgtggccttgtggtcagccagaggggagggatcggagccctctcaggtcttacttgggcatgcgcctggccttctagatcctcaggaatgtatcagtgcttttcaaagtccctgtggacatctcattccccaggctgagtgcagtggtgacatcacagctcactgtagcctcaacatcctgggctccagtgatcctcctgcttcagcctcccaagtagctctgactacaggcgtgcaccgctactctcaagtacttttttaaattttttatcgagacggagtcttgctatgttgcccaggctggtctcaaactcctgagttcaagcgatcctcccaccttggcctcccgaagtgttaagattataggcatgagccactacatctggcactggagcttaagtattaagaggcgttctcaaaaatcaataccaaacttactgtttgtttattgatcacttcttctgtcgtgccgacttagccttgcagtggggtggagggctaggaagagacaaagtgatcagtgttcatgtgtgtctaagtaccagggcatgagaagtgactctgaagacctcactaattggctgttccttttctctgtggccagtgtttgtccaacatgatgctgcccaactgtacctcaaactctggaacctgattaaggaccagatcgctgatgtgcacttggtaagaacctagaaccagagcactcggaagcttaagatgctgctcatttcattcattcagctgttgttcccgtagtgtgtagaggaataaaagagttaatcccctgtaatcccagcactttgggaggctgaggcaggcagatcacgaggtcaggagatcgagaccatcctggctaacacggtgaaaccctgtctctactaaaaataccaaaaaattagccgggcgtggtggcgggcgcctgtagtcccagctactcgggaggctgaggtgggagaatggcgtgaacccgggaagtggagcttgcagtgagccgagatcgcgccactgcactccagcctgggtgacagagcgagactctgtctcaaaaaaaaaaaaaaaagagttaatccacataaaacacttatcacagtttcataatattgttactggtattattttgcacctttgtgaggagcttctgtctcttggctccaccttctggcagttggcctgacctggcttatggtggtgttcccatctcacctctccgctctccctcttgcaggtggagagactgcaggccctgtatatgatccggatgaaggactccttgatttgccttgactgtgccatggagagtagcagaaacagcagcatgctcaccctccgactttctttttttgatgtggactcaaagcccctgaagacactggtaaggggattctcttggtatttgctgcacctgtatgtgttagtccattttctgttgttataactcaatatctgagactaggtaatttatttcttacagttctggaggctgggaagtcaaggttgaggggctgcacctggtgaggacctgcttgctggtggggactctcagagtcctgaggcgaggcagtgcagggcatcacatggcgagggggctgagcatgctaatgtgccggctcaagtctctcttcctcttcatatgaagccaccagtcccactcccaggataaccgattaacccattaatccatgagtggattaattcatttatgagggctgtgccctcatgacgcaataacccccctaccttttattttggagacagattcttcctctgtcacccagactgaagtgcagtggcacaatctcagctcactgcaacctccgcctccggtgttaagcgattctcctgcctcagcctcccaagtagctgagattacaggtgcccaccaccatgcccggctaatttctgtatttttagtagagatggggtttcaccatgttggccaggctgatctgaaactcctgacttcaagtgatccccctgcctcagcctccttgggattacaggcatgagacaccttgccctccccaattatctctcaaagtccccacctttccatacagccacactggggattcagtttcaacctgggttttggggaggacaaaccctcaaaccatcacaccacacagcacagtgtggccaattcccccttgcctctttgatctatctctggcttctggaaagtcacttatttcattttcacggcgctggccaatttctcctttgttttggcaaaaatgtttttccctcctacctccacttccctcatactgctcccttaataggagccccctcctgttttgttcctccagtcagtaggtgccctttgagatcctgccaagtggaccacaccaggccaggcattaagggggatatgaggagaaccagaagaaaagctgaaaccctcagctgcaaagtgtggggaggctgtacctgatacagtttgggtctgtgaccctgcccaaaaatctcctgttcaattgtaatccccagtgttggaggtaaagcctggtggaaggagattggatcatgggggagtgtttctcgtgaatggtttggcaccatcccccgtggtactgtctttgtgacagtgagttctcatgagatctggttgtttaaaagtgtggagccaggctgggtgtggtaactcacgcccataatcccagcactttgggaggctgaggtgggtggatcacctgaggtcaggaatttgagaccagcctggccaacatggtaaaaccctgtctctactaaaaacataaaaaattagctgggcgtggtggtgcagcctgtagtcccagctacttaggaggctgaggcaggagaatcgcttgaacccgggaggtggaggttgcggtgagctgagatcgcgctcctgcactccagctccccacttggtctcttgcacctgctcctcccaggtaagacgcctgctcctgcttggccttccgccatgattgggagcttcctgcggcctccctagaagcagatgctgccatgcttccggtcggcctgcagaaccatgggccaatcaaacttcttttcttataaattacccagtctcagctattgtctcacagcagtgtgagaacagacgaatatagtattctaggtgggaaataccaacgctgctttttccctgttctcttgggtgggacaggaggacgccctgcactgcttcttccagcccagggagttatcaagcaaaagcaaatgcttctgtgagaactgtgggaagaagacccgtgggaaacaggtactcattccctaaatcagactcagctgtccctcggtgcatatgggggatttgttccaggacccctgcttttaccaaaatccacacacactcaagtcacacccagtcggccctgtggaacccacgtataggaaaagtcagtccctcatctatgcggttgtgcatctgggatactttatttttgatgagcatttggttgcagatgtggaactcgtgcctatgggggagggcagactgtatttatttacaacaatttgtgtataagcggacccatacagtccaaacctgtgctgttcaggggtcatctgtccttcactagtctggggttgccccccgtggatttcctgatagaatcatcagaggccccgaggacatcccatgatgggtgagaaagggaatctgggtctggctagtatctgggacgctgtggttctgatatctggagccgtggatgtggcttctcatgtcgcatcactgagagggactgcaggagggggcctgagagcagcgggcagggcatttccctcggggcgagaccagctccctggagcagacgtggtggctccctgggtcctggtacctgtgcagagccctgtgcccttgtgcctcttgtggggggccacatggtggtagaatagccaagttttgcattattctcagaggagctcagcagattcagtgaacaggagccttgaactccatgatgtcgccctgctcccctctttttgggaagaacgcgttgctagccctgacatttctctgactctctcattccaagtggacttcatctccagagtgattttgatttttcaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcaggtgggatgatcccgacctccttgccatcctgcctctccccagatgccatgtcctttctgttttcccttccttcacccccagtctgctaggagccacctgttcctcagagactgtccccagcctcaaaagcctttcttctttctaaatattggatttgtgttcatatgcctcacagcactgagggacagaatccagaattcagtaggcttctttggaaataatgtggaatacatagaaatgcataggcaaacatgtcattgtgggttcatagtaccaaccaaactttcttcctcagatggcctgtgcccactttgaggataatcataaagtagccagttgactggaccacatttaatcagagtaaagtttaattcacttgtcctgagataataacttatcaagagattctgagaaaaaaagagacacaaggccaggtgatgtggctcatgcctgtgatcccacacctcaaaaggctgaggcaggaggattgcttgagcccaggagttcgagaccagcttcagcaacataatgagacccccgtctctcaaaaaaaaaaaaaaaattagctgggtgtggtagcacaaacctttagtcccagctacttgggaggctgagttggaggatcacttgagcccaggagtttgaggctgcagtgagctatgatctatcattgtactccagcctgggtgacagcgcaagaccccgtctctaaaaacaaaacaagaaaaacttaaaaaaaaaaaaaaaaaaaaaaaaaaaggacccaaatatctttttttccatagatttgaaatgctacataacaaattttgtatttctatatgtacgggtctatttttggagtgtctcttctgttttattggtctgtttggctatttatgctctagaaccatgacatttagaaaattaagacctgataatacgttacaatagctcctattataacatgatttctttccctacttaggccgtatacatttcataggattctctttttctttccttctagttctttttatttctacctgcagattctacccgatgaagtacatttaaaattgtttttcacttaaaaaagacttttttggctggatgcagtgggtcacacctgtaatcccagctctttgcggggccaagaggattgctggagtccaggagtcgagcccagctggacaacaaagcaagactccatctttgcaacaacaacaaaaaagactttgttatggaacattacaaatagataccaaagtgtgtagtgaaggaagagttagacagtgaatccttggctgtaacagttaccaaaacgcatggcaggtcttgcttttcctataacccaccctcttgtttcacccaaccctgtactggatttttttgaagcaaatcccagacatcatactatttcatttataaacacttcattatgtatcactaaagaataagcacttaaaagataatcatctccatcttgcaattccttaatagcatcaaatatctggttaacgttcagacttcctgactgttgtgtaatctatgtggtttgtttgactctagatccaaacaacgcctacacttgcatttggttaagtttctttcttttcttaagttccttttagatttccgctccttttcttttccttgcagttgatttggttgaatatttttttcatatgccagcactggctggttgatatcttttaacatcatctataacccttttatttcttgtaaactaatatttagatacagatattgccctgcattttgtaaagttctgcacaaagtctgcaaatggaaatagggataatttcagcctccactgtgggtgactcagctttgcgtgtgccgcccttgccctctgtctcccctccccctacaaaagacttttttggctgggtacggtggctcaggttagggtcattcctgggcttgtggagaagcagaactgtgttctgatgatccccacccctcccaggggaaagttctaatcttgccttggctttgggggcctctctcatgacctcatgccttccatctcttgtgtgctctgccctgccaagctgctgagccttcacagttcaggatccacactcaggaaagcccctcctggagggtgcccactggccgtgggtcaggactgttttctaatattctaaagtcccagagtcgggcctcgggtggacaggtataaatgtgtgaggcagtcgtgtttgtggtggtgggtgaactgtctcgtgcctgtctctttccagtctggagggcagtatgagctttttgctgtgattgcgcacgtgggaatggcagactccggtcattactgtgtctacatccggaatgctgtggatggaaaatggttctgcttcaatgactccaatatttgcttggtaagaaacatcatccacaattgcctcctgccctggattggccacctctagcaaatgctgggctcagggctgcctgggtctctgagatcaagacacactgtgatcctgctgtctgggtgtggggcctttgatgagggttcaagcctttttcggtctgaagtccccatgtggtttgcacctctgcaagggttcaattcacttcacttctaagtttttggtgctctaggctcatgctctgcagcttcctgctttgtgggaaatgtctagagagcaaggagagttagaaatatgtaagttaggcctctgggaaaagcatgaccaagtttaaacacagggacaagggcgctaaacatacttcactgcacaagacatcctgctgctgttgctccaggctcttgggagttgctaggggtgggcttgtctggaggatgaggggcacattatagtgtcctgtcctctgtgggtgcttgtgtcagctggctgcttgaccccatttgtttctggcttccaggtgtcctgggaagacatccagtgtacctacggaaatcctaactaccactggtaagaaacagatttgggtaattggagtctgatgagctcacatagggtccttggagctgcatgaaacgcccatggattcccctgttactaacatgctgatggctcactgtctgcctcatctccagcactcaccccaccaccccatgtttgcctcacacgtcacactccaggaatattaaagtacaggtagctgccaatcagccgtgccctccatctcccgtctgctgtgcacatgcacttcctggccgtattgtcctctcctcgtttaccatctaggccaaccccccactcatgttttcatactcatggccttttcctatcctgtgaagcctttgctgattcacccagattcgtaggggcttcttgtatggttttctttttttcttttttttgacggagtctcgctctgttgccgggctggagtgcagtggcacaatcttggctcactgcaacctccgcctcccaggttcaagcgattctcctgcctcagcctcctgaatagctgggactacaggtgtgtgccaccacgcccagctgattgttttttgtatttttagtagagacggtgtttcacgatgttggccaggatggtctcagtctcttgacctcatgatccacctgcctcagcctcccaaagtgctgggattacaggcatgagccaccacacccggccttcttatatgattttattgcatttgagcatacctcttttacatcgaagatctttttttttaatttaattttatttttagagatggagtcttgctttgttgcccaggctggagcattgtggtgtgatcatagctcactgcagccttgaactcctgggcacaggtgatcctcccacctcagcctcctgaatagccaggactacaggcatgcgccacaatgcttggcatatttttaaaaaatgtttgtagagatgaggtctcgctgtgttgccaggcttgtctcaaactactgggctcaagccatctgtatggtgtcctcattagtgatgtcgtgtacaacgtcctcatcagcgatgtcatatatagcatcctcattagcgatgtcgtatacagtgtgctcactagcaatgtctttttttttttattatactttaagttttagggtacatgtgcacattgtgcaggctagttacatatgtatacatgtgccatgctggtgtgctgcacgcactaactcgtcatctagcattaggtatatctcccgatgctatccctcccccccccaccccacaacagtccccagagtgtgatattccccttcctgtgtccatgtgatctcattgttcaattcccacctatgagtgagaatatgcagtgtttggttttttgttcttgcgatagttactagcgatgtcttatacggtgtcctcattagcgatgtcgtgtacagtgtccgcgttagcgtgccttgtcggtatcattagcaatgtcgtataaagcgccctcattggtgatgtcttgtatggtgccctcattagcgatgttgtgtacagtgtccttgttagcgacggcttgtagggtgtcctcgttagcgatgtcgtatacagcgtcctcattaccgatgccttgtatggtgtcctcattagcgatgtcctgtacagtgtcctcgttagcgtgccttgtacggtgtcattagcgatgtcatatacggcatcctcattagcgatgccgtatacggagtcctcgttagcgatgccgtgtacggcgtcctcgttagcgatgccgtgggcggcgtcctcgttagcgatgtcctgggcggcgtcctccttagccatgtgccgggcggcgtcctcgttagcgacgccgtggacggcgacctcgttagcgacgccctgggcggcgtcctcgttagcgacgccctgggcggcgacctcgttagcgacgccgtgggcggcatcctcgttagcgacgccgtgggcggcgacctcgttagcgacgccctgggcggcgtcctcgttagcgacgccctgggcggcgtcctcgttagcgatgccctggatggcgtccttgtgtgcgatgccctggacttcgacctcgttagcgacgccctggacggcgtcctcgttagcgacgccgtggacggcgtcctcgttagcgacgccctgggcggcgacctcgttagcgacgccctgggcggcgtcctcgttagcgacgccgtgggcggcgacctcgttagcgacgccgtgggcggcgtcctcgttagcgacgccctgggcggcgacctcgttagtgacgccctgggcggcgtcctcgttagtgatgccgtgggcggcgtcctgcttagcgatggcctgggcggcctcctcgttagtgatgccctggacggcgtcctcagcgatgccgtcggcgacatcctcggtagcaatgccctgggcagcgacttcgttagccacgccctggacggtgtggtgtcctcgatagcgatgctgtggacggcgacctcgttagcgatgccctgggcggcgacctcattagcgatgccatgggcggcgtccggcttagcgatcgcttgggcggcatcctcgttagcgacgccgtgggcggcgtcctcgttagcgatgccgtcggcgacatcctcggtagcgatgccctgggcggcgacctcgttagcgatgccgcgggcggcgtccggcttagcgatcgcgtgggcggcatcctcgttagcgacgccgtgggcggcgacctctttagcgacgccgtggacggcgtcctcgttagcgatgccctggacggcgtcctcgtgtgcaatgccctgggcggcgtcctcgttcgcgatgccctgggcggcgtcctcgttcgcgatgccgtgggcggcgacctcgttagcgatgccgtgggcggcgtcctcgttagcgatgccctggacggcgtcctcgtgtgcgacgccctggacttcaacctcgttagcgacgccctggacggcgtcctcgttagcgacgccctggacggggtcctcgttagcgacgccctggacggggtcctccttagcgatgccctgggcggcgtcctcgtttgcgatgtcctgggcggcgtcctcgttcgcgatgccctgggcagcgtcctcgttggcgatgccgtgggcggcgtcctcgttagcgatgccctggacggcgtcctcgtgtgcgacgccctggacttcaacctcgttagcgacgccctggatggggtcctccttagcgatgccctgggcggcgtcctcgttcgcgatgccctggacggcgtcctccttagagatgccgtgggcggcgacctcgttagcgacgccgtgggcggcgtcctcgttagcgatgccgtcggcgacatcctcggtagcgatgccctgggcggcaacctcgttagcgatgccgcgggcggcgtccggcttagcgatcgcgtgggcggcatcctcgttagcgacgccatgggcggcgacctctttagcgacgctgtggacggcgtcctcgttagcgatgccctggacggcgtcctcgtgtgcgatgccctgggcggcgtcctcgttcgcgatgccctgggcggcgtcctcgttcgcgatgccgtgggcggcgacctcgttagtgatgccgtgggcggcgtcctcgttagcgatgccctggacggcgtcctcgtgtgcgacgccctggacttcaacctcgttagcgacgccctggacggcgtcctcgttagcgacgccctggacggggtcctcgttagcgacgccgtgggcggcgacctctttagcgacgccgtggacggcgtcctcgttagcaatgccctggacggcgtcctcgtgtgcgatgccctgggcggcgtcctcgttcgcgatgccctgggcggcgtcctcgttcgcgatgccctggacggcgtcctccttagagatgccgtgggcggcgacctcgttagcgatgccctgggcggcgtcctcgttcgcgatgccctgggcagcgtcctcgttcgcgatgctgtgggcggcgacctcgttagcgatgccatgggcggcgtccggcttagcgattgcttgggcggcatcctcgttagcgacgacgctgtggagggcgtactcgttaacgacgccctggacggcgtcctcgttagcgacgccgtgggcggtgacctctttagcgacgccctgggcggcgtcctcgatagcgacgcagtggacggcgacctcgttagcgatgccgtgggcggcgacctcgttagcgacgccgtgggcggcgtcctcgttagcgatgccgtcggcgacatcctgggtagcgatgccctgggtggcgacctcgttagcgatgccgcgggcggcgtccggcttagcgatcgcgtgggcggcatcctcgttagcgacgccgtgggcggcgacctctttagcgatgccgtggacggcgtcctcgttagcgatgccctggacggcgtcctcgtgtgcgatgccctgggcggcgtcctcgttcgcgatgccctgggcggcatcctcgttcgcgatgccatgggcagcgacctcgttagcgatgccgtgggcggcgtcctcgttagcgatgccctggacggcgtcctcgtgtgcgacaccctggacttcaacctcgttagcgacgccctggacggcgtcctcgttagcgacgccctggacggggtcctcgttagcgacgccgtgggcggcaacctctttagcgacgccgtggacggcgtcctcgttagcaatgccctggacggcgtcctcgtgtgcgatgccctgggcggcgtcctcgttcgcgatgccctgggcggcgtcctcgttcgcgatgccctggacggcgtcctccttagagatgccatgggtggcgacctcgttagcgatgccctgggcggcgtcctcgttagcgacgccgtgggcggcgtcctcgttagcgacgccctggacggcatcctcgttagtgatgctgtgggcggcatcctgcttagcgatggcctgggcggcctcctcgttagtgatgccatgggcggcgtcctcagcgatgccgtcggcgacatcctcggtagcgatgccctgggcagcgacctcgttagccacgccctggacggtgtggtgtcctcgatagcgatgctgtggacggcgacctcgttagcgatgccctgggcggcgacctcgttagcgatgccatgggcgctgtccggcttagcgatcgcttgggcggcatcctcgttagcgacgacgccatggagggcctcctggttaacgacgccctggacggcgtcctcgttagtgacgccgtgggcggtgacctctttagcgacgccctgggcggcgtcctcgttagcgacgccgtggacggcgtcctcgttagcgacgccctgggcggcgtcctcgttagcgacgccctgggcggcgtcctcgttcgcgacgccgtgggcggcgacctcgttagcgatgccgtgggcggcgtcctcgttagcgatgccctggacggcgtcctcgtgtgcgatgccctggacttcaacctcgttagcgacgccctggacgacgtcctcgttagcgacgccctggacagggtcctcgttagcgacgccgtgggcggcgacctctttagcgacgccgtggacggcgtcctcgttagcaatgccctggacggcgtcctcgtgtgcgatgccctgggcggcgtcctcgttcgcgatgccctgggcggcgtcctcgttcgcgatgccctggacggcgtcctccttagagatgccgtgggcggcgacctcgttagcgatgccctgggcggcgtcctcgttcgcgatgccctgggcagcgtcctcgttcccgatgccgtgggcggcgacctcgttagcgatgccatgggcggcgtccggcttagcgatcgcttgggcggcatcctcgttagcgaagacgctgtggagggcgtcctcattaacgacgccctggacggcgtcctcgttagcgacgccgtgggcggtgacctctttagcgacgccctgggcggcgtcctcgttagcgacgccgtggacggcgtcctcgttagcgacgccctggacggcgtcctcgatagcgacgccgtgggcggcgacctcgttagcgacgccgtgggcggcgtcctcgttagcgatgccgtcggcgacatcctcggtagcgatgccctgggtggcgacctcgttagcgatgccgtgggcggcatccggcttagcgatcgcgtgggcggcatcctcgttagcgacgccgtgggcggcgacctcgttagcgacgccgtggacggcgtccttgttagcgatgccgtcggcgacatcctcggtagcgatgccctgggcggcaacctcgttagcgatgccgcgggcggcgtccggcttagcgatcgcgtgggcggcatccttgttagcgacgccgtgggcggcgacctctttagcgacgccgtggacggcgtcctcgttagcgatgccctggacggcgtcctcgtgtgcgatgccctgggcggcgtcctcgttcgcgatgccctgggcggcgtcctcgttcgcgatgccctggacagcgtcctccttagagatgccgtgggcggcgacctcgttagcgatgccctgggcggcgtcctcgttcgcgatgccgtgggcggcgacctcgttagcgatgccatgggcggcgtccggcttagcgatcgcttgggcggcatcctcgttagcgacgacgccgtggagggcgtcctcgttaacgacgccctggacggcgtcctcgttagcgacgccgtgggcggtgacctctttagcgacgccgtgggcggcgtcctcattagcgatgccgtcggcgacatcctcggtagcgatgccctgggtggcgacctcgttagcgatgccgtgggcggcatccggcttagcgatcgcgtgggcggcatcctcgttagcgacgccgtgggcggcgacctctttagcgacgccgtggacggcgtcctcgttagcgatgccctggacggcatcctcatgtgctatgccctgggcggcgtcctcgttcgcgatgccgtgggcggcgacctcgttagtgatgccgtgggcggcgtcctcgttagcgatgccctggacggcgtcctcgtgtgcgacgccctggacttcaacctcgttagcgacgccctggacggcgtcctcgttagcgacgccctggacggggtcctccttagcgatgccctgggcggcgtcctcgttcgcgatgccctggacggcgtcctccttagagatgccctgggcggcgtcctcgtttgcgatgtcctgggcggcatcctcctttgcgatgtcctgggcggcgtcctcgttcgcgatgccctgggcagcgacctcgttcgcgatgccgtgggcggcgtcctcgttagcgatgccctggacggcgtcctcgtgtgcgacgccctggacttcaacctcgttagcgacgccctggacagggtcctcgttagcgacgccctggacggggttctctttagcgatgccctgggcggcgtcctcgttcgcgatgccctggacggtgtcctccttagagatgccgtgggcggcgacctcgttagcgatgccctgggcggcgtcctcgttcgcgatgccctgggcagcgtcctcgtttgcgatgccgtgggcggcgacctcgttagcgatgccgtgggcggcatcctcgttagcgatgccctggatggcgtccttgtgtgcgatgccctggacttcgacctcgttagcgacgccctggacggcgtcctcgttagcgacgccctgggcggcgtcctcgttagcgacgccctgggcggcgacctcgttagcgacgccctgggcggcgtcctcgttagcgacgccgtgggcggcgacctcgttagcgacgccgtgggcggcgtcctcgttagcgacgccctgggcggcgacctcgttagcgacgccctggacggcgtcctcgttagtgatgccgtgggcggcatcctgcttagcgatggcctgggcggcctccttgttagtgatgccatgggcggcgtcctcagcgatgccgtcggcgacatcctcggtagcgatgccctgggcagcgacctcgttagccacgccctggacggtgtggtgtcctcgatagcgatgctgtggatggcgacctcgttagcgatgccctgcgcggtgacctcgttagcgatgccatgggcggcgtccggcttagcgatcgcttgggcggcatcctcgttagcgacgacgccgtggagggcgtcctcgttaacgacaccctggacggcgtcctcgttagcgacgccgtgggcggtgacctctttagcgacgccctgggcggcgtcctcgttagcgacgccctcgacggcgtcctcgttagcgacgccctgggcggcgacctcgttagcgacgccgtgggcggcgtcctcgttagcgatgccgtcggcgacgtcctcggtagcgatgccctgggcggcaacctcgttagcgatgccgcgggcggcgtccggcttagcgatcgcgtgggcggcatcctcgttagcgacgccgtgggcggcgacctctttagcgacgccgtggacggcgtcctcgttagcgatgccctggacggcgtcctcgttagcgacgccctggacggggtcctcgttagcgacgccctggacggggtcctccttagcgatgccctggacggcgtcctcgttattgacgccctggacggggtcctcgttagcgacgccctggacggggtcctccttagcgatgccctgggcggcatcctcgttcgcgatgccctggacggcgtcctccttagagatgccctgggcggcgtcctcgtttgcgatgtcctgggcggcgtcctcgtttgcgatgtcctgggctgcgtcctcgtttgcgatgccgtgggcggcgtcctcgttagcgatgccctgggcggcgtcctcgtttgcgatgtcctgggcggcgtcctctttaaggacgccctgggcggcgacctcgttagcgatgcagtggacggcgtcctcgttagcgacgccctgggcggcgacctcgttagcgacgccgtgggcggcgtcctcattagcgatattgtgggcggcgtcctcattaacgatgccctgggtggcatcctcgttagcgatgtcgtggaccgcgtcctcgttagcgatgctctgggcggcgtcctcgttagcgattacgtgggcggcatcctcgttagcgatgtcgtggacggcttcctcgttagcgatgccctgggcggcgtcctcctttgcgatgccctggacggcgtcctcgttagcgatgtcatatatggcgtcctcagtagcaatgtcatatacagcgtcctcattagcgatgtcgtgtacagtgtcctcatagggagctagaagaacacagagttaaggtcagtgccctggtgctggagactgtgaatcacccaggggcttgcttggtgtgatgcatggaggtggctgattacagcatgggtcaagctgatggtgggacatactcccaggtggacctgcactagtgaagctaagggatgtggctcagaacactttctgctgtgggaatcattttccaggttcaggtatgtattatccggtgaaatggggaaatataaaaaaatagaaattgacaaattcatgaaaagccttccatgagtgcaagtgtgattttttttatccactttacattcagtatgcattcacacatacaaaatatttttacaagaaatcagaaattttaatttttgtcagttatgttaaatctaacttagctgccaacataaagattctatctcatttacttggtctcgagaaaatctagcacatagtaagtagaccaaaatgtttattaaatgaaaacacagagcagagataggggggctgctaggcagactgggttgcacctgattacctggatgataattaactgcacaaaacctcggtcaaattaatattgaaactgtcttttgcttgggctcgtttcccttgcggaagaaggatgacgaagaagatgaacaggaaagaaatgagaaacagaggcctttgcttagtagctaaaggccaccttctataacatgaaatagtctgcaagtggccttgaactctgccgtgattcagtgacagagttccctcatgtcttctacccaggttgaagtccagcaaaattgcgactgtcctctttacaacttgcgagaccacactgcttctgcatttgcctgttgtatgtatgagatttacacgtgttttaaagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggaggatcaggaaaaataactgatattaggctcaatatatgggtgatgcaataatctgtacaacaaactctcatgacacacatttatatatgtagcaaacctgcacatcctgcccatgtacccctgaacttaaaagttaaaaaaaaaaaaaaaaaaggattggtgagctgagccaaacacctggggatctttgtgcttttgacacactgatgactatgcctgtctgtggggagatgagcctataactgccttgggttgtgtgaccacggagcccactttatgatgatgggcagtgtctggggccttttgggctcggtgctttagggcttatacatgaatgttggactccctgtgtggtggtgaacaccccatgactaagtgccatgtcagcgtcagcactggcccacactcctgggttcgtgttttcactttttcattcaggaactcgggagctggggccactcccttggcccttcagtttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggcaagtgattccagaatacttactagattcatgcctcagaggggccacctgcaccacctgcaatacagaaacaaagctttttgaggggtatgtcacgttgtggattgtttgcacaaggctgtgtttctctcaatgaatattgaaaacttgatcagaaagtgtagtcaacttcaaggcctccaaaacaagggtaggatacacactggaaaaggcatcagcttctggacggtgtatctctcaggtccacgtaggttggcaagtgcaaaatactgaatccaaggagaagacattgcttccaaggacaaggaccccaaggatacagtccacaacctgaagccgtcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcacgttgactggcctctctccatctcctctgtccttgtgaactagagactcctcagaggctaagaggacacagagcaacagttagtcatagatgcttttgttcatgagttattcagggagctctgctcaatgtggacaacaggacagtgtgtgtggatgtgtttcattaaaagcacagcttgagctcctgctagaaaatcttccctggtggaaagacaggcaagaacgaggagctaaggagcaagaaatagagtccctggcattttgctgatggcaacttaaggcaatgggaatgagtcagtctacaaatggtactgaagcacatgctatagtttgatgagagtcccactgctcacactgtgaggtttgaaacccagctaaatggttttctaaaccctgtaaaaacgatattagcttgcaggatttatgtcccaagactacttttacctctgaggatccacagtggctgtcactgcagttattatgtgttttagcattttgcacttgaataaaagcaaagtttaatagacagattggattcgattctaggcaaaacagtctatggtatttattcactaatcctttgttataactgctgatgggagaattagaagtactgaaattatatcttttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacatgggttgaatgctggtgtgttttaactctgcagcgcaaacagttgcaacaagtgtggtgaactaaacaccagatggccctttgctgccttatttgtcattgtgccttacatgtagcttgcaggatttgattacgcttatgttttgtggtgatcatactttcaactattcctaaaatactgcttcagtcttatctgtttggggtcaactgccgaggatttcatacaaattaatgaagtttgtgaatctaaagttctacacaaaggtggaaatatttgcaaatcatttatcttgtaagagactaaaatttagaatatattttaaatatatttaagatatattcaaaaatctacaacaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacggaaatcaaacagatgtttgtatactaatgtttgtagcatcacttttcacaggagccaaaaggtggaaataatccaaccatcagtgaacaaatgaatgtaataaaagcaaagtggtctgcatgcaatgctacatcatccatctgtaaaaaacgaacatcattttgatagatgctacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatattgcttattgtggacaaggtttcgtaagaaatcatcaaaattgtgggtgtagatagtggtgctggttatgcaaccctgtgaatatattgaatgccatggagtgcacactttggttaaaaggttcaaatgataaatattgtgttatatatatttccccacgatagaaaacacgcacagccaagcccagatgccagtcttgttagctgccttcctttaccttcaagagtgggctgaagcttgtccaatctttcaagattgctgaagactgtatgatggaagtcatctgcattgggaaagaaattaatggagagaggagaaaatttgagaatccacagtactcaccctgcagggccaagaactctgtctcccatgctttgctgtcctgtctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggaatgaatccaccccaaatgtccctttctggaggaagccaccattatgctgtacctccaagcataatggtacgtccacacacaccaaggcacctcgctcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttactttcatcatttcttacatattggggcctaccatacattgtacggtgaaattagtgctatgcatcatggtagaaatataaattggcaaaagtaatttagaaaatagttcccttctttcttaaaaaaattaggctgggtgtggtggctcatgcctataatcccagcactttgggaggcagagatgggtggatcacctgaggctaggagtttgagactagcctgaccaacacagcaaaatcctgtctctcctgaaaatacaaaaattatccaggcatggtggcgtgtgccagttgtcccagctactcgggaggttgaggcacgagaattgcttaaacctgggaggtggaggttccagtgagccgagattgtgccactgcactccagcctgggtctcagaaaaaaaaaaatttttttgaccaaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaacttgggtgagggaaacatatttaaattagatcgtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagcattaattcaaatggttgtcacaggtcacttaaagttagatagttgtcctacaaatatagggtgaatgttattcatgaatttcctgaatctattgcaataatcacatttttttccattaaactcttgaggtagctaattttatttattgcattttcaatgttaatctactatttcatatattgagattaactcacattagtcagaatttacagtattttaaaatatcacagaatttaatttaccttatctggttttggtttcaagactatactagccatttcatttaattgtacatgtagggtattctaatttatggaaaactattacatcttccttgatttttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttatttattttgagatggagtttcactcttgtcacccaggctggagtgcaatggcatgatcttggctcactgcaacctctgcctcccgggttcaagcgattctcctgcctcagcctcctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttatattctctatcagagaagatgctggttaatgcatttacaatagatagggctgttgacatcttgctgacagaggaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggagaatacagcaggatgactgtgagtgcagggctggtgcagagtaggggcccggattcaaattccactaagccatgtggacctggcaagctcatgtcctccctctgccctcagttctctgcactgtcataatgtaattttagcaatactttttaggccctatttaggccctacttcttagtatcacagtacagggctaaaaaatcactaaatacaggaaaaccttagagaggactggtacttcagtaatgttctctaagtgtttactacaggccaggaggaataagctggacactcagcagtggcggaatatggagggggaacttggatggctccggggcagtggagcatgctttcctgttcggcttttccgtgggcatgatgccttatggtttatggagaacatcagccctgcagggggtgcagaggaggggctgtgactgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccagagacccaagagacccctcactgtttttctccagtcctcctagcccaaggtgtgtgggtggacaaaggtgatgctctggaggaaatgcctgagataaggacaggtccttaatgataaagaattctccttcctctttcagatccttgacctcccagtatgacagcttaaaggctgtcatctctgtggcctgcctcccctttcccttcaccctgccagctgcctctcagtgactgtctcctccagtgactacactgagggaccagggactgcttgcctcccgaggctgctcagaccttccgacactgcaaaatgattgtcaaaagatgggtctgcaaagagtaacttcccttccactgatcaaacctgaatatgcaagctactgtgaattaactggaaaagtggccgtgtgggctggtgctttggtgatttaatgaattaagtctgcaacccccactgcctccttgactattgatcagagctgcctgcaataaggtctggctaagaatgggcagtggctgcaccagctctgggtaaaatttgacctaaaatgaccagtctcattcactaacctcaccatagtcttatgggttcaatggacctgtccaatcctttgctctgttctctccatcaccttcctgtgtaattttcctccaccacgcacataagagaaacatggcacaggggagctaatcgcctcttttatcccccacttcaggctcacacgtaagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacattgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagtggttgtagttcaggccttcaacattagcaccgtatgaggaaacattttgactcttcactatgcagcaagtgaaccagggcacatttatttatgtggcttagtttctccatctggcatgtgggctcaataaacaagctcacaacatatgggcatgatgatgatgaggtgtgaactaatgtaagtaaagtatgtggtctgatttgttaaattaagaaacatggcactgagagttgtgctgggtaaacacaacatttttttcctaggggaaacacacatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccagacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagactggaaataaggttcaagtcaaaagccccaactctagagtagagttgccttaggaaagcacaggagcttttgttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtggtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagacttcgccatattctccccaggggaataacttaatctgtggggtgggggatggaacgttgaaggatgcaggttgaaggatgcaggatgtaaaaggaaattatatatatattatgacatatattatattatatatattatgacatatattatattatgacatatattatatatgacatatatataatatatgataattatattatgtatataatatatattatttatatatattatatatattatatatatgatatataattatttattatatattatatattatataatatataatatataattatatatcatatatattatatatataatatatattatttattatatattatataatatataatatatataatatataattatatattatatattatatattatatattatatataatatataaataatatatattatatacataatatataatatataatatatataatatatataatatataatattatacatattatatataatatatattatatatactatatatattatatataatatatattatatatactatatatattatatataatatatattatatatactatatatattatatatagtatatatattttatatataatataaaatatatataatatattacatataatgtatatattatatataatatatatgttatatatattatatattatataaaatatatataatatattatatattatatatattatatatatatatatataaaatttgggaatttgggaataaacggactcccaattcacactgggactacaccagctgccaccatgcctggctaattgattgtatttgtagtagagacagggtttcactgtattcgccaggatggtcttgatctcctcaccttgtgatcctcttgccttggcctcccaaagtgctgggattacaggcctgagtcaagatacatattttttaaatgaagaaaaatttcaaagatactctgcttggtacagtaatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacgtaggaccaagggcaggagatccctaatcccatcaccatggtgatagggcataaacattccagggtgaaggcacaatccacactgtgaggtccaactgctgccatgcagacaggtgggcttttacaactacaggaaggtcatcaaaggctcagtgttttgtttcaaaaactgaatcccaagcccacacattattatgctggcttcttaaaataagttatgagatgggaaatagggcacccaaaaatatatatatatataattatatataatataatatatagtatatatataatatatttaatatattttatatatatatatatataaaatttgggaatttgggaataaactgaatcccaattcacactgggactacaccagctgccaccatgcctggctaattttttctatttgtagtagagacagggtttcactgtattggccaggatggtcttgatctcctcaccttgtgatcctcttgccttgggctcccaaagtgctgggattacaggcctgagtcaagacacatattttttaaatgaagaaaaatttcaaagatactctgcttggtacaataatcaaatatataaattgaggaataaaacataatcatgaaacatatttataactgcatatggaaaatacagaggctaattttttaaataatatattttgaaagtattaactagtaatttgaaaagatcgcatttgacaggccagtaagaacataccttgaatgcagccacacaggttccccataagaaaaatcaaaatcagggaaaatgaaaccacaatggttcaatctgctctgacgtttgaaaaactcagcacagatagtggcacttaggaccaagggcaggagatccctaatcccatcaccatggcgatagggcataaacattccagggtgaaggcacaatccacactgtgaggtccaactgctgccatgcagacaggtgagggcttttacaactacaggaaggtcatcaaaggctcagtgttttgtttcaaaaactgaatcccaagcccacacattattatgctggcttcttaaaataagttatgagatgggaaatagggcacccaaaaaaatatatatatataattatatatgacataatatatataatatatataacatatatataatttccttttacatcctgcatccttatattatatataatattatgtataatataataggtattattatatataatataatatatatgaatatatatagcaatataatataatatatgtaattatatataatgatatataatatataattatctatattatatataatataatatataatataatatataatataatataatatataatataatataatatataatataatatataacataatatataatataatatataaaataataattaatatttaaattaattattattaattaatattaactaatattaaaaataatataaaatacaattaatatatctaatataacctataattattatatataatataatatacaattatacataatatatataataaaatatatataattatgtgtatttattacatataatataatacataaattatatataattattacatataatataatatatacttatatataattattacatataatataatatataattatatataattattacctataatataatatatataattatataattatatataattatatatacaagataataatacataatatatataatatattatacaatataatatattgtataatatattatataagatattatatataatatgttgtataaaatattatatatattatatataatataatattatgtataatataatatataatatatattatattataacatattatacaataatatattataatataatgtatattataatctaatatattatatattataatctaatattatatattataatctaatataatattatatattataatctaatataatattatattatatataacattatatagtattatatattttataataatataatatataatatattatgatatattatatataatattatataatatattatgacatattatatataatatataaaatgatatattatatatattacataatatattatgatatatattatatattatataatatattatgatatatattatatattatataatatattatgatatatataatataatataatataattatatgtaatataacattatatatcatatattatatattatatatcatatattatatatcatatattatatattatataccatatattatatattatatatcatatattacatataatatatgtcacatattgtatgtaatatatgtcacatattatatgtaatatatatcatatattatatgtaatatatatcatatattatatgtaatatatatcatatattatatgtaatatatatcatatattatatgtaatatatatcatatattatatatgtcttttattatgtaatatgtatcatagatattacataacgtgacatataatatatattatttatatataatgtatattatattttatatatattatatatattatatattatatgttttatgtaatatatagtacatataatatacattatatatatataattttttttagacagattcttgttctgttgcacaggctggaatgcaatggtgccatcttggctcactgcaacctctgcctcacgggtggaagcgattgtcctgcttcagcctcccaggtagctggggctacaccacactgggactacaccagctgccaccatgcctggctaattttttgtatttttagtagagatagggtttcgccacattggccaggatggtcttcatctcctcaccttgtgatcctcttgccttggcctcccaaagtgctgggattacaggcttgagccaagatacatattttttaaatgaagaaaaatttcaaaggtactctgcttggtacaataatcaaatatataaattgaggaataaaacctaaccatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaaaggttcaatctgctctgacctttgaaaaactcagcacagatagtggcacttaggaccaagggcagcagatccctaatcccatcaccatggcgatagggcataaacattccagggtgaaggcacaatccacactgtgaggtccaactgctgccatgcagacaggtgtgctttcacatgtacaggaaggtcatcgaaggctcagtgtttcatttcaaaaactgaatcccaagtccacacattattatgctgtgcttcttaaaataagttatgagataggaaatagggcacccccaaatatatatatatattatgtataatataatatatataatatataacatatatataatttccttttacatcctgcatccttatatataatatcatatttaatataatatataatattatgtataatatatattgttatacataacattatatataatataatatatataattatgtataattatataattatatatgaaatataataatgtataattatatatgtaatataataaagtataatagataatatatattatatattatacaaaatattatataatgtaacatgtaatatatagtatatcataatataatatattttataatataatatattatatattatatatgattacattatattatattatattatatattatataatatatgatatattatggtatattatatattattatatataatacaattatatataatataccataatatatatgatatatgataaataatatattatatatatcataaattatatataatacataatatatatcataaattatatataatatataatatcatataatataattatatataatataatatataatatataatataatataattatatataatataatatatataatataatataatataatataattatatatcatataatataaaatatataatatataatataatataatataattatatataatatatcagatataatatataatatatatcagataaaatatataatatataatatatatcagatataatatataatatatatcatatattttacataatatatatcatttattatgtaatatatatcttttattatatataatatatatcatttattatataatatatgatatatcatatatgatatatatcatctatatcatatattatttatcatctatatcaggtatgatatatcatctatgtcatatatacgatatatcatctatatcatatatgcgatatatcgtatatatcatatatgatataccatgtatatcatatatatgatatatcatgtatatcatatgtagtatataatctatatcatatatattgtatataatctatatcatatatattgtatataatctatatcatatatattgtatataatctatatcatatatattgtatataatctatcatatatgttgtatataatctgtatcatatatattgtatataatctgtatcatatatattgtatttaatctgtatcatatatattgtatataatctctatcatatatattgtatataatctatatcatatagtatataatatatatcatatattgtatataatatatatcatacatattgtatataatatatatcatacttattgtatgtaatatatatcatacatattgtgtataatatatatcatacatattatgtatgatatatatcgtatatattatatatgatatatatcatatgtaatatatacgatatatatcatatatattatatatgatatatatcatattaagttaagtttggggatagcccagaattatatatggattttcaactgcacaggagctggtcccctaacccttgcactgttcaaggatcaacagtatgtataatactacagattttattcatattttagagtgtagtactactactcattaaaaaaaattaactatgaaacagcttcaggaaggtcttccacgagttcttccagaagaaagccttgttatcatagagaatgacagctgcatgtatgttattgccactgaagaccctgaagacctttcacttggacaagatttcgagatggaagacagtgatattgattatcctgacccttacaggactaagctagtgtgtgtgtttgtatcttagtttttaacaaaaatgtttaaaacataaaaaatcaaaataaatgaagcttatcaaataaggatataaagtatttctgtacagctgttcaatgtgtttttgttttaagatgtgttattatcaaagaatcaaaaaattaaaaaaattaaaagtttataaagttatgataagctaagatgaacttgttaaagaaagaaaaaatttaaatacatttagtgtagcctaagtgtacagtgcatataaagtctatagttatgtacagtaatatcctaggccttcgcattcactcaccaggtactcactgactcatcagagcatctgccagtcctgcaacctctgttcatgctaaatgtcctttactggtgtaccactctctttaaattttgtaatatatatatatttttttctttgttttttttgagaaggagttttattttgttgcccaggctggagttcaatgatacgatcttggctcactgcaacctctgcctccggggttcaagtgattctcctgcctcagcctcacgagtagcagggattacagccccacgccagcacgcccagctaattttgtatttttagtacagacggagtttctccatgttggtcaggctggtctcgaacttctaacctcaggtgatccgcccccctcggtctcccaatgtactgtgtttttactgtatcttttccatgtttagatattactactgtgatataactgcctacagcagtgggccccaaagttttgacaccagggactggttttgtgaaagataatttttccacggagtggggatggctttgggctgaaactcttccacctcagatcatcaggcattagttagattctttttttctttttttttcttttttagactgagtctcccactgttgccaggctggagtgcagtggcacaatctcggctcactgcaacctctgcctcccgggttcaagtgattctcctgtctcagtcccccgagtagctgggactacaggcatgcgccaccacacccagctaatttttgtatttttagtagagacggggtttccatgttggccaggattgtcttgaccttgtgatccacctgcctcgacctcccagagtgttgggattacaggcgtgagccacagcacccagcctagttagattctcataaggagaacataacctagatcccttctatgggcagttcacaatagggtttgtgctcctgtgaaggtctaatgctgctgctgatctgacaggaggcggagctcaggcagtaatgttcggctggccagccactcatctcctgctttgtgcccagttcctaacaggacacgaaccggtgctggtccatggcttgggtgttggggaccattggcctactgtattcagcacagtgacatgctgcacaggtgtgtagcccaggagcaataggctgtacgatatagcctaggtatgtagtaggctacgctgtctaggtttgtataaagtacactctttggtgtctgcacagccacagaatcacctaatgatgcatttcttggaatatattaccattaaatgagatttacctgtattagtgtcatctcaggtttattgtctagtaattttaaaagtatttgtatattctttcccagacacatcatcatactctggtgcatatctctattttattccctagacccactcttaatttttctgcattctgctttgttccttaggaggctcacctgaattggatacttcagagatctcccttaccctcatgcttttattggggttcagctaatggagggggtggcagaagataggtgagagaagagtgtgtttatcccccacctctgcccctgcagggtcagcacaggcagactgtgtccctttgctgaagatcacagcttctgtctggtgccttcttggcaagctggcactgtctctagtcaggtgactgcttggccccttactacttacactcttctgtctggtttctttgtgactttcctgctgtgctgtaagtagtccctttattagaatccatccacattacccagttatataaagacaaatagttggtcactgatgtagttcactccctgagaatcagccttcatcaaagatccctaacagtcacatattctgttggccgctccattcctgctccccattattctagttgtgtcttccttgtctctagtgcagtcacaaagcataagcgcctccactgtcacttgttctttgcaactctaggatcacatcattccccttgaaatcagagaatctgcaatctccccaagcccacaaaattcagccatcacagtacttttcaagcatgccagcagccctccccaacaaacgaatccttaatttcttagagaaacatcttctgggcttcctgtgggacacagtgcgggtcggcttggcatgtggatcacacctgatatttttacccccacctcctactattcctattcctttgtatgcacctctctttattatgctaggaaagctctggcaacacaacctcaaaataagcaggccagtgtggattcacagtttctgtcagacaaacaaacttgagcaccccttctaacttcttgggctaagactttaacttcagaatctctatgtatctatgttgataaacttagcctatgtcaagattatattctgcatgccttagtcaaacaccatgtaaatctatacctcatatattctctaggctttagctgatagggattagcaaagtagtgtggttgttttggtctttaaacaatgtccattttctaccagctttccattgcactctttttttttttttttttttttttgagatggagtcttgctctgtcgcccaggctggagtgcagtggcgcgatctcggctcactgcaagctctgcctcccgggttcacgccattctcctgcctcagcctcccgagtagctgggactacaggcgtgtgccgccacacatggctaattttttgtatttttagtagagatggggtctcactgtgttagccaagatggtctcgatctcctgacctcgtgatcggcccaccttggcctcccaaagtattgggattacaggcgtgagccaccacaccgggccgaatccattgcactcttacagaccatgttgacaaaattataactgcaacagtcaactacaatagcaattttacctctcatgtaccactttaaaaaacacatcattcccaataaccacatttgatgatttaagtaatcatgataccaccgtacactacagatgatcaggtttctgtctcctcccgacaacaaggtcaggaattcattcagactgaaacaggtcagcaaaccacttccagattctcatctataaagatctatttctagaaccatttctagtacctatacaatattagaatcaagtcaggaagcagaaaacattctagatattttaaacagaaaacaattcatggagagatcaattacaagagtatgtgtagcaaaagatgaaagggtcaggttgtttaagtaacttgataaatctctgcttcttttgtgttgggtgataaaaatgttgaccagagatcagtggcagatgatccaaggcgtcagctgtccaagctcagcatctggagccggtgctgaggaaatgtgcatttctaggtctgggcgccattggaccatcactactgtccttgaagctgccaccgtgagaactcacatctcagctgctatagccacagctgatattgtcattgcttccagaattatttcccttgctccatcgtggggatcccgcaatactgctgctgctgaaatcactgttgttgctccttccagaactgtcggcaccgcagcattattatcactgcagctaccactggagatggctacagacaccagaaacggaagagcacctctcccctcctccggcagtgtgactttcagtcggctcctctcgtagccagatggtatagaaatgacacaccaatgtccttcagaacatacatgcaaaatagtttaaatatactagaaattctattccccttagaaaactaagtccacctacatatttttcaaaaatccatcagcaatacagaataaaggcattggttctatacagcgttgcaagaatattttaacaatagaaggtattttaatgtcattcaccacattaggagattgaaaaagggaaaacacaggattaccttagcagatgtaggaaaaaaaataagatggtaaaatacaacattcatttatattaaaatctttataccaaactaggaaaagcagacaaatttcttaacctgataagcttatctataacaaaaccatcgacaccaccatatgtaatgttgaagcataatcgttattttttataaaagctaggaaagggaatgagatgtctgttgacactgctcgtatttatcattgtcctggggtttctggccagttcagttaagataggacaaagaaatattatagaaagaggaagaaaaaaagaaaacacatacgttgtcattgtgtggagtttctgtttgtttgtttatgtgtttttgtgagatggtgtctcactctgtcgcccaggctggagtacagtggtgtgatcttggctcactgcaacctcattgtgtggagatttgtaattacccatagaaaatccaagaaaatttgtggatgcactaatcaaatcagcaaggttttcagatatgaaggcaaagtaaagagaaaatgaaattcttataaacagtagcaaccaattaaaaatattatattataatatcacattcatggtaacataaaacattaacgtatctaagaattaattcagaaaacacatgatctttcatttaattttattaaagttatttcaataaatataccaccagtatttttttagaacttgattggaaaagtcatattaaaataatcaatggaaaggaagaaccaaagttattctgaacaataatagcctatcaatatttaaatgtgttttaattataataattaaaatggtttgctttggctcagtgatacaccgttaaacaatgggaaaaaatggaagcaccaagaaatagatccatagatatgctgaatacattggacttgtaataaaagatatgatactaaaagtcagtagaaaaattatactattcaataaatgatgtcagaaaaaacatataaatttttatccatatataaataaaaatctgtatattacagcatatcacaaaatcctgtatctatttaggttaaagactcaaatcttaaactacttgtgaaattacttatgaatattacatgtttaagatatttaaaagtatatacagagaactaatgacgttgggcaacaaatggcttattaatcaaatgccagaatgcatgaagaagaaaagaaaagaaaaataaattagactgtattaaaatgaaaaatcctaggcatcctaaataaaggttaaatgcaagccagaaaattgggtaaaatatttacaaaatatataattgaaaagtataatatccattatataaagaggatttctacaaattcatgatataaaataaataatatagtagaaaaaatgattaagaactactacacaatattcacaacagatgataaatagtgaattattgtgaaaagacaattgaaaagagcaaggtacaattcaacagcaataagactttatgcccttttctataaaaacacaaaactatgccaagggctttaggaaccgtgaatttatacacggcgaaggggagtttaaatctgccactttgaagagttttttggaaatatatagtaaagttgaaaatatatacatatgtgtatatatatatacccacacacatacacatacacactagaaattccacagggtaaaccttctccaagagaatacacacacatttgcagaagagatgtccaaaggtgtttgttgaaacattattggtaatagctaaaaattggaaataatcttaaagctcattactaggaaaatggaaaagtgaatcgtggtatgtgcatataatgtaaaactatacatcagttaaaattaattgtctgaatttatatggatcaatttttatatattgaaacatcgttgcattccaggaataaatcccacttggtcatggtgtataatccttttaatatgatgctgaattcagtatgatagtttttttttagacaaagttttgctcttgttgcctaggctgaagtacaatggcatgatctcggctcaccacaacctccacctcccgggttgaagcgattctcttgtctcagcctcccgagtagctgaggttacaggcatgcaccaccacacatggctaattttgtatttttagtagagacaagagtttctctatgttggtcaggctggtcttgaactcctgacctcaggtgatccacccacctcagcctcccaaagtgctgggattacaggcatgagccaccgtgccccacccagtatactagcatttttagagtttttgcatcaatgatcagaggcatattgatctgttgttttattttcttacagtgtttttggctttggtatcagggtaatgctggcctcatagaaagagttaagaggtattcactcctcttccactctttggaaatgcttgaaaagaatcagtgttagttcttctttaaacgtttggcagaactcaccagtaaagctatcaggtccaggacttttctttgtcatgagattgtcttattactgactcaattcccttactaggttaggtctattctgactttctgtttctttataattgagtcttggtaggttttgtgtgtctaggaattcatctatttcatctgggttatccaatttatgagcacacaattatttatagtaatcttttataatcctttctaggctgggaatggtgggtcatgcctgtaatccaacaatttgggaggccgaggtgggaaaattccttgaggccaggagttcaagatcagcctggataacatggcaagatcctgtctcttaaaaaaaaaaaaaaaaaaaagagctggcatagtggcgagcccaggaattcaaggctgcagtgagccgattgtgccactgattctggttgcatctgattgttgccagggcaatagagctagaccttgtctctaaaacatagacaggcagacagacagacagacagacagaaatatataaagatattctcaaatacatttctgttttaagtaatttagattgtttcccttttccttagtcttgtcagttttattaatctttttgaagaaccaacttttggttttgttttttattgtttttctattctcttttccatttatctctgccctgatctctattgtttccttccttctgctaactttgggtttagttttattcttctttttctagtttcttaatgtgtaaacttatgttgttgaattgaggtgtttctttttttaatgtgtttatagctataaatttcctccttagcactcctttcaccacaactcataagttgtgtttttttgttgtttctttgttttttgagacagagtctcattctgtcacccaggctggagtgcagtggtgttagctcagtggtgcaacctctgcctcctgggttcaagaaattttcatgcctcagcctcctgggtagctgggactacaggcacgtaccaccactcccagctaatttttgtgtttttagtagagacagggtttcaccatgttggcctggctgaaattgaactcctgacctctagctatccacctccctcagtctcccaaagtgctgggattacaggtgtgagccaccacaactggccacagcccataagtttggatatagtgtgctttcattttcatttgtctttaagaattttataatttctttgtgatttctttgatccattggttgtttgagagtgtgttgtttaaattctactaatttgtgaacttttttaaatcttctgttattgatttctaactttatcctgttgtggtcagagaagacactttgtatgatgtctatcgttttaaatctactgagcttttttccttttttgggacagggtctcgttctgtcagtggtacaatggtacattttctttgtcatgaagtacaggctggagtacagtggtacaatctctgctcactgcagcttcaacctcctgggctcctaagcaattctcacgcttcagcctcccaagaagctgggatcacaggcacgcaccaccacgcccagctaatttttgtatttttagtagagatggggtttcaccatgttggccaggctgatgtcaagctcctggcttcaagcaatccacccgcctcagcctcccaaattactctgggattacagatgtgagccactgcacccagcccctattgagaattaatttgtgatgtgttatatggtctatcctgaaaatgtcccatgtatacttgagaagtatgtgtattatgttgttgggtagaatatcctgtgtatgtctgttaggtctagttgttttttcaggtgttgttcaagtgctgtatttccttacttatgtctggtctggttgttttattcatttgtgaaatgaagacaagggacaaaatcctaagacatcccccttaaaagggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcagccattcatggacaaaactgcctttgcaagagttttaatatccaggcaggaggtggcaaaactctagcaaagcccaaaaccaaggagagctgctttgagaaggcaggtccacacaccagtgacaggttaccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcatgcctgcccaggaattcagtgatgcctttacatacccttggtaacaggcctgctgatctcagtctcagctatggacactaaagtagccctgtgactccattccagtcttgctttgccacagtctgggcacagtccagcccatcctgggacctggtgaaagacataccatccattctcctaataagaggaccaccaatcttgaactcaaatgtggtcaccaaagctgtcctgtgacttggctctagccctgctctactgtggtctggaggcagtcctgtcttcccatggacctacctagtaaaccagcaggagctcaatctgggacccacagggagctataccagtccatgcccttggtaataggcctgatatctgaagacttgactgtagaactagaagtggccccatgacctggctccagtcctgttcaatcagggtatcagaggcagtccagttctcctgaggatccagcagaaactgcatcaccaacctatgccttgatagcggcctgccaatcagagattcagctgcagaccaggcagcagccatgtaatatggctccaggcccacttgactgtgatccagtcaagggatccagcaggaaaaggtttgtacctgctgaaaccaatctataaagacagaaagagattgggcatggtggctcacacctgtaatcccagcactttgggaggccaaggcgggcagaccacttgaggccaggagtttgagaccagcctggacaacacggtgaaactctgtctctacaaaaaatacaaaaaaattagccaggcgtggtggcacatgcctgtgatcccagctgcttgggaggctgaggcaggagaatcatttgaacctgggaggtggaggttacagtgagctgagatcacaccactgcactccagctgggtgacagagcaagactctgtctcaaaaaaaaaaaaaaaaaaaaaaaaaaagaagaggtatttgcttcttcatagacattaatgaaagtctgtagatcatgaagaatcagcaaatatgacactaccaaaataaactcataaatctccagtaatcaaccccccaaaaatagagatctacaaattgcctgacaattcaaaataattaagatagctcagtgaaatttactagaatgtatatatcaactcaataatatcaagaaaatagtagatgagcaaagctaaaagttcaataaagatacagaaataataagaaccaaacagaaattctagaactgaagaatacaatgaataaaatgaaaatgcaagctgggtgccgtggcggacgcctgtaatcccagcactttgggaggccgaggcaggcggatcacttgaggtcaagagttcaagaccagcctggccaacatgccaaaaccccatctgtattaaaaatacaaaaattagccaggcatggtggcatatgcctgtaatcctagctactagggaggctgaggcaggagaatcgcttgaaccgggaggtggaagttggagtaagccaagatggcaccactgcattcaagcctgggtgacacagactctgtctcaaaaatatataaaaataaataaatgaatgaaatgaaaatgcaatagagaatttcaattgcagacttgatcaaacagaagaaagaatctgtgaaattaaagacaggacatttgaaatatcccgtcagaagaccagaaagaaaaaaaagtttataagtaaaaacctttgggatttataggacaccaccatgaagtgggtcaaacatattatggacttcctagaagtaaaaaagatagaaaaggcctgaaagtatatttgaagacataatgggtaaaaactttccaaattcttagaggcaagtgggcttccagacacatgaagttcagaggccccaaaaaaggccagcccaaagaccataataccaagatgtattataattaaaatatcaaaagtcaaagacagagactttcaaaagcagcaagaagaaaggaattcatcacatacaaggaaacttcaataaggctatcagtggatttctcagcagaaaccttataagccaggagagaataggatgctatattcaatgtattggaagaaaaaaactgccaatcaggaagaccacaacttgtaaagctgtccttcagaaatgaaaaagagatgataaggtctttcccagactcccaccaaaaaaattctaagggagttcatcaccactgcacctgccttataaggcagtttttcaagttgaaataaaaggattctgattagcaacattaaaacattaagatattaagttcacaggtaggccgggcgcagtggctcacgcctgtaatcccagcactttgggaggccaaggcgggtggatcacaaggtcagaagagggggatcatgctggctaacacggtgaaaccccgtctctactaaaaatacaaaaaattagccaggcgtggtggcgggtgcctgtagtcccagctactcgggaggcggaggcaggagaatgacttgaacccgggaggcagagcttgcagtgagccgagatcatggacactgccctccagcctgggcgacagagcgagactctgtctcaaaaaaaaaagttcacagggaaaggtaagtatatagtcacattcataacactgtaatattgcagtggtggtgtgtaaatcacttttcactgtagtataaaagttaaaatgtaaaagtattaggcggcccgggagcggggcagctgctgcggggaggcggggaggcggggggcctggccggacacccctgcgccccctccccgcacccgggcggagggcggcctcttccccctccccctcccccaccacccccggcagccgcctcccccaggacgcaggaggcgggcggaggccgggtccgcgcagcgggcgacttgcggcatgggccgggtcgaggtgggggggcggtttcgggggctgggaagctggggtgccggggacaggagggtgggggagctggggaaaggagggctggggggccggggacaggagggccatgcaggcagtggcaagcgggcggcgagggctccgtggggcaggtggacggggatcagcgcctggggctgctccgttccccaggcgggtgtcgtggctctggcctccatgcaactccaggtctgcgcgccccgcgctgctggagccccagtcaaaagtctatttaaaaagcagagagaggatgcttccctctgagtggagcgatgaagacctgatccctgggccatttgggaacactagctgcctttcatcacagtcaacctggactcagagaatgtcaagagcttgttggttgggtcaagaatgaatctaggcatgacgtcatagtttatagtcatccttttaaacctgcaaagaagcatttgcaggtttaaagttatttcacgggtactgcttgccaatctttggaggatgtgaagcctgcagagaaataaagtgtcgcccctctgcgcgtcgctccccatctgccagaatgtttctcatgaatgctcctccagtggttgctctccagcccaaatgggaggcctctgtcccgccagggagctttaggttccccgggtgcttctcggaggctgacaagggcgtggagagcatgtcggtgagcacccgggtgcagatgctcatcagcacgctgcagagcgacagggctgctaggggcaccagcgatgagcgcactgcgcagagggggcagagggatgccacgacgccaggcctgctgccaagcccaccatgcacaaggagctgcctgcgttggctgcctgtggtcttgttgctgactttgaccccgtgggggaggaggaaactgcagactttggcccattggtgctagattcagacagtgacgattccgtggaccgggacattgaggaggccatccaggagtacctgaaggtaaagagtggagcggcacagcccggggccagcggggcccagccatgcacagccttccagggctgcgggcggaggcagtagatgtaagcgggaactggctcacagcagtgcccaactgccctgtgttccccaaaacttgtacctggctcaggtggtgtggccctggcagccaggtgggatccagcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggagcgccagcaccgcaaggaggggaaagcgagtcacgagcgccgtacaggctcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggggatctggacgctgaccattcccccaagatcccaaaggaaaccaaagctccacctccaacgagcccggcttccaggagcaagtttgtggaatggtcctcttgccaggcagacacctccgctgagctgatgtgtgtagaagcagtcctggacattttcaagacgatcctgccggccctatggagggcagcgatgggtccctgtccgcaagcccactcttctactcccccaacgtgccttcccgctctgatggtgacagtagctccgtggacagcgacgacagcattgagcaggaaatctggacgtttttggccctcaaggtgcagtctagaagtttgctggccagaggtgagagctgccctcaggctgcccagggcccactttcaccacctggcctcagcagccagaccggcagccccaaggcccctctctctaaaacactggacccactcctggctgcaaaaggaagcatagaggcggctgccaagtgaggccatccactcccaagaacatgcgggtggtggggaaagagggtggccaggatgccgaccgcagccaggggagagccgggcccggccatgaggggcgggacctttccatccagggcacagccagcgaggccccgggatgggagggcgccgctagggtgggacctttccatccagggcacagccagcgaggccccgggaggagagggcgccgctagggtgcccggtgacactcgcacgtcacagggccagggtaagacagacgaggcaaggcacctagacaagaagaagagctccgaagacaaaagcagttccctggacagtgacaaggacctggacacagccatcaaggacttgttaaggtccaagtgaaagctcaagaagaggtccagggagcccagggctgtgtgcaggaagaaggtcaggttcagcacctcccagacgcacttccaggagcggctgggcaggctcctgagagagtggaaaaacaggcacctgcaggtgctgaagagctgcctaagtccaagagagacagctgcgagggctccaggaagaaaccccccagtgtctttggcagcagggccgagaggacgaagccccggccttcctggtgaggagacccgcttctgcctccgcctccgaagagaatctattccccagagagtcccagggcccagctcccagccctggctccttgtctgacaacagcagttcagtggacagcgacgatagcatcgaactggagattaggaagtttttggtggaaaaggccaaggagtcggtgagcagttcagaagttcaggcagagggccccaccgctctcgggacagggggcccagccaggccagaggtaccttgcaggaaggagccggccccactgcctggcatgtgcacacggagccagagggccggggggtcccacatttggctaaagggcatcgaggcgcagggagcgcaggagcacagggcgcagcgtgcctgctcagccagggtgggaaggggctccccactgatccggcggaggggatcatgcgccacccaggaggaccagcggcagtgtctccgccaaggtctctcagtgagcaagagaagtgtttacgtttacaaagaccagagcccacgaggggctgagcctgctgccaaaagtgcttttggtcagcggcccagctgtgccacagcgggcaccgaggcaggaggagccagggggacctttcacgtggactgcaggaaccggagcttcctgacccccagcccgggagctgagagggatgctggagcccaggccaaccgcgccccgccctggagtgactttgcccaccacagtcggctgcccagcccatgggcactgcgctccaaaggtagagatgcggcgtggagggggcggcattgggagagagagacaaggggtccgagggccccgcccggggcctgcccagcctgccccttgcgggcttctccccgctgctgtccacccagctcttccactttggaaagggtgtctcctgggggggcagggagaccggcctcttcagcccctacctggggctgcctctgcagggcctgtccttctcggccttcagggagtcccaggccaggcccagccttgtctttggaagcccacacttgctggcgaagaaggactgcgatcaccggccaagcaggaaggtacagacggggctgagtttgcacaacaggaagagctctggctcggaggaaaggattttagacctgaggtatccacgaagggtcaatcagtagagttgaccaggaccaggacaccttgggcagggacaccagtgatttcagcaacacctccgcagaggtgttgctgctgcagtggcggcagctcagtagtgaaggtataagacctcgagctgtgggttcgcgtcctgggttccatgcattcgtggaaagcggcatagctgacgtgtatctgtgcctgtgtgtgatggttctgtggttgcagggaggggaaacagtctgttatacatagtcttgtatatatgtataccaacacgaaacaatgcttttatttaacagatgtgtcctggtaaatatgatttttgtagattttgtacattatttaaagtgatgaaaaatgtttttggaaaatactgttggtcaattttgtagggtgttccttaactgcagttttctgtgttctgcatacaagtcttagattagaaaacatttggtttttatcatcacaaccaggtttacagggactctgatgttttttggttggttgctggtgagaatggccagcgctggctgcaggggtagccttaggaaggccgaggtgccctccccaggaatcgctcacatgccccaaagtgtccgtcaggaagttcctgggacagcactttttatacagaggacacccccccaccaccgcctggcttcatggtccttggaggccagagcacatctgaaaactacaggaacggaaaaccaaactccgcatgttctcactcataagtgggagttgaacaatgagaacacttggacacagggcagggaatatcacacactgaggcctgttgggggatgggggcaaggggagagatagtattaggagaagtacctaatgtaaatgatgggttgatgggtgcagcaaaccaccatggcacatgtatacctaagtaataaacctgcactttctgcacggctaccccagaacttaaagtataattaaaaaaaaaaaaaaaacaggaaaaaataagtagagattaaaccagtaatgaaaaatctcccaacaaagaaaatcccaggaccaaatggttttactggtcaatttcaacaaacatttaaagaattaataacaatccttctcaaactcttccaaaaaaattgaagaaaagggaacacgttgaaactcattctaagaggccagcattatcctgatatcaatgccagataagaacactacaaaataagaaaactataggtcaatatccctggttaacatagatgcaaaaatcctcaatgaaatactagtaaaccaaattcaacagtgcattaaaagaattattcaccatgaatccagtctctaccaaaaatccaaaaaaaaaaaaaattagctgagcatgctggcgggtgcctgtggtcccagctactagggaggctgaggcaggagaatggcgtgaacttgggaggcggagcttgtagtgagccgagatcgcgccactgcactcaggcctggatgacagagcgagactccatctcaaaaaaataaataaataataaataaataaaaaacaaaaaaagaattattcaccaggatcaagtgggatttatctctggcatgcaaggatgctttaacatacaagagtcactaaatgtgatacaccacatcaacacaataaacgataaaaatcctttatttttattattaaaaagcacttgataaaattcaacatcctttcatgattaaaaaaaacaacaaactgagcaaattaggtgcagaaggaatgtacctcaacataatgaagaccacatgtaacatactcaacagtgaaagactgaacgtttttcctcgaagatgaagaacaagacaagaattcctactctcaccatttctcctcaaaataggactggaagtcctagccagaacaattaagcaagtaaagaaataagaatggaagtaaaatggtctccatagatgacatatttttatgtatagaaaactgtaaagacttcactaaaagactgttagaagtaataaattcaataaagtagcaagatacagagtcaacatccaaaaatcagttgcatttctatgcatagatggactggagggcattatgttaagtaaaataagccagacacagaaagtgaaatgttgtacaatctcacttatgtgtggaacctaaagacgtcaaactcagaagaagagaacagaatggtggttgctgggagctggggaagagaaggaaatgggaagttgatggttaaagtgtacaaatttcagttatgcaagataagtaagttctggagagctatacagcatagtacccacagaaaatgttactatattcttaaattgtttaattaaaaacttttattattattatttttttttagacagattttcactcttgttgctaaggctggagtgcaatggtgctgtctcggctcactgcaacctccacctcccaggttcaagagattctcccacctcagcctcccagtactttgctcagattataggtacccgccaccacgcccagctaatttttgtatttatagtagagatggggttttgccatcttagccaggctgctctccaactcctgatctcaggtgatccgcctgcctcagcctcccaaagtgctgggattacaggcgtgagccaccgcacctggccattaaaaacattttttttatacaataataataataaagaggcagaaggaaattttaaaaggtgatggatatgtttataggcttgatgataatggttttatggtgtaaatttatcaagatgtgtacgttaaatatgtacagtttttatgtaaatcattcctcaacaaaatggtttaaaaagtaataaagtaattactgataaggggggacttacttctggcattttgctatacattttctatatgccttacagcatttttgtccatttcctgcatgatctcatttgtatttagttgattttttgtagcgaagtgttttaattcccttctcatttacttttttatgttatataatgttttatttgtggttaccatagggattacacttaacattctaaagttatagcactctaacttgaattcataccagctatatttcaataatatgcaaaaattctcctcacagttttgccactcctctttcagttatcaatgtcacaaaattacatttttgtacattgtgtgtccataaacataaactaataattgtttttaatgcatttgtctattaaattatgtagaaagcaaaacatggagttttaaaccaaagttacgataatactagatttaatattttcccatatatttacttttactggcatctttatttcttcatatggctttgagttactatctagtgttctttcttttcaacctgcatgattctctttaagatttcttgcagggcaggtctaatggtagcaaacttctcaactttggtttatttggggatttcccaatttcttcctcacttttgaaggacagttttgctggatataggattcttggttgagaggtagtggttgtttttcttttagccctttacatatgtcatcccattgtcttctgttctccaaagtgtctgatgagaaatctacttataatcctattatatattcctagcatgtgactagttgcttctctcttggtgctttcaagaggccctactggctaattataatgtctcagtatgagtcttttttttttcatcctacttggagtccattgagttttctggatatttattttcatgtctttcatcaaatttgggaagtgttcagctttttttttttcttttttgagacagagtctcgctctgttgcccaggctagagtacagtggtgtgatcttggctcactgcaacctctgcctcctggattcaagcgattcttctgcctcagcctcctgagtagctgggactacaggtacgtgccaccacgcccagctaatttttttttttttaaacggagtttcactcttgttgcccaggctggagggcaatggcacaatctcggctcactgcaacatctgcctcctgggttcaagcgattctcttgcctcatcctcccaagtagctgggattacaggcatgcaccaccacacctggctaattttgtgtttttagtagagacggggtttcaccatattggccaggctggtctcgaactcctaaccttgtgatccacccaccttggcctcccaaagtgctgggattacaggtgtgagtcaccgtgttcagcctcagccattatttcttcaaatgatctctctgcccctttccctctcttcttttgggacttccacaatgtctgcttgctattcaacaatcgtctttatttctgttcctctgacttgatcatttcaagtgtcccatcttcaaattcactgaatctttcttctgttgctcaaatctgcttttgaatccctctggtgaacttttatttcaatcactacacttttagttccagaatttatttattttttttctttttaggttttctatctctttattgatattcccattttgtttacacataattttactgactttctccacatcttccttcagttctttgaccatctttaagaaagttgttttaaagtatttgtgtagtaggttaccatctggtctttctctggaacagtttctgttgttgtttttcctttgaaataccatattttcttgttttttgtatgccttgtgttttgtattgaaaactggacacttgaatataataatgcagtaactctggagatgagactctcctcttcctcagggtttgctgttttagggttttgttatgttttacattgttgtaggttgtctccatgctgaggatcaacctgagttgtaagcttgaggtcttctcaggtctgaagctgctcctttccctgggcacacactcctctctccaaggatgtgtggtaactttaatttcctctgggtatgccattgcttttgagtgtcctagtctttaatgtttggctcccaaaaaaggaaaagagaacaatgaaggggaagggaaatggggttctggccttttctatctcctagaagttgcttcagtctggtaagggcttgcagcagtggagtggggagttgtgagcaataatggctgccggcctctgtgtttgcccttccataatcaaaagtagcaatcaacaaccagaacgcagatgctaacacttggaggacagagtgcttattgcccatgattgttcccacaagcttggtacaagctgcttcaggaacacatgcaaagcttcttgccgtgaagctggggcatggggattgggtagccactgctgagctaagagctgaaattgaccaaaattaagtaaaaattatagtttaagccttcatttggaggttacaagcctcctttgatagagtctagagttccaaaatagttatatcaggcagattctgccagtgtgattattttctaggtggggagatgaattcccagtgcttcctactccactttcttcccagaaccctctcttgtaatagttttttacttaaaatctattttgtctatacttttttttccatatatttactttttattgaatttgttaacgttacagagttcttgcactgccaaaccatgcctgagaattcaaacaaatggtacaatggacagcctcatccacccatcatacagtatattaaaacttgattcatctatattttgatattttcacaatcttttaaaaagttataataagagctggaatttaaatctgctgcaggtcttcagattttgagtacagtatgcctttacataacacctccacttactcatctctgttcattcttcagtaacataaaccccaacaacttgtacagccataacttgtacagccattcctgatctgttttggttactttttgcacggaatattctccattctctcatttttcaacccatttgtattggatttcaaatgagtctcttgtagacagcatatatagttgaatcccgtttttttaaatccaatcagccaatttatgtctttttattgggagtttaacctatgcacatttaatgaaattattgattaggaaggacttactaccaccattttggtcattgttttctgtatgtttagagcctttttgtccttctttcctcccttattgtcttcctttgtgttatagttgattttttgtagtgctatgctctgatttccttctcatttccttttgcatatattctgtaggtattttctttgtggttactatgggaattacatggaacatcttaaagttatcttattattttaaacagataacttcaatcacatacaaaacctctactctttacatctttgccccactattaagttactgatgtcacaaattaaactttatatactttgtatccattaacatagatttataattattatgcttttgtcctttaaattccattaaagtattaaaaattgagttattagcaaaaattacaataatacaggttttaatctttatgtatttacctttatattttcatcaggctgagcaactgtctagtatcccttcatatcaacttgaaggactccctttattgtttcttttttttttttttgagatgaagtctcgctccgttgcccagactggagtgcagtggtgtgatctcagctcactgcaacctctacctcccgggtacaagtgattctcctgcctcagcctcctgagtagctaggattacaggtgcgtgccaccacacccagctaatttttgtatttttattagagatggggtttcgccatgttggtcaagctggtcttgaacacctgacctcaggtgatccacctgcctcggctcccgaaagtgctgggattacagacatgagccactgtgcccggcccctttattatttcttattggtcaggtctagtggtaataaactccttcagcttttatttatctgggaatgtcttaatttctccttcacttttgaaggacagttttgtcaaatatagtattctcagttggcaggctttactctttcagtactttcaatgtatcatcccaccaccttctggcctgcagggtttctgctgaaatatccactgataatcttctagaggctcccttgcacatgagaagtcacttttctcttgctgcttttaaggttctctctatacttactaccactaaattctacacttaaaaatggtataatctgttatgtatattttgccacaataaaaacatcggaaagaggtaccatagaagagtatattacatgcaccataggctggaaaacattttcagagattaggctattctcagtaactcacatatctagttctggtaaacactgattgatttaaacaaatatcaatgaacaaagtattacatgcaccgcgtgcagctaaacagtgtttcgctgacataacactagtacctagatctgataaactatctaaacaggcatcactgaaactatactacagaaaacacagaatgctaaccacagtatttccaagagtctacgctacacctaggcaatcttgcacctatctctgttaaacacagggtttgaacttggaacaacaaagaatgtagtacctgcaccacacacttcttaaaacagggttttggccgggtgtggtggctcacgcctgtaattccagcactttgggaggctgaggcaggaggatcacctgaggtcaggagctcgagaccagcctggccaacatggtgaaaccccgtctctactaaaaatacaaaaattagctgggtgtggtggcagacgcccgtaatcccagctactcaggaggctgaggcaggagaatcgcttgaacctgggaggcagaggttgcagtgatccgagaccacaccattgcactccagcctgggttgcaagagcaaaactccatctcaaaataaataaataaataaataaacagggtttcatagggaaaacactatgctaagtcattcacaaacctatttctaataaacacagatagtgaacatgcattaaagaaggctatcttagatgagccacaccctgctaaacacatcgattctcaaagataatgcaaggctcattcactcatggtagacctaactgttaaacttaacatttaaatatgtatcacagaagatggtagtacctgaacctcatgcttctaaatggaatgcttcaccaaggcagcattattctcaatcactcatgcatctgcctcacttcagtacggagcaaatatgtatcagtgagcaatgtgccacgtgcgctatacacggccaaacacagtggctcatacagttaacacaaggtgtggtcaatcactgacagaatgggaatgaggaatgtgtcccactctctcagctgttgtattatatcatacaaggtgcagtgactaagttcattcatgaacccagctctcttaaacacagaaattaaacacatatatgggatacagcacacagtgtgatttgtgtctgcatctccctcgtgcatgttgtatatttcatataatgtaggtacaaaatgtaactttggtcttcacccgcatcagctatcatctatcacaggttacatagcgacataatacaactcagttctgcatccccctctgctatcatatggtatcatgtgtgacaatgtgacccgaggtgagtaatgactatcccctctcacctgctgtatggtgtcataagtgacatttgtgactcacatacactgtgaatcaggcctgcaacccttctgtcagttgttgcatgatactgtatgtgccatagtgacataatgcaactgaggtctgggctccttgatgtcatataatatcataagtgacatggtgtgaacaaggctgcctccccctcttgggttatcattggctatcatataggacatagtgatacaaagtgacaagtgtgtgtccccctcaagtgttatatatcacatgtgacatggagtaaggtgagcctgagtccttctcttggttgtcctagattattttattttatttttttgagatacagtctcactctgtccccaaggctggagtgcagtggtgcaatctcagctcactgcaacctctgcctcctgggttcaagcaattctcctgcctcaggtgcctgagcagtggggaccacaggcgtgcaccacctcacccagctaattttgtatttttagttacacagtaacaaatgtgactgaggtctacctgcgctctcagctgatgctggcacctttattgcctaggtgtttaatgcttctcaggtctgcatcctatctcccgtcacacactctcatatgctatgtaggatgaggacacagctgacacacttagtcactgcaccttgtatgatataatacaacagctgagagagtgggacacattcttcattcccattctgtcagtgtaacatagcatatagcagctgagaacggggtacatccctgactcacatgatgtcacaatgtcacatatgatatcataagtcatccagtgggctaggcacggtggctgacacctataatccccacactttcagcctgccaaagtgcctttttttgtgcctttcacataaagactatgacacagctaagctattcatgtactaataaatacctgccctgagctgtgtgaccacggacaccaccctataatgtggccagtgtgtaggaactctgcaggctcagatcattccagacatacatgcagatgttggaactcccttgcacagtgactcatgatcccaaggctgagtgctgagggcaggtcagtagttcagagcctcagcattggggccgtatgcttgggttcccatcttggctcccacactttgggagcccgaggtgggtagatcgcttgagctcaggcattcgagaccagcctgggcaacatggtgaaaccctgtttctactaaaaatacaaaaatttgccaggcgtggtggtgtgtgtctgcattcccagctactcaggaggctgaggtgggaggatggcttgagctgaggaagcagaggctgcagtgaactgccctgctgagagtggagctcctgctcagctcctaggaaggcaagagccagcaaggccactgcccaggcccccgagggttccagggggtcccatccctgggaaggtggaatctgggaggtgagggggacctaggaccccattgtgtgcacagcttgggctaaggcatgagataagaccagggtgacagtacaggagtatccaagaactgacttcacctaacttctgcatttgacttcccatccccaatgtgggtagggccctgccctctggcgattggaaagaggcgcagggtgcaaagaagtcccctcctctgacctcctgcagggctccgtcttggcctggatccgcaggggggcctgggcaggagggaggctatggtcttgggatggggtggcagttccaggcccacagcggggcaagagacatcctacaccttcctcccatccttgccccgaaagtcatgggcgctggggttcaaggtgccctcactatttgacctttcttgctggtggctttggtgtgtcattctggtccccagcctctgtttcctggactgtaagtggggataataataggtcacccctcccctgcaggattaacctcagcgattgttgctggcatcagtgcagccctgggaccagagcacacctgggtgagtttggagcgctcccgctcttcctggtggccctgcctgggcaccgacccctcccatcctctcctcaatagccacgcccctagcccagctagctaatgaataaatatgtagtagccaggccagcatcttggctccgcggtctagccactttctagtccttcctagctgcggctgccactgagccacgcacgcccctggcatcatgctcgccttgcggtgcagctggtgtggtgcagactctgagagtgagcaccaggactcttcccgtctggtctccaatctaccctcttgccatgctccaccaccccttaggtcttgccactgggagtggggagggactggggagagaaaatactggggtaggggtgacatgagagaaggttcttcactggcctcccctggcctaagcccctggcctacttcattcttggaccccagttgatgggatggggcttggagaggacccagatgactggtctctcagctcagcctcctgcccactgtctctataggtgcctggtgctacgactcccaggaccccaagtgtggtgaggacagagtgtcatgtgaggctgagtgacatcagtctgtgtcctgggaccaccagacaccataatacatattatgtaatatgtatgatacatattacagaataaatgacatatataatatatgatatatattatatataatatatgacatatattacatatatgtgacatatattacatataatatgtgacatacattatatgtaatgtatgatataatatatagtatatgatataaaatatataatatgtgatatataagatatataatattatattacatataattatattatattatatataatatatatcataatatattatataatatataatatatatcacaatatattatatattatatataatatattcataatatattatatattatatataatatgtcataatatattatatattatatataatatataatattatatattatattattattataaaatatataatactatataatgttatatataatataatatataataatatataatatattagattataatatatattatactataacatattattgtataacatatgataatataatatatattatatattatattgtataaaatattatattatatataatatataatattttatataaaatattatattatatataatatataatattttatataaaatattatataatatatatagtataatatattatataaaatattatgtaatatatattatatattatatattattatcttgtatatataattatataattatatataattatatatattatatcatatgtaataattatatataattatatattatatcatatgtaataattatatctaattatatattatattatatgtaataattatatataattatatattatattatatgtaataattatatataatttatgtattatattatatgtaataaatacacataattatatatattttattatatataatattatatataattgtatattatattatatataataattatagattatattatagtaattatattttatattatttttaatattaattaatattaattaataataattaatttaaaatattaattattattttatatattatattatatattatattattttatattatatattatattatatataatattatatattatattataatgtatattatattatattatgttataatatataatatattataatatattattatattatattatatattacattatatacacttatatataatatattacattattatatatacttatatataatatatatataatattatatatacgtatatataatataatatattatatatacgtatatataatattatatatacgtatatataatataatatattatatatacgtatatataatatattatatatacgtatatataatatattatatatatgtttatataatatactatattatgtatacgtatatataatatattatgtatacttatatataatatagtatattatatatatttatatataatatatattatattatatagaattatatagaattacatattatattatataattatatatattcatatatattatattatatataataatacatattatattatacataatattatatataatataaggatgcaggatgtaaaaggaaattatatatatgttatatatattatatatattatattgtatataattatatatatatatatttgtgggtgccctatttcccatctcataacttattttaagaagccagcataataatgtgtgggcttgggattcagtttttgaaagaaaacactgagcctttgatgaccttcctgtacttgtaaaagccctcctgtctgcacggcagcagttggacctcacagtgtggattgtgccttcaccctggaatgtttatgccctatcgccatggtgatgggattagggatctcctgcccttgctcctaagtgccagtatctgtgctgagtttttcaaaggtcagagcagattgaaccattgtggtttcattttccctgattctgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtaactttgaaatttttcttcatttaaaaaatatgtatcttgactcaggcctgtaatcccagcactttgggaggccaaggcaagaggatcacaaggagaggagatcaagaccatcctggccaatacagtgaaaccctgtctctactacaaatacaaacaattagccaggcatggtggcagctggtgtagtcccagtgtgaattgggattcagtttattcccaaattcccaaattatatatatatataatatattaaatatattatatatatactatatattatattatatataattatatatatatatatttgtgggtgccctacttcccatctcacaacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcgtaagtgccactacctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttcaaatttttcttcatttaaaaaatatgtatcttgactcaggcctataatcccagcactttgggaggccaaggcaagaggatcacaaggtgaggagatcaagaccatcctggccaatacagtgaaaccctgtctctactacaaatacaaaaaattagccaggcatggtggcagctggtgtagtcccagtgtgaattgggattcagtttattcccaaattcccaaattatatatatatattatatatatatatataaaaaatatatatatatataaaatatatatataatgtatttaatatattatatataatatattatatatattatatataatatattatatatataatatatataatatattaaatataatatataatatatataatatattatatatattatagataatatatattatattatatataatatatattatacattatataattatatattatgtatataatatataatatataatatatattatataattatatattatgtacattatatattatttatatatattatatataacatataatatatataataaataatatatatattatatatatcatataatatataatatatataatatatatataatttccttttacatcctgcatccttcaacgttccattccccaccccacagattaagttattccccaggggagaatatggcagagtctattttaatgctgtttttaacccaattaagaacctatgaaatcattactttccaaaactttggaacaaagccacagtagtaaggatccgttggaggcttttcacacaataaaatgtaactctctttgtttttaacatgtttttcccttcctctcttctttttttgtgaaatgtgtatttactttaatatatttgtagtaagtcacttccatgcacatattaattttttaaagtaataagcatgtgtattgtctacgtgtgaaagaaaacacacatttatttttatgctttggaagttatccagaatcatggaattgtcaatcacagtcaatcacccaacctactcacctttccagtgtaatcttagtcaaatttttttttttgttatccaatgagatgcagtatttcaactcagaaagataaatagagtgaatttatagagactattaactaagaacatacagtttgatttatactcagaagcaagtagattatgtacatatatatgaagataaaaattaaaaggataattgtgtaaatttgcatgtagagggctttgaaaacctgtttacttgtgaatgctgttttgatgtattgtgtctttgttctcccgacccatcatccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacagggcagaaccctataccctccatgataaatgcagtagcagtgtatgtgggtctgtggaggttgaaagggacttggtcgatgtcaagaaggtagtggcagtcctgctgggcttttaaagggtctgaagaagtgacaggatgctgtggttgaatcgtagcatgtgttttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctactaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaagaaaagctcctgtgctttcctaagggaactctactctagagttggggcttttgacttgaaccttatttccaatcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtccggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatctgtgtttcccccaggaaaaaaatgttgtgtttacccagcacaactctcagtgccatttttcttaatttaacaaatcagaccacatactttacttacattagttcacacctcatcatcatcatgcccatatgttgtgagcttgtttattgagcccacatgccagatggagaaactaagccacataaataaatgtgctctggttcacttgctgcatagtgaagagtcaaaatgtttcctcatacggtgctaatgttgaaggcctgaactacaacctctatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaacgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctcccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttatgtgtgagcctgaagtgggggataaaagaggcgattagctcccctgtgccatgtttctattatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtggggcttgcagacttaattcattaaatcaccaaagcaccagcccacacggccacttttccagttaattgacagtagcttgcatattcaggtttgatcagtggaagggaagttactctttgcagacccatttttgacaatcattttgcggtgtcagaaggtgtgagcagcctcgggaggcaagcagtccctggtccctcagtgtagtcactggaggagacagtcactgagaggcagctggcagggtgaagggcaaggggaggcaggccacagagatgacagcctttaagctgtcatactgggaggtcaaggatctgaaagaggaaggagaattctttatcattaaggacctgtccttatctcaggcatttcctccagagcaccacctttgtccacccacacaccttgggctaggaggactggagaaagacagtgaggggtctcttgggtctgtggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctccataaaccataaggcgtcatgcccacggaaaagccgaacaggaaagcatgctccactgccccggagccatccaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatccggctgtgttcccctctccaggaaggcactgcccacgcagtctgtctgatagaggtgttgagtgctcactgaactccgtgatcttcctgaaacccaactttgattcagtgggctctgcttggaagcctgtaaaaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgcttcaagctaatgtctagaacttacctggttgttaaacataagcatagatctccctgaaagagtggtgctatattattatttttcaattaatatatttctttagagagttttaaattgacataaaaactgagcatatggccgtgtgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcagaaggctgaggcaggagaatcgcttgaacccgggaggcagaggttgcagtgagccaagatcatgccattgcactccagcctgggtgacaagagtgaaactccatctcaaaataaataaataaataaataaataaataaataaataaaaattgagtatataatacacgaagttcccatattattctgtctcctcaccctcacttcctaatttcacctattagtaacatcttacattactgtggtacatttgctagaataatgagaaaatattgacacattattatctgaagtctgcatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcgctcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccaacagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaatggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaatcaaggaaaatgtaatagttttccataaattagaataccctacatgtacaattaaatgaaatggctactatagtcttgaaaccaaaaccagataaggtaaattaaattctgtgatattttaaaatactttaaattctgactaatgtgagttaatctcaacatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgtgacaaccacttgaattaatgctgctttcacagcatatctcttggcttgttaaaaacccgacaagaatttccgtaacattatttttaacacctatattgggtgtgaacccaccataaagtttgcccactgaaaaggtctagaatttgatgctttattaaattgatactgtgtgcacccaacaccacgatctaatttaaatatgtttccctcacccaagttctctcttgcgcactggcagttaatccccactcccatctccagccctaagcaatactgctgtgacattccatctccataaatttcccacttgctttatagaaatggacatatatatatatttggaatctgacttccctcatttagcatactatgtttgaagttaattgacgtgttagcacgtgctggtcatgtgttttccttcatagtctgctgtgtttattcatacagatagtgtttattcatttatcagttaatggacatttaattgttttgttattttctttgatgagtaatgtagctttgagcattcatatacagtcatgtaatgcataatgacattttggtcaaaaaaaatttttttttttctgagacccaggctggagtgcagtggcacaatctcggctcactggaacctccatctcccaggtttaagcaattctcgtgcctcaacctcccgagtagctgggacaactggcacacaccaccacacctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatataacacattatttatcatttgaaccttttaaccaaagtgtgcactccgtggcattcaatatattcacagggttgcataaccaacaccactatctacacccacaattttgatgatttcttacaaaaccttgtccacaataagcaatatagcgccttccccctatttccagcccatggtgattcctatccgactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacatccttgttcacacttattttcctttaaatcatcctagtaggtgtatattggtggctgcttgtgtttttcatttgcatttccctaatgactaatgatcctgagcagcttttcctgtgctactatttgtggctatatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcgctgcagagttaaaacataccagcattcaacccatgtctcctgtcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaggatataatttcagtacttctaattctcccatcagcagttataacaaaggattagtgaataaataccatagactgttttgcctagaattgaatccaatctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaatagctcatgaacaaaagcatctatgactaactgttgctctgtgtcctcctagcctctgaggagtctctagttcacaaggacagaggagatggagagaggccagtcaacgtgaaggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatccaaaatggcatttagctatgatggcttcaggttgtagactgtatccttggggtccttgtccttggaagcaatgtcttctccttggattcagtattttgcacttgccaacctacgtggacctgagagatccgccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcgtgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccatttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaaaagtgaaaacacgaacccaggagtgtgggccagtgctgacgctgacatgcacttagtcatggggtgttcaccaccacacagggagtccagcattcatgtataaaccctaaggcaccgagcccaaaaggccccagacactgcccatcatcataaagtggcctccgtggtcacacaacccagggcagttatgggttcatctccccacggacaggcatagtcatcagtgtgtcaaaagcacaaagatccccaggtgtttggctcagctcaccgatcctttttttttttttatttaacttttcagttcaggggtacatgtgcaggatgtgcaggtttgctacatatataaatgtgtgtcatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgactggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacacgagggaactctgtcactaaatcacggcagagttcaaggctatttcgtgttatagaaggtggcctttagctactaggcaaaggcctctgtttctcatttctttcctgttcatctccttggtcatccttcttccgcaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaatgaacattttggtctacttactatgtgctagattttctcgagaccaagtaaatgagatagaatctttatgttggcagctaagttagatttcgcataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgacaagggcatcgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaaggaggacgccgcccacggcatcgccaacgaggatgctgcccacggcattgctaacgaggatgccgtgcacggcatcgctaatgaggactccgtatacgacatcgctaatgaggatgccatatatgacatcgctaatgacaccgtacaaggcacactaacgaggacgctgtacacgacatcgctaatgaggacaccatacaaggcattggtaatgaggacgttgtatatgacatcgctaacaaggacactctacaagccgtcgctaacaaggacactgtacacaacatcgctaatgacggcaccatacaagacatcaccaatgagggcgctttatacgacattgctaatggcaccgacaaggcacgctaacgtggacactgtacacgacattgctaatgaggactccgtatacgacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgatggcaccgtacaagacatcaccaatgagggcgctttatacgacattgctaatgataccgacaaggcacgctatcgtggacgctgtacacgacatcgctaatgaggactccgtatacgacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcactaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacactctggggactcttgtggggtgggggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacactaacaaggatgctgtacacaacatcgctaatgaggacagtgtataagccatcgctaatgaggacactgtatatgacattgctaacgaggacactgtacaaggcattgctaacgaggacgctgtacacaacatcgctaatgacaccatataagacatcaccaatgaggatgctgtatatgacatcgctaatgacacccacaaggcatgctaacgaggacgctgtagacgacattgcttataaggacaccgtacaagacatcactaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatggatgtcatctgcagtttaatcaaatgtagacatgaacatctgccaatgtggactatttatgacatctgcaattcccttggtgtggtgctattgattggcagcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactataccccttcttattttctctctcaagttgtcgagagactatcagatctgtgtgacgtgtatggcatcatttcaccctcctaatgttttcttttctataattgcaggagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggattggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccacttaactgctcattgactcttactgtagatgaggaggtggccagcagcccctgccctcccccagttgtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtaaaatgccaataaaacaattgcctatataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacatttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccatttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattgtgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcagaaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagcagaaaggccaggagggtggctggaggccaggctctgagtcattctccatgtgatggaaacagccggagcccagtggacttggaggtacaggatgcggtggctgatgacagaacaatgtggagagaggcgtcatttgtcaaatccttactttgttctgggcattgtgctaaaaattctgatggctcatcccatttaggggctgaaagttgcagaggtttaggaagctcacccacgatactggagcccccatctcctgccctagtgctgtccaccttctcacccagccaccacctgtttcgggggaacacacagaagtggtaacctcttatggtgaggcaagtaaattctgctgtttttgttattcacagaaaaacactggctcgtgtgggttgggaaggtgaaataccagaagtatttcatctggttatttctacccatgcgactcctatagtattgaaatgcataggttagcatttttggccaatttactcagcattctgggttaaaggcttttatttattttatttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggtgtgagccaccacgcctgccctaaagtcttttaaaattcacttgtataagttgacttagttttctttaaccttgtagaaaaatacaaaaatagcaatctcttttatcacacaaataatgtctttttaatggagtgatttttttctaattgaggtattatgtacttttcatttactaattattgtttacatttgaagtgttttatgaattaatatttaattgcatagatgaagattactagttataggcattttactaaccaatactcattaagcatagcgtggattcctatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatggaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgaagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccgcccaggttggtgccggactctccctgggcccccctgttctctcaccagccacatccattctccccccagaggcgctagtgactgtgcgtggctttccattcccaccacgtttgtctctaaccccagtggcagatcagtgtaagaacacagctgagtgctcctcgcctccttgccccttcaagggctcctcaccacccaccagatcaggtgcaaacttccaagccttactggatccccttccacattctgagctccgcctgccttcccatcgctatccttccccacctgcctccctggtagagaaaagcggagtgtgtgatgctgtctgaatgctgagcacggccttttgcagccagtccactgtgtacgctgcccctatcggagacctccaccttaagcctttccagcctggaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgctgaataaatgaatagcagttacaaaacacttgattcatatggaattaatgttggttctcaaagtgaaaaattacaaacagcactgatattcagccagtatacaagtctggtcacagcagttgtataatactgaaataccccccgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcattgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaaccttcatcagaaaacaatgcttcattaatccgtgacaggacaagcgtcagcaaacttccaggcggctggataaggccttcatctatccatcaccttggagaggaacaaaataggtggcctgggaagttaagcactatgtttctattcgttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggttttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgggagccaccgtgcccagccttttgtttattttttgacgagaccgttcttgctctgtcaccaggctggagtgcactggcacaataatagctcaccacagcctcgtgctcctgggctcaactgaccctcctgcctcagttttagcttcctgagtagctaggactacgggtgtgtaccaccatgcctagctataataatttttatttttttgtagagatggagtcttgctttgttgcccaggctggtcttgaactcctggcttgaagtgatcctcctgcctcggcctcccaaagtgccgggattaaaggtgggagatcgcacccagtctccaaccctctttttgcaagtaaatgtaactggaccccagccatgctcatctgcccatgtactgtctgcggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagattgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataggatctctgatatacagtctccaaaagctcagccaagaaacttacaaagtctctctgccttaacttcatccaccttttttctctccagcttctcctcggtagttaatgattataaaaatatttattggctcatgcctgtaatcccagcactttgagaggccgaggcgggcagatcacgaggtcaggagatcgagaccatcctggctaacacggtgaaatcccgtctctactaaaaatacaaaaaattagccaggcgtggtggcgggcgcctgtaatcccagctactcaggaggctgaggcaggagaatggcgtgaacccacaaggcggagcttgcaatgaggtgagatcccactactgcactccagcctgagcgacagagcaagactccatctcaaaacaaacaaacaaacaaacaaccaaaaaaacagtgtgatggccaggcgcagtgctcatgcctataatccaagcactttgggaggctgaaatggatggatggcttgagcccagtagtttgagacaagcctggcaacatagcgagacctcatgtctacaaacatctttaaaatatgccaggcatggtggtgcatgcctgtagtcccagctattcaggaggctgaggtgggaggatcacctgtgcccgggagttcaaggctgcagtgagctatgatcacaccacagtgctccagcctgggcaacaaagcaagactccatctctaaaaataaaataaaattaaaaaaaaagatcttcgctgtaaaagaggtacgctcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcagtgagcctagatcgcaccactgcactccagcctgggtgacagagtgagactccgtctcaaaaaaaaaaaaaaagaaaaagaaaagaaaagttcttgtgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccagctaatttttgtatttttagtagagatggagttttgccatattggtcaggctggtctcgaactcctgacgtcaggtgatcgacctgtcttagcctcccaaagtgctaggattacaggtgtacatttatttatttatttgagatggaatcttgctctgtatttattaatttatttagttgagatggagtcttgctccatcgcccaggctagagtgcagcggtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaaatgttgggattacaggcctaaggcaccatgctcggccatatttatttatttaattatttagagacaaagtcttgctctgtcacccaggctggagtgcagtggcgccatctcagctcactgcagcctccgcctccgaggtttaagcaattctcatgcctcagactcctgagtaactgggactacagatacttgccaccacgcagggattttttttttctatttttttgtagagacacagtttcaccatgttggccaggctggtctcgaactcctgaccttaggtgatctgacagcctcgtcctctcaaagcactgggattacaggcatgagccccttgcccggcctctcactacgtttaagtgatgccatggctcatgcctgtaatcctagcactttgggaggccaaggcaggtggatcacctgaggtcaggagttcgacacgagcctggccaacatggggaaaccctgtctctagtaaaaatacaaaaattagtcaggcgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaataagagaaaaacatatgatgccggggcatctcggcctcaatacctgggtgagcacagtcatgtccaggccagggctgctggttgaggtccggccccatctcttccagcagaaagggagtaagcttgcagggcggctgggggacaagatcccaggatctcagcctctgctcatggatcagctctgagaccccgagtgagctgggggtgctctgtgcgcgttggtttccccagctgtcaagtaaagggattggatgaggaagtcttgtcaaggtggaatgatgtcagatttggggcagcagtgaatgatcccgttccttgggccatgccagtggcctggcctcggctcaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgaggccgggaattttgagaatagcctggacaacatagccagaccccatgtctacaaaataataataaaacatacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaagaaataaaacatactgaaatatgtatgggtacagttatatatctgggatttgcacggaaataatgtggggtagagggaagcaggaaagagtatacatgaaatgagcttggccataagattgttgttgaaattgaatggatactcggggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggtgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagggaaggatgcatgttgtaagctctaaaataatccagtcatcttttaaaagaactctaagactgcacagttatgaaactaatagagaaggaggaaattaaataataaaaataataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataagggtacagagaggtggaagatcatgaaaaatatgtcatgcatgtactaaccaagaaagctgtataactttttttttttttttttttttttttttttggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatactagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagggacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagattgtgccattgcattccagcctgggcaacaagagcaaaactctgtctcaaaaaaaaaaaaaaaaagaagttactagctagtttcggtaattcttaacatccaggaaactggaatgtgaaagtttttcagagaaactaaaccaatagattatacatagagagagacttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggtagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtatttgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataagcattagaacaaaaatataaacttttctttcttttttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccacccccctcggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctgggccaacatggtgaaaccctgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcacaaaaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctgacgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggacagatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagcggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgagatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgctcaagccctgcaggtgctgaagcccacacacacggctcctgcttcctgggccagtgcacgtgcacacacacacacgtgcacacacacacacacccacaaatatacccacacacaatcacacacattcacacatacccaccccccatactcacactcacacatttacacacacccacacacccacactcacacactcacagtcacacacaccctcacacagcgaaacacaatcacacacattcacacccacccacacccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactcacacataatctctcacacacacacatgctcacacacacacgccttctccaggaggggctggctgccaaaggccacccagcttcctcccacgtctcactcaccgtacaatatttgagaagaccttggagtcagcagcaacagcggtgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggcccgacctaccgcccaccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggcttcccagtctgcacagaggacagggggtcttgacagcatcaaatgctagtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtctacacctggagtctgggcccctccatctgggcagcagagaaactgaggcacagagacagactgtgtccttacagggcacacagcctgccaggcccctatgtccggccagagcccctggccagcctgggctgcagtgattgtttagaggtaggctgttcccacggctgcctctcacggtaggggggcctgcggacgcctcctcccgcccccacccgactcccaagcctcagtgacattgctcaaccaggagctgaagtgcattcctgggctcaggccagcccacccaccgacccgctgcagtcctggaagcccagaggcctgggcagcaggaacagtggagacagcagtgtgggggacgtccccctcctctccccaccatcctcgtcaggcagaggccagggtgcagggaccgcccgagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgttgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccgtatgctgagtgcaggtcccctgggcccacttttctttctctatactttgtctctgtgtctctttcttttctcagtctcttgtcccagctgatgagaaacacccacaggtggggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatttcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaattttttttaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccgatggtgaaggctgctgtgtcgagctgtttccttccggacccactccctctgggctgcgtccccggctggtccaagccctgatccctgggatctggggacatcttcccgtttgctgttccctgagaaccaggcctccctctggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgcctggctctccccatgctgaagatgctgaggctagttccagtgtccgcattgtgaagatctccgaatcccacctctctgttcctccccagccagatggctccatttcacacacaaaacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcactcagtagccagcaggttccccgcctttcctggagtccgaggcagctgcccagccaccagccgtgcggacgatggcttgcaccacagcgatgaaggtggacgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggccctcatgtcacaggggctccagatggcccaggcactagagagaggacaccaaccattgtccactctgtgatgatccaggcctccagcccaggatgccctgggaccccacaccgtgactcagtttctccaacccccggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccggacctccaccccatacctggctggatgaaattggcaggtgaggggggtgccccaaactcattggtgatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtcgtaggagatcgggtgagtggtgtggtcagagatctgggaccggagctgggcagcgaagaactcagaggtcatgttgcggaccacctgctgagaccccagagctggcctgaggaggtggggagggggcacaggtctcagaaggcccttgactgtgactctgaccgcaaccctctggcacccacaaccttccgtggctccccaggacccaagggcaggcccaggaccttgcatgaccagtctgactccctgtctctgtcgcgttccagcaactctgaatgtctgtctgcctggtcctcagcctccagacccttgccgcattcaatcactcattctttcatgcaaaaaatatttctagaatttgcactgcatgcctggcactggggaatcaacagggaacagacacttaagtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaatgttgcctaaatggtcagtgcaaaggccctgaggcaggtggtataggctggtgagcgataggcagagagtgaatggagtggggtggggagaagaggatgaagatgcaggctggggcccatcccacaggacctcctaggtcccataacaactggcttttgctctgtgccatgcaggcttagggcagaagaatgaggaggctggggagtgttttcacagggtccctctggcagctatgacggggataaggataaagcccaaaggggaggctgtgggtatcaaccaggcaagagatgatggcctgggtgggagaaagagaagaatcaagcatggtgccgactagcgaggccggcagaaggggccggtttggggatggtcaggagcttgattttggatacttcatcagacccaaagagcatgggtgcacgtataaaaaaaataaataaataagcatgggttcacgggcaagggcgggctgagagatgaacatggaggtattgacattgagtggctgctggatgccatgagcctggccaaggtccccaaggcagtggcgaggaggagatgaggaggtcaaagaggagacagagaggatggacccgaaggccgaagaaaatgcctcaagagagtttcaacaccgggcgcggtggctcacgcttgtaatcccagcactttgggaggccgaggcctgtaatcccagcactttgggagggcggatcatgacgtcaggagatcgagaccatcctggctaacacagtgaaaccccgtctctactaaaaatacaaaaaattagctgggcgcggtggtgggcacctgtagtcccagctacttggggggctgaggcaggagaatggcgtgaacctgggaggcggagcttgcagtgagccgagatcccgccactgcactccagcctgggggacagcctgggggacagagcgagactccgtctcaaaaataaaataaaataaaataaaataaaataaaataaagtttcagcaacaccccacggattagctgaccaatcccagggaaaggtgttctgtctgaatctgccctcaaggaaacagaaaggcaaatccacgatgtgggacattttccaagactactgccctgggctttaaaaatcaacaaaacaggccaggcacggtggctcatgcctgtaatcccagcactttgggaggccgaggcaggcggatcacgaggtcaggagatcgcgatcacggtgaaaccccgtctctactaaaaatacaaaaaattagctgggcgcagtgtcgggcgcctgtagtcccagctactcgggaggctgaggcaggagaatggcgtgaacccaggaggcggagcttgcagtgagccgagatagcgccactgcactccagcctgggcaacagagcgagactccgtctcaaagaaaaaacacacctgtaatcccagcgctttgggaggctgaggtgggaagacagtttgatcccaggagtttgagaccagtctgggcaagaccctgtctctaaaaaaaatacaaaaattatccaggtttggtggcacgtgcctctggtcccagctgctcagggggctgaagtgggaggattgcttgagccctggaggttgaggctgcagtgagccaagatcacaccactgcactccaacctggatgacagagactctgtgtacaaacaaaaacacaacaaaaacaaaacagccaagggagcctactgtaggtaaagagaagggacagcaggttgtgtcaccccgacatcctgctgtgctatgttcaagtctcacttttgagacacaccctgaggtgcgacatcagtaacctactgtggaatccctcagaaaaacacgaatcccaatagatgtgggtggagacggagagagttaggaaatccggcagaaatgtccacactgcagaatccaggaaaagggaacattgatgcttgggcagttttgggttttttttacatttttgtaggtgcgaaaatttgcaaaatgaaaactcgaggagagtgtggtgagctgtgtgagatgctgctgagtggggcctgatggggaaactgaggctggacatggcgatctggtggcatggggatagagcaggggaggggataccctgaagggagagaggacatagcccagccatgtttgctctaagaggagcaaaggacagaaggaggcagcagatagaagtctctagagcaataacagctgccttttttttgggaataatccgtgataaagaaataaatcatcagaggcagacaggagcattgtaggaacagcaccccgagccagcgagtagatgaaggacctggccttagccaaaaaggagggcagagggacacgctgcagtggctctgtccccttagagagacaagacaccaggtcactggctgcagcgggagtcagaggtgcagaatgctcacagggaaagagaagacaccacccgggcagctgacgcccctcctgggaggtcactggtcagtgtgggggggtctgcagatccgcccaggaatgccaaggacccaagtaggtaaggagggatgtgaggatcctcagcgggaagggatatgacagggtcttatagggacccagcatggagctggggcaactactgggtgagtgggtcaggtggtgcagggctgagggtggcatctgggaagcgttagtttggagtgacagggagtgggtggccgaggtctctgttcacctggccctctccctttcacccatccatctcaccatgcccgagggctgcaatgcccccatgcattcctcatctcagcactgagcactcaagaaccacagcatgtgcaaaggacctgaggtaggagggtggccactaattccccacactgtcagttctgtggggcagaagccaagactgggggtcacccacgagtccatccgagcacacagtaggcccgcaatcaaattctgtggcaggaatggattcataaagcatatgtgaggctgtagccaccctggggagcccacctgatgcctctacggcaggccccacacccacagtgagccagcccctgccccttacctcagtcacatccacaaacttggggtccccaagcagggtcctcttggcgtaggcaaaccggaaagcctctacgatgcggtggtacgtcaggcccttctgctcgggggtctccacgctctcccgggagaagttgtaccctggttgatcagagccaggtgcatgttgctgagccccagaggctctgaggggctcagagggttaacacctgcctgagccactttgcccacctcaaggagcgtttaataaccaatagcagcagctgcttcagaaggctgtggtgagagtgaagtaaggtgagggctcctgagcctggacctcacgtcacgcatcagctctggccattcaatgaccaagtggcagggtcacccactggaccggggtaccctctggaccggccctgcagccctgagctcctgcacctctctccctcctgatgactcctgttcctcctccaacccttgagcattgcccgcttcagccctgttgctctgcactgcctccttcaggacatggtgagctgtgacgcagggacacacctcaggagctcagtgatggaaagacgtggcatggggggcgagcagagatgcaggaggggtggggcgtggggagagagaggcagtgtcatgggtcctaccacacggctgtggtgcgaccactcacctttgaggatgttgaggatgagggccagcacgggcccgctgagccgcgcactgggcatgtacagcaccgcgtctcccaggctgatgttcagcgggtgctcgatcagctcagcacggtagttgttcaggtcctcagctgtcacaatgccccctgcaatgggacagcagctcgaatgggcgctgggatggggctgcaccactgcgtggaggatggagctgcaccagtggtgttgggggcaggcatggctgcaccatggtggtggggaaaagcctgtacctaccagggaggacagagtgcactactggaggggtgggactgtgccctgggagggggccacaggcaacctcacctccttgggaacctcaccagctccggcactcctgtctccctgacactgctcaccacccgacagctgggctggggccacctgccctctgcctgcttggcttactggcttcctgtctgccttctctcatctgtggccagagagtgttttcttttttcttttttttttttagagatacgatcttgctctgttacccaggctggagtgcagtggcttaatcacagccttgaacccctgggctcaagtgatcctccagcagaccctccccagtagctgagactaaaggcacaactacacccagcaaattttaatttttttgttgtgttttgctatatttctttctttcttttttttttttttttgtgagacggagtctcgctctatcgcccaggctggagtgcagtggcgcgatatcggctcactgcaagctccgcctcccaggttcacgccattctcctgcctcagcctcccaagtagctgggactgcaggcacccgccaccacatgtggctaatttttctgtatttttagtagagacaggtttcactgtgttagccaggatggtctcgatctcctgaccccgtgatccacatgcctcggcctctcaaagtgctgagattacaggcgtgaggcaccatgcccggctgggttttgctatatttcttttcactatgctttgaattttttgttttcttgttccccacccccacccccactatatttatgtagattctcaatattttttttgtagactcactatgttgcccaggcttgtcttggacctcctgacctcaacttctacctcaggctcccaaagtgttgggattacaggcatgagacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggaattcatctatttcatctgggttatccaatttatgagcacacaattatttatagtaatcttttataatcctttctaggctgggaatggtgggtcatgcctgtaatccaacaatttgggaggccgaggtgggaaaattccttgaggccaggagttcaagatcagcctggataacatggcaagatcctgtctcttaaaaaaaaaaaaaaaaagagctggcatagtggcgagcccaggaattcaaggctgcagtgagccgattgtgccactgattgtggttgcatctgattgttgccagggcaatggagctagaccttgtctctaaaacatagacaggcagacagacagacagacagacagacagaaatatataaagatattctcaaatacatttctgttttaagtaatttagattgtttcccttttccttagtcttgtcagttttattaatctttttgaagaaccaacttttggttttgttttttattgtttttctattctcttttccatttatctctgccctgatctctattgtttccttccttctgctaactttgggtttagttttattcttctttttctagtttcttaatgtgtaaacttatgttgttgaattgaggtgtttctttttttaatgtgtttatagctataaatttcctccttagcactcctttcaccacaactcataagttgtgtttttttgttgtttctttgttttttgagacagagtctcattctgtcacccaggctggagtgcagtggtgttagctcagtggtgcaacctctgcctcctgggttcaagaaattctcatgcctcagcctgctgggtagctgggactacaggcacgtaccaccactcccagctaatttttgtgtttttagtagagacagggtttcgccatgttggcctggctgatcttgaactcctgacttctagctatccacctccctcagtctcccaaagtgctgggattacaggtgtgagccaccacaactggccacaacccataagtttggatatagtgtgctttcattttcatttgtctttaagaattttataatttctttgtgatttctttgatccattggttgtttgagagtgtgttgtttaaattctactaatttgtgaactttttaaaatcttctgttattgatttctaactttatcctgttgtggtcagagaagacactttgtatgatgtctatcattttaaatctactgagcttttttccttttttgggacagggtctcattctgtcagtggtacaatggtacattttctttgtcatgaagtacaggctggagtacagtggtacaatctctgctcactacagcttcaacctcctgggctcctaagcaattctcacgcttcagcctcccaagaagctgggatcacaggcacacaccaccacgcccagctaatttttgtatttttagtagagatggggtttcaccatgttggccaggctgatgtcaagctcctggcttcaagcaatccacccgcctcagcctcccaaattactctgtgattacagatgtgagccactgcacccagcccctattgagaattaatttgtgatgtgttatgtggtctatcctgaaaatgtcccatgtatacttgagaagtatgtgtattatgttgttgggtagaatatcctgtgtatgtctgttaggtctagttgttttttcaggtgttgttcaagtgctgtatttccttacttatgtctggtctggttgttttattcatttgtgaaatgaagacaagggacaaaatcctaagacatcccccttgaaagggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcagccattcatggacaaaactgcctttgcaagagttttaatatccaggcaggaggtggcaaaactctagcaaagcccaaaaccaaggagagctgctttgagaaggcaggtccacacaccagtgacaggttcccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcgtgcctgcccaggaattcagtgatgcctttacatgcccttggtaacaggcctgctgatctcagtctcagctatggacactaaagtagccctgtgactccattccagtcttgctttgccacagtctgggcacagtccagcccatcctgggacctggtgaaagacataccatccattctcctaataagaggaccaccaatcttgaacccaaatgtggtcaccaaagctgtcctgtgacttggctctagccctgctctactgtggtctggaggcagtcctgtcttcccatggacctacctagtaagccagcaggagctcaatctgggacccacagggagctataccagtccatgcccttggtaataggcctgatatctgaagacttgactgtagaactagaagtggccccatgacctggctccagtcctgttcaatcagggtatcagaggcagtccagttctcctgaggatccagcagaaactgcatcaccaacctatgccttgatagcggcctgccaatcagagattcagctgcagaccaggcagcagccatgtgatatggctccaggcccacttgactgtgatccagtcaagggatccagcaggaaaaggtttgtacctgctgaaaccaatctataaagacagaaagagattgggcatggtggctcacaactgtaatcccagcactttgggaggccaaggcgggcagaccacttgaggccaggagtttgagaccagcctggacaacacggtgaaactctgtctctacaaaaaatacaaaaaaattggccaggcgtggtggcacatgcctgtgatcccagctgcttgggaggctgaggcaggagaatcatttgaacctgggaggtggaggttacagtgagctgagatcacgccactgcactccagctgggtgacagagcaagactctgtctcaaaaaaaaaaaaaaaagaaaagaagaggtatttgcttcttcatagacattaatgaaagtttgtagatcatgaagaatcagcaaatatgacactaccaaaataaactcataaatctccagtaatcaaccccccaaaaatagagatctacaaattgcctgacaattcaaaataattaagatagctcagtgaaatttactagaatgtatatatcaactcaataatatcaagaaaatagtagatgaacaaaactaaaagttcaataaagatacagaaataataagaaccaaacagaaattctagaactgaagaatacaatgaataaaatgaaaatgcaagctgggtgccgtggcggacgcctgtaatcccagcactttgggaggccgaggcaggcagatcacttgatggcaagagttcaagaccagcctggccaacatgccaaaaccccatctgtattaaaaatacaaaaattagccaggcatggtggcatatgcctgtaatcctagctactagggaggctgaggcaggagaatcgcttgaaccgggaggtggaagttggagtgagccaagatggcaccactgcattcaagcctgggtgacacagactctgtctcaaaaatatataaaaataaataaatgaatgaaatgaaaatgcaatagagaatttcaattgcagacttgatcaaacagaagaaagaatctgtgaaattaaagacaggacatttgaaatatcccgtcagaagaccagaaagaaaaaaaagtttataaagtaaaaacctttgggatttataggacaccaccatgaagtgggtcaaacatattatggactttctagaagtaaaaaagatagaaaaggcctgaaagtatatttgaagacataatgggtaaaaactttccaaattcttagaggcaagtgggcttccagacacatgaagttcagaggccccaaaaaaggccagcccaaagaccataataccaagatgtattataattaaaatatcaaaagtcaaagacagagactttcaaaagcagcaagaagaaaggaattcatcacatacaaggaaacttcaataaggctatcagtggatttctcagcagcaaccttataagccaggagagaataggatgctatattcaatgtattggaagaaaaaaactgccaatcaggaagaccacaacttgtaaagctgtccttcagaaatgaaaaagagatgataaggtctttcccagactcccaccaaaaaaattctaagggagttcatcaccactgcacctgccttataaggcagtttttcaagttgaaataaaaggattctgattagcaacattaaaacattaagatattaagttcacaggtaggccgggcgcagtggctcacgcctgtaatcccagcactttgggaggccaaggcgggtggatcacaaggtcagaagagggggatcatgctggctaacacggtgaaaccccgtctctactaaaaatacaaaaaattagccaggcgtggtggcgggtgcctgtagtcccagctactcgggaggccgaggcaggagaatgacttgaacccgggaggcagagcttgcagcgagccgagatcatggacactgccctccagcctgggcgacagagcgagactctgtctcaaaaaaaaaagttcacagggaaaggtaagtatatagtcacattcataacactgtaatattgcagtggtggtgtgtaaatcacttttcactgtagtataaaagttaaaatgtaaaagtattaggcggcccgggagcggggcagctgctgcggggaggcggggaggcggggggcctggccggacacccctgcgccccctccccgcacccgggcggagggcggcctcttccccctctccctcccccaccacccccggcagccgcctcccccaggacgcaggaggcgggcggaggccgggtccgcgcagcgggcgacttgcggcatgggccgggtcgaggtgggggggcggtttcgggggctgggaagctggggtgccggggacaggagggtgggggagctggggaaaggagggctggggggccggggacaggagggccatgcaggcagtggcaagcgggcggcgagggctccgtggggcaggtggacggggatcagcgcctggggctgctccgttccccaggcgggtgtcgtggctctggcctccatgcaactccaggtctgcgcgccccgcgctgctggagccccagtcaaaagtctatttaaaaagcagagagaggatgcttccctctgagtggagcgatgaagacctgatccctgggccatttgggaacactagctgcctttcatcacagtcaacctggactcagagaatgtcaagagcttgttggttgggtcaagaatgaatctaggcatgacgtcatagtttatagtcatccttttaaacctgcaaagaagcatttgcaggtttaaagttatttcacgggtactgcttgccaatctttggaggatgtgaagcctgcagagaaataaagtgtcgcccctctgcgcgtcgctccccatctgccagaatgtttctcatgaatgctcctccagtggttgctctccagcgcaaatgggtggcctctgtcccaccagggagctttaggttccccgggtgcttctcggaggctgacaagggcgtggagagcatgtcggtgagcacccgggtgcagatgctcatcagcacgctgcagagcgacagggctgctaggggcaccagcgatgagcgcactgcgcagagggggcagagggatgccacgacgccaggcctgctgccaagcccaccatgcacaaggagctgcctgcgttggctgcctgtggtcttgttgctgactttgaccccgtgggggaggaggaaactgcagactttggcccattggtgctagattcagacagtgacgattccgtggaccgggacattgaggaggccatccaggagtacctgaaggtaaagagtggagccgcacagcccggggccagcggggcccagccatgcacagccttccagggctgcaggcggaggcagtagatgtaagccggaactggctcacagcagtgcccaactgccctgtgttccccaaaacttgtacctggctcaggtggtgtggccctggcagccaggtgggatccagcaaggaccagggctctgcctccccagtcagcatgagcagagcagactcctttgagcagagcatcagggcagaaatcgaacagtttctgaatgagaaaagacagcatgagaaccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgcaggagaaggagggcagcacaaagccagcaacccccaccgcccttcagaagcagtacagaataaaagtgggattaaaaggaacgccagcaccgcaaggaggggaaagcgagtcacgagcgccgtacaggcgcccgaggcgtccgactccagcagcgacgacggcattgaggaggccatccagctgtaccaggtgcagaaaacacgcaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggggatctggacgctgaccattcccccaagatcccaaaggaaaccaaagctccacctccaacgagcccggcttccaggagcaagtttgtggaatggtcctcttgccaggcagacacctccgctgagctgatgtgtgtagaagcagtcctggacattttcaagacgatcctgccggccctatggagggcagcgatgggtccctgtccgcaagcccactcttctactcccccaacgtgccttcccgctctgatggtgacagtagctccgtggacagcgacgacagcattgagcaggaaatctggacgtttttggccctcaaggtgcagtctagaagtttgctggccagaggtgagagctgccctcaggctgcccagggcccactttcaccacctggcctcagcagccagaccggcagccccaaggcccctctctctaaaacactggacccactcctggctgcaaaaggaagcatagaggcggctgccaagtgaggccatccactcccaagaacatgcgggtggtggggaaagagggtggccaggatgccgaccgcagccaggggagagccgggccgggccatgaggggcgggacctttccatccagggcacagccagcgaggccccgggaggagagggcgccgctagggtgcccggtgacactcgcacgtcacagggccagggtaagacagacgaggcaaggcacctagacaagaagaagagctccgaagacaaaagcagttccctggacagtgacaaggacctggacacagccatcaaggacttgttaaggtccaagtgaaagctcaagaagaggtccagggagcccagggctgtgtgcaggaagaaggtcaggttcagcacctcccagacgcacttccaggagcagctgggcaggctcctgagagagtggaaaaacaggcacctgcaggtgctgaagagctgcctaagtccaagagagacagctgcgagggctccaggaagaaaccccccagtgtctttggcagcagggccgagaggacgaagccccggccttcctggtgaggagacccgcttctgcctccgcctccgaagagaatctattccccagagagtcccagggcccagctcccagccctggctccttgtctgacaacagcagttcagtggacagcgacgatagcatcgaactggagattaggaagtttttggtggaaaaggccaaggagtcggtgagcagttcagaagttcaggcagagggccccaccgctctcgggacagggggcccagccaggccagaggtaccttgcaggaaggagccggccccactgcctggcatgtgcacacggagccagagggccggggggtcccacatttggctaaagggcatcgaggcgcagggagcgcaggagcacagggcgcagcgtgcctgctcagccagggtgggaaggggctccccactgatccggcggaggggatcatgcgccacccaggaggaccagcggcagtgtctccgccaaggtctctcagtgagcaagagaaatgtttacgtttacaaagaccagagcccacgaggggctgagcctgctgccaaaagtgcttttggtcagcggcccagctgtgccacagcgggcaccgaggcaggaggagccagggggacctttcacgtggactgcaggaaccggagcttcctgacccccagcccgggagctgagagggatgctggagcccaggccaaccgcgccccgccctggagtgactttgcccaccacagtcggctgcccagcccatgggcactgcgctccaaaggtagagatgcggcgtggagggggcggcattgggagagagagacaaggggtccgagggccccgcccggggcctgcccagcctgccccttgcgggcttctccccgctgctgtccacccagctcttccactttggaaagggtgtctcctgggggggcagggagaccggcctcttcagcccctacctggggctgcctctgcagggcctgtccttctcggccttcagggagtcccaggccaggcccagccctgtctttggaagcccacacttgctggcgaagaaggactgcgatcaccggccaagcaggaaggtacagacggggctgagtttgcacaacaggaagagctctggctcggaggaaaggattttagacctgaggtatccacgaagggtcaatcagtagagttgaccaggaccaggacaccttgggcagggacaccagtgacttcagcgacacctccgcagaggtgttgctgctgcagtggcggcagctcagtagtgaaggtataagacctcgagctgtgggttcgcgtcctgggttccatgcattcgtggaaagcggcatagccgacgtgtatctgtgcctgtgtgtgatggttctgtggttgcagggaggggaaacagtctgttatacatagtcttgtgtatatgtataccaacacgaaacaatgcttttatttaacagatgtgtcctggtaaatatgatttttgtagattttgtacattatttgaagtgatgaaaaatgtttttggaaaatactgttggtcaattttgtagggtgttccttaactgcagttttctgtgttctgcatacaagtcttagattagaaaacatttggtttttatcatcacaaccaggtttacagggactctgatgttttttggttggttgctggtgagaatggccagcactggctgcaggggtagccttaggaaggccgaggtgccctccccaggaatcgctcacatgccccaaagtgtccgtcaggaagttcctgggacagcactttttatacagaggacacccccccaccaccgcctggcttcatggtccttggaggccagagcacatctgaaaactacaggaacggaaaaccaaactccgcatgttctcactcataagtgggagttgaacaatcagaacacttggacacagggcagggaatatcacacactgaggcctgttgggggatgggggcaaggggagagatagtattaggagaagtacctaatgtaaatgatgggttgatgggtgcagcaaaccaccatggcacatgtatacctaagtgataaacctgcactttctgcacggctaccccagaacttaaagtataattaaaaaaaaaaaaaaaaacagaaaaaataagtagagattaaaccagtaatgaaaaatctcccaacaaagaaaatcccaggaccaaatggttttactggtcaatttcaacaaacatttaaagaattaataacaatccttctcaaactcttccaaaaaaattgaagaaaagggaacacattgaaactcattctaagaggccagcattatcctgatatcaatgccagataagaacactacaaaataagaaaactataggtcaatatccctggttaacatagatgcaaaaatcctcaatgaaatactagtaaaccaaattcaacagtgcattaaaagaattattcaccatgaatccagtctctaccaaaaatccaaaaaaaaaaaaaattagctgagcatgctggcgggtgcctgtggtcccagctactagggaggctgaggcaggagaatggcgtgaacttgggaggcggagcttgtagtgagccgagatcgcgccactgcactcaggcctggatgacagagcgagactccatctcaaaaaaataaatacataataaataaataaaaaacaaaaaaagaattattcaccaggatcaagtgggatttatctctggcatgcaaggatgctttaacatacaagagtcactaaatgtgatacaccacatcaacacaataaacgataaaaatcctttatttttattattaaaaagcacttgataaaattcaacatcctttcatgattaaaaaaaacaacaaactgagcaaattaggtgcagaaggaatgtacctcaacataatgaagaccacatgtaacatactcaacagtgaaagactgaacgtttttcctcgaagatgaagaacaagacaagaattcctactctcaccatttctcctcaaaataggactggaagtcctagccagaacaattaagcaagtaaagaaataagaatggaagtaaaatggtctccatagatgacatatttttatgtatagaaaactgtaaagacttcactaaaagactgttagaagtaataaattcaataaagtagcaagatacagagtcaacatccaaaaatcagttgcatttctatgcatagatggactggagggcattatgttaagtaaaataagccagacacagaaagtgaaatattgtacaatctcacttatgtgtggaacctaaagacgtcaaactcagaagaagagaacagaatggtggttgctgggagctggggaagagaaggaaatgggaagttgatggttaaagtgtacaaatttcagttatgcaagataagtaagttctggagagctatacagcatagtacccacagaaaatgttactatattcttaaattgtttaattaaaaacttttattattattatttttttttagacagattttcactcttgttgctcaggctggagtgcaatggtgctgtctcggctcactgcaacctccgcctcccaggttcaagagattctcccacctcagcctcccagtactttgctcagattataggtacccgccaccacgcccagctaatttttgtatttatagtagagatggggttttgccatcttagccaggctgctctccaactcctgatctcaggtgatccgcctgcctcagcctcccaaagtgctgggattacaggcgtgagccaccgcacctggccattaaaaacttttttttatacaataataataataaagaggcagaaggaaattttaaaaggtgatggatatgtttataggcttgatgataatggttttatggtgtaaatttatcaagatgtgtacgttaaatatgtacagtttttatgtaaatcattcctcaacaaaatggtttaaaaagtaataaagtaattactgataaggggggacttacttctggcattttgctatacattttctatatgccttacagcatttttgtccatttcctgcatgatctcatttgtatttagttgattttttgtagcgaagtgttttaattcccttctcatttacttttttatgttatataatgttttatttgtggttaccatagggattacacttaacattctaaagttatagcactctaacttgaattcataccagctatatttcaataatatgcaaaaactctcctcacagttttgccactcctctttcagttatcaatgtcacaaaattacatttttgtacattgtgtgtccataaacataaactaataattgtttttaatgcatttgtctattaaattatgtagaaagcaaaacatggagttttaaaccaaagttacgataatactagatttaatattttcccatatatttacttttactggcatctttatttcttcatatggctttgagttactatctagtgttctttcttttcaacctgcatgattctctttaagatttcttgcagggcaggtctaatggtagcaaacttctcaactttggtttatttggggatttcccaatttcttcctcacttttgaaggacagttttgctggatataggattcttggttgagaggtagtggttgtttttcttttagccctttacatatgtcatcccattgtcttctgttctccaaagtgtctgatgagaaatctacttataatcctattatatattcctagcatgtgactagttgcttctctcttggtgctttcaagaggccctactggctaattataatgtctcagtatgagtcttttttttttttttcatcctacttggagtccattgagttttctggatatttattttcatgtctttcatcaaatttgggaagtgttcagctttttttttttcttttttgagacagagtctcgctctgttgcccaggctagagtacagtggtgtgatcttggctcactgcaacctctgcctcctggattcaagcgattcttctgcctcagcctcctgagtagctgggactacaggtacgtgccaccacgcccagctaatttttttttttttaaacggagtttcactcttgttgcccaggctggagggcaatggcacaatctcggctcactgcaacatctgcctcctgggttcaagcgattctcttgcctcatcctcccaagtagctgggattacaggcatgcaccaccacacctggctaattttgtgtttttagtagagacggggtttcaccatattggccaggctggtctcgaactcctaaccttgtgatccacccaccttggcctcccaaagtgctgggattacaggtgtgagtcaccgtgttcagcctcagccattatttcttcaaatgatctctctgcccctttccctctcttcttttgggacttccacaatgtctgcttgctattcaacaatcatctttatttctgttcctctgacttgatcatttcaagtgtcccatcttcaaattcactgaatctttcttctgttgctcaaatctgcttttgaatccctctggtgaacttttatttcaatcactacacttttagttccagaatttatttattttttttctttttaggttttctatctctttattgatattcccattttgtttacacataattttactgactttctccacatcttccttcagttctttgaccatctttaagaaagttgttttaaagtatttgtgtagtaggttaccatctggtctttctctggaacagtttctgttgttgtttttcctttgaaataccatattttcttgttttttgtatgccttgtgttttgtattgaaaactggacacttgaatataataatgcagtaactctggagatgagactctcctcttcctcagggtttgctgttttggggttttgttatgttttacattgttgtaggttgtctccatgctgaggatcaacctgagttgtaagcttgaggtcttctcaggtctgaagctgctcctttccctgggcacacactcctctctccaaggatgtgtggtaactttaatttcctctgggtatgccattgcttttgagtgtcctagtctttaatgtttggctcccaaaaaaggaaaagagaacaatgaaggggaagggaaatggggttctggccttttctatctcctagaagttgcttcagtctggtaagggcttgcagcagtggagtggggagttgtgagcaataatggctgccagcctctgtgtttgcccttccataatcaaaagtagcaatcaacaaccagaacgcagatgctaacacttggaggacagagtgcttattgcccatgattgttcccacaagcttggtacaagctgcttcaggaacacatgcaaagcttcttgccgtgaagctggggcatggggattgggtagccactgctgagctaagagctgaaattgaccaaaattaagtaaaaattatagtttaagccttcatttggaggttacaagcctcctttgatagagtctagagttccaaaatagttatatcaggcagattctgccagtgtgattattttctaggtggggagatgaattcccagtgcttcctactccactttcttcccagaaccctctcttgtaatagttttttacttaaaatctattttgtctatacttttttttccatatatttactttttattgaatttgttaacgttacagagttcttgcactgccaaaccatgcctgagaattcaaacaaatggtacaatggacagcctcatccacccatcatacagtatattaaaacttgattcatctatattttgatattttcacaatcttttaaaaagttataataagagctggaatttaaatctgctgcaggtcttcagattttgagtacagtatgcctttacataacacctccacttactcatctctgttcattcttcagtaacataaaacccaacaacttgtacagccataacttgtacagccattcctgatctgttttggttactttttgcacggaatattctccattctctcatttttcaacccatttgtattggatttcaaatgagtctcttgtagacagcatatatagttgaatcccgtttttttaaatccaatcagccgatttatgtctttttattgggagtttaacctatgcacatttaatgaaattattgattaggaaggacttactaccaccattttggtcattgttttctgtatgtttagagcctttttgtccttctttcctcccttattgtcttcctttgtgttatagttgattttttgtagtgctatgctctgatttccttctcatttccttttgcatatattctgtaggtattttctttgtggttactatgggaattacatggaacatcttaaagttatcttattattttaaacagataacttcaatcacatacaaaacctctactctttacatctttgccccactattaagttactgatgtcacaaattaaactttatatactttgtatccattaacatagatttataattattatgcttttgtcctttaaattccattaaagtattaaaaattgagttattagcaaaaattacaataatacaggttttaatctttatgtatttacctttatattttcatcaggctgagcaactgtctagtatcccttcatatcaacttgaaggactccctttattgtttctttttttttttttgagatgaagtctcgctccgttgcccagactggagtgcagtggtgtgatctcagctcactgcaacctctacctcccgggtacaagtgattctcctgcctcagcctcctgagtagctaggattacaggtgcgtgccaccacacccagctaatttttgtatttttattagagatggggtttcgccatgttggtcaagctggtcttgaacacctgacctcaggtgatccacctgcctcggcccccgaaagtgctgggattacagacatgagccactgtgcctggcccctttattatttcttattggtcaggtctagtggtaataaactccttcagcttttatttatctgggaatgtcttaatttctccttcacttttgaaggacagttttgtcaaatatagtattctcagttggcaggctttactctttcagtactttcaatgtatcatcccaccaccttctggcctgcagggtttctgctgaaatatccactgataatcttctagaggctcccttgcacatgagaagtcacttttctcttgctgcttttaaggttctctctatacttactaccactaaattctacacttaaaaatggtataatctgttatgtatattttgccacaataaaaacattggaaagaggtaccatagaagagtatattacatgcaccataggctggaaaacattttcagagattaggctattctcagtaactcacatatctagttctggtaaacactgattgatttaaacaaatatcaatgaacaaagtattacatgcaccgcgtgcagctaaacagtgtttcgctgacataacactagtacctagatctgataaactatctaaacaggcatcactgaaactatgctacagaaaacacagaatgctaaccacagtatttccaagagtctacgctacacctaggcaatcttgcacctatctctgttaaacacagggtttgaacttggaacaacaaagaatgtagtacctgcaccacacacttcttaaaacagggttttggccgggtgtggtggctcacgcctgtaattccagcactttgggaggctgaggcaggaggatcacctgaggtcaggagctcgagaccagcctggccaacatggtgaaaccccgtctctactaaaaatacaaaaattagctgggtgtggtggcagacgcccgtaatcccagctactcaggaggctgaggcaggagaatcgcttgaacctgggaggcagaggttgcagtgatccgagaccacaccattgcactccagcctgggttgcaagagcaaaactccatctcaaaataaataaataaataaataaacagggtttcatagggaaaacactatgctaagtcattcacaaacctatttctaataaacacagatagtgaacatgcattaaagaaggctatcttagatgagccacaccctgctaaacacatcgattctcaaagataatgcaaggctcattcactcatggtagacctaactgttaaacttaacatttaaatatgtatcacagaagatggtagtacctgaacctcatgcttctaaatggaatgcttcaccaaggtagcattattctcaatcactcatgcatctgcctcacttcagtacggagcaaatatgtatcagtgaacaatgtgccacgtgcgctatacacggccaaacacagtggctcatacagttaacacaaggtgtggtcaatcactgacagaatgggaatgaggaatgtgtcccactctctcagctgttgtattatatcatacaaggtgcagtgactacgttcattcatgaacccagctctcttaaacacagaaattaaacacatatatgggatacagcacacagtgtgatttgtgtctgcacctccctcgtgcatgttgtatatttcatataatgtaggtacaaaatgtaactttggtcttcacccgcatcagctatcatctatcacaggttacatagcgacataatacaactcagttctgcatccccctctgctatcatatggtatcatgtgtgacaatgtgacccgaggtgaataatgactatcccctctcacctgctgtatggtgtcataagtgacatttgtgactcacatacactgtgaatcaggcccacaacccttctgtcagttgttgcatgatactgtatgtgccatagtgacataatgcaactgaggtctgggctccttgatgtcatataatatcataagtgacatggtgtgaacaaggctgcctccccctcttgggttatcattggctatcatataggacatagtgatacaaagtgacaagtgtgtgtccccctcaagtgttatatatcacatgtgacatagagtaaggtgagcctgagtccttctcttggttgtcctagattattttattttatttttttgagatacagtctcactctgtccccaaggctggagtgcagtggtgtaatctcagctcactgcaacctctgcctcctgggttcaagcaattctcctgcctcaggcgcctgagcagtggggaccacaggcgtgcaccacctcacccagctaattttgtatttttagttacacagtaacaaatgtgactgaggtctacctgcgctctcagctgatgctggcacctttattgcctaggtgtttaatgcttctcaggtctgcatcctatctcccgtcacacactctcatatgctatgtaggatgaggacacagctgacacacttagtcactgcaccttgtatgatataatacaacagctgagagagtgggacacattcttcattcccattctgtcactgtaacatagcatatagcagctgagaacggggtacatccctgactcacatgatgtcacaatgtcacatatgatatcataagtcatccagtgggctaggcacggtggctgacacctataatccccacactttgagcctgccaaagtgccttttatgtgcctttcacataaagactatgacacagctaagctattcatgtactaataaatacctgacctgagctgtgtgaccacagacaccaccctataatgtggccagtgtgtaggaactctgcaggctcagatcattccagacatacatgcagatgttggaactcccttgcacagtgactcatgatcccaaggctgagtgctgagggcaggtcagtagttcagagcctcagcattggggccgtatgcttgggttcccatcttggctcccacactttgggagcccgaggtgggtagatcgcttgagctcaagcattcaagaccagcctgggcaacatggtgaaaccctgtttctactaaaaatacaaaaatttgccaggcgtggtggtgtgtgtctgcattcccagctactcaggaggctgaggtgggaggatggcttgagctgaggaagcagaggctgcagtgaactgccctgctgagagtggagctcctgctcagctcctaggaaggcaagagccagcaaggccactgcccaggcccccgagggttctagggggtcccatccctgggaaggtggaatctgggaggtgagggggacctaggaccccattgtgtgcacagcttgggctaaggcatgagataagaccagggtgacagtacaggagtatccaagaactgacttcacctaacttctgcatttgacttcccatccccaatgtgggtagggccctgccctctggcgattggaaagaggcgcagggtgcaaagaagtcccctcctctgacctcctgcagggctccgtcttggcctggatccgcaggggggcctgggcaggagggaggctgtggtcttgggatggggtggcagttccaggcccacagtggggcaagagacatcctacaccttcctcccatccttgccccgaaagtcatgagcgctggggttcaaggtgccctcactatttgacctttcttgctggtggctttggtgtgtcattctggtccccagcctctgtttcctggactgtaagtggggataataataggtcacccctcccctgcaggattaacctcagcgattgttgctggcatcagtgcagccctgggaccacagcacacctgggtgagtttggagcgctcgcgctcttcctggtggccctgcctgggcaccgacccctcccatcctctcctcaatagccacgcccctagcccagctagctaatgaataaatatgtagtagccaggccagcatcttggctccgaggtctagccactttctagtccttcctagctgcggctgccactgagccacgcacgcccctggcatcatgctcgccttgcagtgcagctggtgtggcgcagactctgagagtgagcaccaggactcttcccgtctggtctccaatctaccctcttgccatgctccaccaccccttaggtcttgccactgggagtggggagggactggggagagaaaatactggggtaggggtgacaggagagaaggttcttcactggcctcccctggcctaagcccctggcctacttcattcttggaccccagctgatgggatggggcttggagaggacccagatgactggtctctcagctcagcctcctgcccactgtctctataggtgcctggtgctacgactcccaggaccccaagtgtggtgaggacagagtgtcatgtgaggctgagtgagatcagtctgtgtcctgggaccaccagagcatgtgccagtggtgcaagagtggccaagagacagtctgcaccctgcactctgtggcctttgcaggtttctgtctgtagtcgtctgccccagtagactgactgggcatcaggtgcaagtgcgtgactgtccccctgtgtgtgagtctgggcctgctgtgatcgccggtcccgagtcagtcaaggctggtgtgcctgttactgtggccagcccaagtgtgtgcaggtgatagaggtcccagtgtgggtgtgcaactgtgtgccagagactcttttgccttcatctcaccatggggcagccaaccgggagactagatggataggccagatgcagggtacaagagaagggggatgctgtgacctgttcaggtgtgggggaagcagggagctgggtttcctgaggctgggctatcctctgggtgtatgggggccactctctgctgcacccccaggctgcctccctgaccccacccccaccccaaaggccccagtccttgttccagcagtccccacccactggaagaagctggcccctgcctgtgggggcccaggccagtccctcatcgacattgactttcacagggtccggcggaactctaccctagggcccttcatcttccgaggctatgactcagcacctccaggcccttggaccctggagaatgacagccacacaggtcagcaccctgtggtcaggacccctcctaggcaggagcaggagccccacacagggcatgagagctcctgagtgtacacagggaccaggaccccctacacacgggagctgagacatcctacagggccaaaaaccctccacaggggctagcttcacaggaaaggagcatcctcacacagcagtccagatgcgccctctgtgtaggtgccaggtcccaccctacaaatcacaaccagccatggcccctgaggaccaggagtcagggtctctggcagggccaggatccctgaccacacacagctgggctcagagccccaccccaggagggctgccctctgccttcttccatgccatgctgggtgtgtgggggagggtttcccctgcagtctgtggaactctgctctgctgaccagcaggagccatggacaccatgggttccattccatggaggcaatggggccccactggggagcagcctggcctgaggaagggcctctgctcgtaccctgtgctctaatggcacaaggtgggcaggtggtgaggtagagagggtgtcgtgtgcctcctccccttcattgctactctgaatggacactgatcctcagaaccacctggagatttgggaggctgggctgctgttgcctgtctaccgcgcactgcggctgcacatcagctgggggcggggggggggcccgaggcgagcagactcagagcacagcctggacaggcagcgccaggctatggaggtagacttgggcacaaggtggggtggccggagtgctcccacggagatgagagagagcaaggtgggggcagctgggtatctcccacatctgtgcctacccccagatgcatgtggtccacagtaacacaaagtaccagagcatggaggaggcaccacgccacggtgatgggctcgagtgcaggccctgctgctggaggtgctgctggcggtgaaggcagggctgtgattctatgtatgtttccaaaaaaggggtccatggggatcctggaagtggacaggctaggcctgtggagtccatggggggatctctagggtctataggatctgtgggaggatagggcggtgggaatgcctgaatcggcagggccagtggcggcgagaaccctccaccccatttcccagatgccagatgcctcctgccactgggagcctcctgcttagagtatcccagctgagttccctcttcagagactcccccactcagaaccccttgcacttggagcccctcccaggagcaggactgtagcaacaccaacttctgcgccatagtgtcgggcttgaggaaggtgcctgagccaggtgaggagccaccgggtcgttttccggctcaggggcggggggtttgctggggatggcaccagcagggcacggggaggctggttccaatccccctccctctgccgcctggggctctcagtgaatctgatgtccaccttcctgctggcgtcgatgcggcccaacacctcgagctactgtcgcttcgctgggtcactgaccccgcctgactgcgagcccacggtgctctggaccgtcttcgaggaccccatacccatccggtgggtgcaggtggagccaccgtcccccctcgccccccacacccctccccgggccttgcctggctcctcccgcaggcgctgcccctctcccaccccgttttgatctctttgccctgcaccctcagatgaccctgttccacaccgtgccccaggctggaccctcccactttcaccccataccgctcacgggtaacttccgcccacagcagcctctttttttttttgagacggggtcttgctgtgtcgcccaggctggagtgcagtggtggaatcagctcactgcaagctccgcctcccgggttcatgccattctcctgcctcagcctcctgagtagctgggactacaggtgcccgccatcacgcccggctaattttttgtatttttagtagaaacggggtttcaccgtgttagccaggatggtctcgatctcctgacctcgtgatccgcccgcctcggcctcccaaagtgctgggattacaggcgtgagccaccgcgcctggcccacagcagcctcttaaggggcacacagtcttggcctcccccagagcctcggtccccgcagcagccccccgctcttcccccaccctagcaggtgtgcactgcgctctgatgcgcctggggctcagcttgtggttctgtcaaccgtgggcgaccctccgtgtgaaataatgaaataatgcacagagtgaccttagcctaatgtggcctggagggggtgggtgcgtgacccggcgcggtcccccactgcaagaggggcatttcctgccctaatcccactgaggcctcagtgtgcctgtctgttccgtgggagccctctgagtgaccctctcctacctcagcagaacccgggcctctccaggttcctctcagagggagaagggcccccaccctcatcctatacattgtgtctgaatcccctggtcagatggaaggagaacatctagcagtcagaaattccaccattaggccaagattacattattttattttaaaactaagctgggtggccaacccagggacaccgtgctctgctaaatgatgactccagctacatttcccgaggccaagagatgagaagctgctggctccaggctccgctgcaggctgccctggctgagcgggtgctgggcaccgcggagcgctgcctggtgctctgaagccatgccccagtgcctccctgggagttctgctgtggagtctgtgtggagggtgactctggagagatgtttgtgtcccggtggctgcctgtggtctggctaagtaaaggggtgagtattcttggtgtcactgtccaaagcaaagttgtgtccacgggacacagactaggtgaggctctgtgtccaggtgatgctgtccagtgagagggggttgcagtcagagtgaggctgaccggaggccgctgtccaattggtgccgtgtggaatgtgattacatactggttgacaccgtcctgagggccatcaccagctgcgtgtctcagccgccctgtgtccctgggttctgtgcccttgtgtgtggtttgacactattccagtgcgtggagaccctgcctcgtcactgagaccttgaaagaaaaagaacgtgcagtcaccccaaggaagaggagtctcggctgttcccctggaggctgacccagccctggcccaaaggctgacccagacccaaggcccaaaggcccagctctaaggtccaaaggggctccaccctgttctctagccggactcagtctctcgcaaggaccccggctcccatccgcactccccagacgcacgtggcccaccctccgcccgtcccgcgcccaccccctccctccagtaccggagccctaactggcggcacccgggcacccttctgactcagagccacgctacacgagggggaccgatctgctcacttgccccgtcctgggggtaccagagtagccagcgcgacgccttccgcacctcgcctaggctgcccttgtgcggccgccctcagtccccgccaccttgcggggccccaggcggcactggcatcttcttgtggttcttcctggccggggctcggtgcgctccgcattctgctgggccgtccggggcgtcgtctgcgggcctggaggcggcgaccagggcgctcacggtgccgagcgtccgcagcagggtcgggccgcggggcgcggcgcgggggacggcgcggggctcgcggcgggcaggcggggacggcggcggcggcggcagcagcgcgcgcagagcgtccagctccgctcgaagctccgcgcgcagcgcctcaatctcggcgcccagctcctcgcgcactgccgcgagtccctcctgcagccgccgctcgctgacctccaggacccccgccgggtaggtggccctgccgcggggctccccgcatactgagcacacggagccgcggctgtgcgcgccggtcctctcgcccgcgcccgccgccccggcccccgcacgctccaccagcttcagcagccgcggcacctcggaccgcgaagccgcttcggcccggagctggcggagcaggcgagccagccggcccggggctcgggcgtcttcccggcccggcccattggattgcggccccgggtcccgccggcggcccgtgacgcgccgcagcacctcgctggctctgtacgcactacgcgcctgggcccacgggcggccgggcgtcgccatccgccctgctgcctccaccgccgccagcgcccgggatggccgggagccccaggctgcagcctagccatcgctggggcccaggcgacgcaccgtggagggggcccgcgggacggctttgggaacgaccaaagccctgggggttccggcctgggccgcagggaaccctggcagggctgggtcccgggcagcccggttccccggggaccctgcgggaacaacgacgttgtgggcaggtcctcacaaagggcatggcccagtttctgggcataggtgacatggagcatcgccagccaaagaccaggcaccacccgctagacacgagtcaggaactgagctcacattttacactagaagctactgtctccatcatagtcaagggaaggccaggagtggtcatggaccccacagcccttttcaatggctcagggcgacgtccttccatgtagtccaggccattatctcctcaccctgtcccctagtccacacagctggaggaatccatccaggtggcatctccagccccaagctgctggtccttccatgcgagctcttcagggtctcccttactctccaaggtggcccgcctagggcctctggaaatccctggccatctcaagctgggttttttgttttgttttgtttttataaacaggatcttgctgtgttgcccaggctggagtgcagtggtgcaatcatagctcactgcagcctccatctcctgggctcaagcgatcctcccacctcagtctgctgagtagatgggactacaagcgtgcaccaccatgcccggctttttttatttttatttttatttattttattttatttatttatttattttgtagtgatagggtctcactgtgtttcccaggttggtcttgaactcctggcctcaagtgatcctcctgtcttggcctcccaaagtgctgggattacaggcatgagccaccatgtccaagcctgtctgtgtctttaacctcctctaatccaacagtcttcttcatccttctgggtctttgcacagttcctctccccccaacccctgccattttcctggtggctctcacttttcccacttagatagggaaatgttccatgaccaccccatcccacactggggacctcgagcccctcctccacagcacccttcacagttgtatttaaatgactctgttttccatccacccactgtggggtctctgagcccagggctgggtcatttctcctgggccgagtgtggcactaagcatgctgagtgctagcctgcacagaggccaggcccgggtgggccccaggacacagctgtcagtggctgtcttgccatggagtgagtggatgaatcagcagggctgggatcctctcccattttacagtaggaggctggggagaggagctggccagcccctccacctctgcagcctggcatctgaggccctcatggcatccctgctggtctgccttcccctgcagcccttccaccctctgtggagccctcactactgcaccctactccttctcaccccagtgcctctgcataagcagtgctgcctgtggccgccacagggccctaggtatgggcagagtagtatcccccacacagcatgctgttctccctgtacccccaggggctagttagcactctgggtgccctggaccctggggcctccctcagcaaattgtggagggtggcctggcatgaatccaggcaggtctgggaagggacatggcaagacagcccctggaagctgtgtccccgggtccactggggtctggcccctgcagatcagtgcatgtgtgcatgtgttgggggggggattgaggggaccgctaatactgtcctcaagcagctgctgaggagaagactgggtccctctagtcatgttcatccactcaatcactccctgcagctcgtctccctggaaggtgcaggaggaggtgagaattgggcactctgtcaacccctcagactcccccattcctgctgagtcacccgtcctctgggacctccagcagctggctctgctgatccctagagcctcattagccattctctccctccccccagtcattaaaacactgccaacaagagcgccctgggttcttttccccagccctactggagacgggctgtgtgacccaggggctctgccctctctgagccaagtcttcacctgtgaaatgaagagatctctgaggtccccaggaggagtgacagggaggcctggatggtggcgaaggtgcaggagagagtccagatttgcagaaagagctgttagttttgtgatctctgcctggaggtctatggacaggctggaagagaacctgagccattgcaatgagtccagattagggcttgttcctgcagaggctacagatgtgggggctggtacttatggcagagggtcccaaagtcatgggcatagagaagacaggttggcaggagcaagggcagaatgggagcggggtcctggggaccctgttgggccctgaggaggactgcagaggtgtcggtgaggggtggacaggcaggcgtgtcagcacaaccctgagcccctgagctcaagtgcagggatggccgtgaagcaggtgatggggaccctggcttgagcttcatcggtagcggggctggggtggacaccggggactggcggagaggagatggggtgggggctggtcaaagcagtgtgtccctcagggaacgtggcagagcggggcgcgcacacaggtctgctctccagttcctccgggaagttcctcaaattcagccagctccagctgcccctggcacagaggagctgactgaggctccagtgcagggcctgctccttcccctcctgttcccctcagtgtgccctgggccgggggccaggcatggtgggggtggggaggctggctgtgcctgtgggaagccaccggctcccggggctgtccctgggcccaggctgtagctctgtgcatgcagacgtgcaggctgggtgggcaactggccaccttgcccgtcagtaatgcattcacagtggggggtcagaggaaaccccagggctcctctgcttagcttggccaggggtcccgatggggcagtctctccgtgtgacttaattgtcatcccttttgtgctctatggctattaaataaaacttggcagccaccttggctggaggttttatgtcccagagcccaagggcggttgggagccaggggagcgctcagacggcagggccaggcgagctctgtgtgtgggaggggctgtgggggcctctgagagctgctgcagggacccggcagggcgggggtggaggcagagagtgtgactgtagcttcacagtcatcagagtggacgtggagatgcaggcagagtcctcgaagctggctcaggggtctgtgtggggagggggcacacccagcaggggcctgagggtaagcaagggaggcagcagggtcttggagctgcctcccaaaggtggtggggagccccaggaagagcaaggaacaggagcagccggcaggtgcggctgatccaccctgaggtcccggacacactggtggggacaggaaggctcatcttggagctgctcctggaggggccatgtgggtcacggcccctggccctctgctcagaccacagagcacaggacacttgtccagcctttgctgcgactgtgctgcttgctctgggagcagctgctgctgggcctttggaggaggaggaagggtggcctggctgggacccagcccctgtgcccagcctcttagaaggggaggtgatggtccttttaggccccaggagtgcaggctgcatagtggggcctctgtacacataagctggcaggtctggcttgggctttgctcaggacactgggtactgggttctgggttcagaggcctcatgaaaacacctagcctcagtttcctcatctgtcaggaccagcggctggctgggagggtgtgtgttagcatggcagcggccagcttagtctactctaggagaccttgcctccccgacccctgagctgacctcttctttgagagcttagagaggagaatgacttgttccaggtcttactgcagggtctggggcttcctgtggggactcaggtgcaccttgtccctgaatacccctgccttgcccactaggccctggaactgtgccccggcctcctgtggcactggctagccagatctctgggaaccgtcccagggcaggtggctctgcaggaggccaaatgattacccagcaatggccttgcctgatgtgggtaacgagctcattacctggtgatgaccttgtttgtctgttcctggcatcaacagcctcagctctccctgcaaggaatgtctagcctggggtgggtctgaccagtctgtgccacaggcaccagcatcccagtctgcactgcatggggtgtcgggcctgacagcatctacctatatgtgccctgagggcccagactcagcccccagtgggaagactccaggctcctgacggacccctcccagttgtacaacctgagcaggtaagccctgacccactctgggcctcactctcaccaagctggtgacaaagattctctgcttggtcaagctttatttaggctcctgagccttctcctaggcacatctgagcacttccttataaactctagttttagcaagaattctgcaaagtcagtttagcgagaagccccccgtccttgacatctgatcgggttccccctctgtcccccaggtgcggtctggccatcctggccggccttcagcaagaattctgttaggggagttaagccagaatccctggctgctgatgcttcctcttagtcactttccatgcactgccccccaccctgctccttgactgtccgatcccacttgcccatgctgtcttcgaggctgagcccagtctcttacccactgcagaatctcatcgccatggtcccttatgcctagtgacacggtcctggatagtcttccccctgctccttgacggtccgatcccacttgcccatgctgtcttcgaggctgagcccagtctcttacccactgcagaatctcatcgccgtggtcccttatgcctagtgacacggtcctggacagtcttccctacggcgctttggcaagtgtcatttttctttttttcttttctttttttttttttttttttgagacggagtctcactctgtcaccaggctggaatgcagtggtgccatctcggctcactgcaacctccgactccctggttcaagcgattctcccgtctcagcctcccgagtagctgggattataggcacctaccaccatgcccagctagtgtcaattttcactgaattatttttttaacagtggggactaaagagggtccgcaagcagggctgctgctgggcaccatggagggccgcctggcgggacatgccccaacctacaggggtccttgagggctccccttcccctgccagctgggctggggtctctgtgtcaggagtgtcctcaccaccacctggggatggacctccactgtcatcctagggaaggggccagggaggggagtctacatgctgagcgggcctgtccgaggcctctgctatcccaatgcagcccccagtatttagacctgcccccagtgacctgctccctcttgcccatcattccaggaacttcctgctccacgcctgcgcacatcctgtccctaggccggctccccctgctcagcctcaggacgcagccacccaccctcccaggagcgccttccctgcccctgtggcttcctgctggcactctctgcactgggttcttcctcctggtgtgtggggccctagtctctgtctcctgtcgggtttgacttctaccagagcagggacctccctgagtcctcatggcccagaaaagtgcccagcatgcagtaggcgcatcataaatacctgtctactatcatgtggtgaactgagtgaagacatctcattaaagatgacattaaagaatagggcatagggcttggcattcagtaggcacacagtacatgatggctttgttatttccagtctggggttgtgttcatgcctcagtttcccacctggcctgataggaggggctcagctgctgggctggctgtgtctctgtgccccttgcctggaaatgcctgacgaggggcagggtcctcatcccagccacatcccaggggttcccagccctctgaccttgaggagctgtgggaggcgaaggctgcagccaccctgtagcactgcaaacacaggctggggcgggaaggggggtacagagggtgtgcacaaggggcagggggagggagagggcgggcacaaggggcagggggcagggacatgtccccacgcccagctaatttttgtatttttagtagagacggagtttcaccatgttagccaggctggtcttgaactcctgacctcaagtgatccgcccacctaggcctcccgaagtgctgggattacaggcctgagccaccgtgcctgaccaaaaatgattaagtattttaaggcagccaccacagagcattaaacaagcccctagagctggccccgcccccgaaggctccaggcccatctgtcttggggatgcacaggttccagggacccaaacccacccttcacaactctcttcccctcccagcaccacaggggccctcctggcccctgggacctcccatggagcaggctctctgtccaggatggagatggggaccctcctcactgccctgtgcccctcatgggctggacacacccaccacccaagaagaaaggcctaaagggctgggcactgcccttttggaaccagaggcttggcggccccatatgggtctggctgaacccacctttggggggctgagatgagccagcctcagttactcagctgacggcagggcctgtggtatggagcttcccagactgcacacctagcccctaccggacttccatcgtctccagacacgcacagcaagggttcccaggccagaaacaggaagcagcagctctccctcctccagttcctgggaactgtctcagacgaaccacccggagcctcacctacaggaggatggacacctgcacccagtgctgtagggagcaacctcagccctgggcctgggatgaatgccctcgccagcctggggccaggagacaggctctccgtggctcagcgcctgagcatccacttacaggacactcacctgcagaggtaccctgagcaccgttgtgggttaagggactttctcccctctggaaacagtcctgagaagctgaaggtcttgggggcctctcaccaaatgtctttgggaggtgggaagacatcaaatgcgggtgtggcttccctggaacagctctgtgtggggactcaggagccaagtcccccagcacatgcctctaacactttcagtaggggcccacctctctggagccatgggtggctgccaacaccctgtggttcccagcaggcaccacccaggcaagagagagaacaggctggggaacaatgggctggcctggccgcaagcgctggggcagatcacagaccagatggcctaagctcatgccctggggccagctctgactccctgcaagtgtggcaagggtcccttttggacaccttgagaagctgcagctgggagaggaccacccgcctgtctggacgtccagcccaggtggcagggcccaagtgaccagtcccaggccacagcccttaccacccgccctggctgcaggggctcccagaagccaccaagggcctggctcggccttgcctgtccgcatctgagcttcagtttcctcatctgctcaagaagggaggtgaacactgattaaattatgcaaactctgagcggcaggattaggtgtggctgggacagccaaggcttccctgggtggtggcatctctggagcccggggatgggacctgtctcccttcagggcccccagctgggcacgcacctgccccagtccctccctgcaactcttcctccatgccagtccctggaaatgtggccctgccgtgggtgtcatggcccataggagatgctttgggcccagcacccacagcccctcgcagtgtgcacccccacttccctttccccactgctgggacacctgcttgaaatgtccctcctccccccagaaaggaggggagcagccctggccttctgccctgagggcggagctctctttggggtctcaattgcagcccctgggagagtgagaagggtcaagttcagaccctgcaccattccctaccaggcctcgaatgggactcttggcagctgtatcccccaccccagtccaggcaagcaaaaggggttcttctgcagtcttcagggcccccagaaggcgcactgttcacagacaccctggggagccaagagaggtcgagggctccagctaccgtggccctctgaggacccccgcctgtgggatagaggacttggtggctgaagggcagtcatgcccagggggcttctcctgaccctgcagggctgagcgggtgcagccttttgcctcttctcgctgcattctagcccatcagtcagggcaacagccagatggtctatgctaagattcatcccatccccacgggccctgtgactttctaccatatcaacgtggtggcctgtgcagttcccggccagcattttcctggggatgctgctgtctaatgggctgtgggagaaacagagacaggccctgcacatggggcagccagtccagcacccgccaggccaggccctcagcatcctctcctccagatgcccaagagagctgctccatgcgctgtggcgccctggacaggccatgttcctgccacccgacgtgctccggccttggtacctgctgcttggatttccaggacttctgcctggagatattgccctactcagtctccatgatgggcggcaaggactttgtggtgcggcacttcaagatgtccagccccacagacaccagtgtgatctgcaggttgggaggcccaggaggccgggcactggggccccacgcccccatccctgtgcatgctgagggctcagacccactggcaggctgaatggagcccctcagacccaggacaggcaggagggcacaggacagctggttggatgggttccccagggaggttgggggcccagactgtcgagatgctcagcctgcagtggcccagcacctcctaccaccaccaggcccacaggtttgcatgccacaggagagcatccagaccctcggccatgtggactcctccgggcaagtgcacttcgtgtcgcccctgctctatgagagcggccacgtccccttcaccatctcactggacgatggccactccttccctcgtgcgggcacttggctggctggtgagccctcctccctgcccacagcctgcccccacggggactttccccagcgctaatctatgcacaccgagacttggcccgtccgtgtcctgcctctctggctgaaccaatcccttgggaggcctgcccgcctgcgagagttccttcagctcctttccactccctggcatccagaccacggtcccagcccagagtgagtgggagctgcaggggtccctagagaggtgggccagtgcctatccactgagctccgccacaccagggcaggggagaagccaggtggaggctagaggcgtgggcagtggagggagggcaggcccctgcctctccggcctcagcgtccttttctgccatgagggccggagagaccatcacccagctgctgccatgcattggccctggaggctcccacagcccttgaagcctcagggcctcctccctgcttccctgggcccagccctcactcacccctcacctcccctgcccagtgcaccccaacaaagtgttgatgaaggagaagagtgagttgatgaacgagatgcattggcaatactacggcaccgccaacacctcaggcaacctcagcctgacctggcacgttgaggcgctgcccacacagacaccatcaagctgtggggctatgaggagacaggtgaggccagctgagggctagggtggcatccagagctttgggcccccagaggtgggagaaagggagtcccagctgtgtgggaggaggaggagagtttccaggtggggttgaggagggaagggaattccaggcggagattgaggattcggatggagggaagtgcaggccaggggggtcaggcaggtgggagggggcagctgcatggggcctgggtcccggggaggaggctcatgaggaacccctcacggctggcatggccctgggcccggcttccagcagggacagggatcctggagtgtggcaggaggtggtggtcacccaagccagggtccctgctagaacagcccctcctaaggggaccgcctggcagtccatccacacatgtgtcaggctgctctaggtatcaaggcctggggccaggccttgaaggagccccagggctaaccaggccttctctccctcaggaatgccctactcacaggagtggactgcaaagtggtcgcacctgtaccccccagccacacacatccccaactccggctctttcaccttcacccaaaaacctgctcctcccagctaccagagatggcgagtgggtgcactttggatcatcgacaacaaaaattacgcagggcaggctggttacggtggctcacgcctgtaatcccagcactttgggaggccaaggcgggcggatcacgatgatgtcaggagatcaagaccatcctggccaatgtggtgaaacccagtctctactaaaaatacaaaaaattagccgggcgtggtggcgggcgcctgtagtctcagctgctcaggaggctgaggcaggagaatggcgtgaacccaggaggcagaggttgcagtgagccaagatcgtgccaccgcactccagcctgggcgacagagcgagtttcaatctcaaaaaaatgataaagaaaaaaagaaagggcacatccactctatggagttctccctcaaatcctgtaaccctagtcttatcatgggcaagcatcagacaaacctaaattaggggacattcaacaaaataactgttcttcaaaagtgtcaaagtcacaaaagacattgacagactggggagtcaccacatattggaagggagtaggagacacagagattaaatgccacctggtgtcctgggttggatgctggaacagaagcggggcatgtgtgggagacctgggaaatccagacgaagtctgaagtttaggtaataggattatatcaatatctgactcagttttgacacatcagcctggttactgcagatgttaaaatccagggaagctaggtgaagggtatatgggagctctgtgctgtctttgccactctctgtaagtctaaaaccatttcaaaagaaaatgattgaaagttgctaggattctctctctgttgctgcaccttatccgtggaaacctcgtttcagggatgatgcagtgtgtgattgcagtcgcggacaaaatattcgatgccttcctgaacatgatggcggtccagaaaaacagatacacagggccaggcgcagtggctcacgcctgtaatcccagcaccttgggaggccgaggcaggtggatcacgaggtcaggagatcaagaccacagggaaagcccatctctactaaaaatacaaaaaaaaaaaaaaggccaggcgtggtggctcacgcctgtaatcctagcactttgggaggccgaggcaggcagatcatgaggtcaggagatcgagaccatcctggctaacacggtgaaaccccgtctctactaaaaacacaaaaaattagctgggcgtggtggcgggtgcttgtggtcccagctactcgggaggctgaggcaggagaatggcgtgaacccgggaggcggagtttgcagtgagcggagattgtgccactgcactccagcctgggagacagagcgagactccgtctcaaaaaaaaaaaaaaagaaaaaaagaaaaaattagccgggcgcagtggcgggcccctgtagtaccagctactcaggagactgaggcaggagaatggcgtgaacccgggaggtggagctttcagtgagccgagatcgcgccactgcattccagcctgggtgacagagcgagactccgtctcaaaaaaaaaaaaaaaagaaaaaaaaaagaggtacacaggcaccacctgcccccaaggagctcacagcatcttgaagaggcaccaaggaaaacaccagacggtgttgagggtttgatgaggtgtgggggctcagaggaggggcctcgcagaagctgggggaggaaccagggatggaaggagttccccagtaggcaagaggacaaggaaaagaaagtgcctttgctggggcaggaaatgggcactggacacttatacccttcattggcaccatagagcagtgctaacatgttccatttgataggagagaaaactgtggccctgggagaagtggcccattactaggctaggagctgggtaccaggaattggacctcatctagagcatgcaggtgaggctttgcctcaacctccctctgactacctgaagcctcatctcccacatccctcgcttcccacaatcagtgctgtgccacatcacaccccccactatgcccaggctgttccctctgcctgtggtgcctttgccattccctcccactacactccccatgtccatcgtggcagggactcaatttatcatgctcccttaggtaagctgacaggaagatgctgctggacccctttgattttttttttttttttttttttgagatagggtctggctctgtcacccaggctggagtatagtggtgtgatcatggctcagtgcagcctcaacctcctgtactcaagttatcctcccacttcagactctcaagcagctagaactacaggtgcacacctccatgcctggctaatttttgggaaaaaaatttatagagacagtttgtctctatattacccaggctggtctgtaactcatggactcaagaaattctcccacctcagcctcccaaagtactgggattacaggtgttagccaccacacctagcctggacccttctgagtgcaaaggcagcacccagcatctctgtgactcccccaacagcccgctgggtcagaactgctatcaaccccatttacagaggaaaaaactgaggctcaagctgttcctcagcttctcagtcatctggctggtcagaggctcaagcccaagtctgttcttgaactgtgagggccagaccaagtcctgaggggacttagataacctaaaggactccctctttctttcctttctccctcccaccttccttcctttctatcctccttcttctctcttttccttccttctcctttccaccttccttctactccattctctgtgcttagtgaatgaagaaattaacacattacttggcccttgtcctcccctgtctagattgcatgcttaacaaacatttgatgaaggactgtcctctgacctagagctatggccaaatgacagaacaaatggtcattgctactcgtgcctttgggaagtgggcaaagcctcaagtttcaggctgcagaggaaggagggtgattgaaatagatccagcccgggagcggtggctcatgcctgtaatctcagcactttgggaggctgaggtgggcagatcacctgaggtcaggagtttgagaccagcctggccaacgtggtgaaacctcgtctctgctaaaaatacaaaaattagccaggcgtggtggcatgcacctgtaatcccagctacttggaaggctgaggcagaagaatcgcttgaatccaggagacagaagttacagtgagccaagattgtgccactgcactccagcctggatgatagaacgagactccatctcaaaaaaaaaaaaatagatctaaagggaagagaaatggagatgctacaagacagaagatacgtctgtcctggcagcagtgtggagctgggaaacagagacgctgacagcagcaatggggatctcaggaagcagtgcctgcttgttcaaaggctcagggattacagtaacactcaggctgccagagccagagggcaagaccctgcaagcaccagttcagagcccagactcaggtcacacagacctgcccataagtccctgtgtgaccctggacagtttccttctctggagaggagagtgccaggctctctggctatggggaggattcagcgatgaggcttgtaaagtgcagatgggaaggggctgaccactcgctgcagaggcacatgagctggggagctgggccagggccaccagggcaggaagccagcccagtaggccagggggccccagccagagagctagaagctcgcaccatactgccctcctggcccaggaagatgtggaccagccaggcaggctgcagggcccaggaagagcagcacggtccctctccaggtatccagccccatccagtgctgggggatggaaggaactccactggaactcagcgggttagggtctggccaggtgaccctccctctctgagctccagtcctccctgcaccctcaaacgagggtcatgataggacgggaaaatatcagtgcaagaagggatgtgagtgccctgagggtggtgggcatgggtgagggctggtacagatagccagactgcaggaggctgggggtttgcagctccagttcccactgcctgaaatcgcctcccagctcctctggcagccctcactccctctccttcagctctcagctcttgtgtttcctccttgcctcatgcaggaagcctgctctgatgcggctcttctccccatgagcaccacattcctcacccagagcactcgcccaagcgccaatgttactacattccattgttgtttgtatttaacctttgcattctcccccaaactgagccctgaggaacccagtttgaaaaccattcatgtaatccatcactttcatttattgtttgtttgtttatttatttatttattttgagacagagtcttgctctgtcacccaggctggagtgcagtggcacaacctcagctcactgtaacctccacttcctaggttaaagcaattctcctgcctcagcctcccgagtagctgggattacaggcaactgccaccacgcccggctaatttttgtgttttttagtagagatggggtttcaccatgttagccaggctggtctcaatctcctgatctcaagtgatccacccaccttggcctcccaaactgctgagattagaggcgtgggccaccatgtccagcttcacttttatttcataggtgagaaagctggaccgggagagggtaggagcttggtgagcccatgctgggacacctgcctcccagtctgcagctcattctcatagatcatggactgtcaattccctaaggacagcagccacatctggcctgtctgcctctgtcttcttcagtcctgtatttactgagcacctatcatgtgccaggcactgttctagacatggaggagacagcaaagaacagacagaaaacacatagaaacaaaaataaaaaatatgtggctgggtatggtggctcatgcctgtaatcccatccctctgggaggctgaggtgggaggatcactcgagattaagagtttgagaccagcccaggcaacatagggagaccctgtctctacaaaaaaaaaaattaagtgttttttgtttttttttttttttgagacggagtctcactttgtcgccaggctggagtgcagtggtgctatcttggctcactgcaagctctgcctcccgggttcacgccattctcctccctcagcctcccaagtagctgggactacaggcgcccgccaccacgcctggctattttttgtatttttagtagagacggggtttcaccgtgttagccaggatggtctcgatctcctgacctcgtgatccgcctgcctcggcctcccaaagtgctgggattacaggcgtgagccaccgcgcccggccaaaaattaagtttttaataaataaaaataaaggatatggaatgaaaagctgggggagctactgtagcaatgggggatgggaagcttaaaccctcctgcaggctctcaggatggagcccattcccctcctcaaggccaggcaggctccacaaagcttggggctttggtagccgaacagaaatggagccaggccatgccggcaggagaaggatgtgaaccaggttgcccaggaacccagactccatggcccaaaagtcatagactggggttgtagagagagggaaagtggaatacagagctggcgatgtggagccaactgagatgtaagggggacatatcgccttctctccgggtcagggaagtcattacgtactgggatggggtatgtgtgtgtcgtgtgtgtgtgagcacacaatgggcaagaggtcctctaacccaggggttctgaaacttgtttcaaggagcataacgctttattaaaccaaaacccttcttcgaatctgataagtgacacttaagagtagatctgccggccgggtgctgtggctcacacctgtaatcccagcactttggaaggccgaagagggtggatcacgaggtcaggagatcgagaccatcttggctggcatggtgaaaccccatctctactaaaaaatacaaaaattagccgggctcggtggcgggcgcctgtagtcccagctactcgggaggctgaggcaggagaatggcataaacccgtgaggcggaggttgcagtgagccaagattgcaccactgcactccagcctgggtgacagagcgagactccgtctcaaaaaaaaagagtagatctgcccattgaagcaagtaggggcactgtctctccccatccgcttcctgcatacctcctcccaaaaggcctatggtatttctgttttatttatttttattattattattgtttttattttgggggggtgggttttttgtttttttggttgtttgaaacagggactggctctctcgtccaggtggaagtggagtggcacaatctcagtccactgtaacctctgcctcccaggctcaaggtatccttccatctcagcctcccaaatagctgggactacaggcgtgcaccaccatgccaggctaaattttgtaatttttttatagagatgcagccttgccgtgttgtctaggctggtcttgaactcctgagctcaagtgatctgcccgtctcagcctcccatagtggtgggattacaggcatgagccgtcacatctggcctgttgttaattttttttcttttttttttgactcagactctcactctgttgcccaggctggagtacaatggcgtgatctcagctcactgcaacctccacctcctgggttcaagcaattctcctgcctcggcctcccgagtagctgggattacaggcacctgccaccatgcccagctaatttttgtatttttagtagagacagggtttcaccatgttggccaggctggtcttgaactcctgatctcaagtgatccacccaccttggcctcctaaagtgctgggattacaggcatgagtcacggcgcccagcctacaaaaaaaaaaattttttttttttttgagatggagtcttgcactgtcacccaggctagagtgcaatggcatgatcttggctcactgcaacctctgcctcgcgggttcaagcgattctcctgcctcagcctcccgagaagctgagtctacaggcgcctgccaccacacccagctaattttttgtatttttagtagagatggggtttcactatattggtcaggctggtcttgaactgcccaaagtgctgggattacaggcgtgagccactgcgcccagccagcacaggagttttgacctgctccttttcgttttcctttttctttctttcttttttttttttttttttttttgagatggaatctcactctatcgcccaggctggagtgcagtggtgcaatctcagcttgctgcaacctccacctcccagattcaagcaattctcctgcctcagcctgccgcgtagctgggattaggcatgcatgcgccacaatgcctagctaatttttgcatttttagtagagacgggttttcaccatgttagccaggcgggtcccgaactcctgacctcaggtgacctgcccaccttggcctcccaaagtgctgggattacaggcatgagccaccgagcccggccaacctgctccttttctaacctgggccagttcacctctccttagacaagctggtggtttcctgctcccaggaagtcaccaatttatgccaagtttagtgcagacaccccatcagtatagtacattacaatccagaagtcctggatccaagcaagcctcctgcctcagcctcccaagtagctgggagtataggtgtgtgcccagcagttctatatttccaaggaaccctggagccctaaagaacccagtttgaaaccaccactttcaggctgggcatggtggctcatgcctgtaatcccagcactttgggaggctgaggcctgtggatcacttgaggtcaggagttcaagaccagcctggccaacatggcgaaaccttgtctctactaaaactatgaaaatcagctaggcatggtggcaggtgtttgtaatcccagctatttgagaggctgaggcaggagaatcacgtgaacccaggaggtgaagattgcagtgagccgagatcatgccactgcactccagcctgggtgacagagtgagactccatctcaaagaaaaaaaaaagaaaccatctctttcatttaataggtgagaaagttgaacctggagaaggcagcagcatggtgagctcatgcagggactcctgcctccctgcaactcattctcatatgtcttgggcaccagtgatgtgctaagtcacatgcacggatgcaatagggacaagggaaaacatggcttctgctctccccaagatcagagttgatgggggtgacaggcaggtcactggacaatcactgcacaacatgatgagaacagggatggcagaaacccagccctggggaagcctggctttgctcatccactcaaccaacattcccgaatgcttttgacatactttggggcagctgctggatggtaactgtggggttcccagagacccatccaccccagtgtcctttttcttggtgacagcctactctctttttttaattttaattttaatttttatttttgagatggagtctcgctctgtcgcccaggctggagtgcagtggcgggatctcggcccactgcaagctccacctcctgagttcatgtcattctcctgcctcggcctcccaaataagtgagactacaggtgcccgccaccacgcctggctaatggctaattttttgtatttttagtagagacggggtttcaccatgttagccaggatggactctatctcctgacctcgtgatacgcctgccttggcctcccaaagtgctgggattacaggagtgagccaccgcaccaggctttttttttttttttttttttttgagacagtcttgctctgttgcccaggctggagtgcagtggtgccatcacagctcactgcgactttgacctcaccttgcaggctcaagcaatcatttcatctcagctggaaatgcagactgggtctcgctcactctgttgcccaggctagtctcaaactcccgggcttaagtgaccctcccatctcagcctcctgggtagctggcactacaggcatgcaccagcacgcccagctaaaattttttttgtagagacagggtctctctatgatgctcaggcaggtcttgagttcctgggctcaagtgatcctcccaccctggtcacccaaagggctgggattacaggtctgtgccaccatgcccggcccagcctgccctcctgacctgacagttgaggccctactggagactgcagcagggcatccaggctgtgaaaccccacccaccagctctgcctcagttgcccatgtgccctggcaagccagtggctctcactgagcctcaggttctcttccgtaaaacagggctgtgatgaagattctctcaagatagtcctccctgtggctaccatgcccaggagcccagcaccagttcaaggctaaggccatccctgcatctcacctccccttcctctcacatacacactacatctgcctcacctctcataaagaacatctgggctgggcacggtggctcacgcctgtaatcccaccattttgggaggccaaagtgggcggatcacaaggtcaggagatcgaaatcatcctggccaacatgatgaaaccctgtctctattaaaaatacaaaaattagctgggcgtggtggcgcatgcctgtaatcccagctactcaggaggctgaggcaggagaatcacttgaacgagggagttggaggttgcagtgagccgaaatcgtgccactgcatgccagcctggtgacagagcaaaactctgtctcacaaataaaataaaataaaataaaataaaataaaataaaataaaataaagggccatgcgccgtgactcacgcctgtaatcccagcactttgtgaggctgaggcgggcagatcacaaggtcaggagatcgagaccatctctactgaaaatacaaaaaaaattagccaggcatggtggcgggcacctgtagtcccagctacttgagaggctgaggcaggagaatggcgtgaactcaggaggcggagcttgcagtgagcagagattgcgccactgcattccagcctgggcgacagagcgagactccatctcaaaaaaaaaaaaaaaaaaaagaacatctggagccataattcccgatgttcttgttacttgacactgcctaaaggcatgttctgtgggttccggggaaactgatttgaaaaacttgagtgttgtaaaggagggccataagctgagtgaacacagcagttgtgagaggtcccaggtgcttcctggggacagggagacacgacagaccaagaagcaaaggggcctctgatgtgacttcaatatcaaggtcttgtcgggcacagtggctcatgcctgtaatcgcagcactttaagaggccgaggcgggtggatcacttgaggtcagaagttcaagaccatcctggccaacatactgaaaccctgtctctactaaaaagtacaaaaaattagctgggcatggtggctcaagcctgtaatcccagctacttgggaggctgaggcaggagaatctcttgaacgtggaaggtagaggttgcaatgagccaagattgcgccactgcactccagcctggcgacagagtggggccccatctcaaaaaaaaaaaaatcaatgtctcgatgcagactgccaggtatcaggtgtccatccatgtctcccaaaagccacttggcaccaggagcagacaggaagggcaaagaggagccagactgaagcagggcttcttagctcccaagccacacaggtggccaccagtcagagaggcagtgtgtgtgtgtgtgtgtgtgtgtgtgtgtatttcttcagttcagtgtgtgtatgtatgtttcttctgcagctcagtgtatgtgtgtattccttcagctcagtatgtgtgtgtgtgtatgtttcttctgcagctgtgtgtgtgtgtgtgtgtgtgtgtgtgtgtgtgtgtgtgtttcttctgcagctcaggatgcctccaacatttctgctgaagcctcaccctcactcctggcccatcctgaggcctctacctaagatgccaatgagtagcccagacactggggctccagtgtttgtcaccaggtggtacctggatgtgggaggtagacaggccagatggccagtttgggcagtgcccctcatgcctatctggccctgggtccctatgccaccttgctggggagggtcttttcgcttacacctcctctgagccgactctgcgcagtaacacaaatgtgtatcaggcacatcctttcctcaaaaggtggatgaccagttgggtgatcagggctgttagggggctgaagggtcctggggagtccaggtctagccaagttgaggcctatcctgctgcattttccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcgacagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagcggagaacaagcagctgcggcgtgcaggctgcccctaccaggcagacgagaaggtgaagcggctcaaggtaaagcgcgcggagctgaccgggctcgcgcggcgcctagctgaccgcgcccgcaagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcgcgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggagtggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggcgcgggtggaggtgcggctgccacgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccctattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctcccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgtggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggaacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatagaaaaaacatattttagaagttgaagcacaaccaaggaaacatgagcctggctttcctccctctcacttctgcgcattgggtccgcaagggctacagaaatgttttcctggctgaggaagggagggtgcacccttctgctttttttttcctggctgcagtctattcccagaacacattccatcacatggttcccagaactcagattgtgcggtggccacgtcatcattggctggggctcacagtcacagcagcagaggcctccctaaacctccctctcctctagccccacccgctgtcccctgctcctcatgcccccatgctgtgtcccctggcctcacttccgttgccatgttttcataatcctctcaggctctgggcagcagcgctgcccacagtaggaccagatcatgtaaggaaaatactgcaggctcatcttggggctgcactggcgacctgagaacaccttatcctactgtacctgctgcacctcatctgacaccagcttctctgctttgcccaaggtccctaggccctgaatgcttactttttaaggtcagcctggctcaggatatgctagtttggctgcagagggtcctactaagagccaggactgaggagcaaggcccaaaaaactcctctgggccacatcttccccgagggcatccccgcagggaggccgtgtgctgctgagccctttgctaggagtgggtagtcagtgtctcccacatgacgatcttgcttcattcagatagctttcgtagctcactgcttttctgagtcacttcctgtgagggatcaccttgggatggaatttcttttccttttttttttttatttggagacagagtctcgcactgtcacccaggctggagtgcaatggcacaatctcggctcaccacaacctctgtctcccgggttcacacaattatcctgccttagcctcccgagtagctgggattacaggtgcacaccactacacctggctaattttttgtatttttagtagagacagtgtttcactatgttggccagactagtctcaaactcctgacctcgtgatctgcccgcctcagcctcccaaagtgctgggattacaggcgtgagccactgcgtccggccttcttttccacttttttttttttttttttttgagatggagtcttgctctgttgcccaggctggagtgcagtggtgcaatctcagttcactgcaagctctgcctcccgggttcacgccattctcctgcctcagcctcctgagtagctgggactacaggcgcccgccaccacgcctggctaattttttgtatttttactagagacggggtttcactgtgttagctaggatggtctcaatctcctgacctcatgatccgcccacctcagcctcccaaagtgctgggattacaagcatgagccaccgcgcctggacctttcctttttttgagacagagtcttggtctgttgcccaggctggagggcagtggcacaatcacagctcactgtagtcttgagcttcagggctcaaatgattctctcacctcagcctcccaagtagctgggactacagatgtgcaccaccacacctggctaatttggtgtgtgtgtagaagcaggggtctcactgtgttgcccaggctggtctcaaactcctgggctcaagcaatctgcctgcctcaacctcccaaagtgctgggattacaggcctgagccaccacacctgatgcctggctaatttttaaattttttggtagagatggggtcccactatgttgcccaggctggtctggaactcctgcgctcaagtgattctcctgccttggcctcccgaagtgctgggattacaggcctgagccactgcacacagagggcatttctttatttgccccattttgcagaagagcttcctgaggctcagagaggcccctcatctaaggtcacatcatggctcaaagtcacctcctccatagactccccaggctgcccctctgggagggcgggaatgaggggtggtctttatccttctctccctctctttgatacccttttgtttccccacgtccaacaacactgtcagaggaaagacacttccagaatacccaggtaaaaaaaaaaaaagagacaataaggaaaggacactgccttctccggtgtcatcagaaatgattgaaagaggccgggcgcggtggctcacgcctgtaatcccagcactttgggaggccaaggtgggcagatcacgaggtcaggagatcgagaccatcctggctaacacggtgaaaccccatctctactaaaaatacaaaaaaattagctgggcgtggtggcgggcgcctgtagtcccagctactcgggaggctgaggcaggagaatggcatgaacccgggaggtggagcttgcagtgagccgagactgcaccactgcactccagcctgggtgacagagcgagactccgtctcaaaaaaaattaaaaaataaataaataaataggccgggtgccatggctcacacctgtaatcccagcactttgggaggctgaggcaggcggatcacaaggtcaggagttcaagaccagcctgaccaatacagtgaaacactgtctctactaaaaatacaaaaaaattagctggacgtggtgacatgcacctgtagccccagctacttgggaggctaagcagaagaatcacttgaacccgggaggcagaggttgcagtgagccaagatagtgccactgcaccccagcctgggcgacagagaaagactccatctaaaaaataaataaataaataaatcacattaaaaataaacttaattttttttaaaatttaagtttaaaaaagtaggccaggtgcggtggctcacgcctgtaatcccagaactttgggaggccgaggttggtggatcacgaggtcaggagttcaagaccagcctgaccaacatggtgaaaccccatccctactaaaaatacaaaaattagctgggtgtggtggtgggtgcctgtaatcccagctactcgggaggctgaaacagagaattgcttgaaccctggaggtggaggttgcagtgagccaagaatgcgccactgcactccaggctggtgacagagtgagactccgtctcaaaaaaaataaaaataaaaaatcactgggcatggtggcctgcgcctatagtcccagctactccggaggctgaggcaggagaaatgcttgaacccaggaggtggagcttgcagtgagccgagatcgtgccactgcactccagcctgggcgacagagcgagactccatctcaaaaaaagaaaaggaaggaaggaaggaaggaaggaaagaaggaaggaaggaagattaaatgtcaatggctcatacttgtaatctcagcactttgggaggcgaggcaagtggatcgcttgagcacaggaattcaagaccagcctgggcaacatgttgaaaccccgtatctactaaaaatacaaaaattggcctgatatggtggttcacacctatggtcccaactactcgagaaggtgaggtgggagaatcgcttgagcctgggaagcagtggtttcagtgagccaagattgagctactgcactccagcctgggtgacagagtgagaccctgtctcaaaagaaaaataaaataaaataaatgacaatgtaaaggcaaattttgtctataacaacatcataataggacattgaattattacagtgcagttgttataattaagtttacaatagaatattcatggctgaaacccagacaaactaaaatcaccaactgcttacaaaccaactgcttactagtgaaaacccaaataggtaaggcttttttttagcagtgagtctctgctcagtgaggacctgggcaccctcatttttttgagtcttggtatttctttccatctgaaaggatggagcggatgtgtggatccccagcgttttcagttcttccacctggtcctcattctgtcatggcgtgatcatggctcactgcagcctcaacctccagggctcaaaccatccttcccgctcagcctcctgagtatctggaggcatgtgccaccacacccagctaattaatgtgtgtgtgtgtgtgtgtgtgtgtgtgtgtgtgtgtgtagagatgaggaattctcgctatgttgcctagcttggctccaactcctggcctgaagccatcctcctgcctctgcctcccaaggaatagttgatttttgttgttgttgttgttttgagatggagtctcactctgtcactcaggctgtggtgcagtggttcgatcttggctcactgcagcctcctgggttcaagcgattctcctgcctcagcctcctgagtagctgggcctgcaggtgcatgccaccatgcccagctaattttttttttctttttttttgagacagagtctcactctgtcacccaagctggagtacagtagtgtgatctcggctcattgcaacctccgcctcctggtgcaagtgattctcatgtctcagcctcccaagtagctgggattacaggcatgcaccaccatacccagctaattttttgtattttagaagagacggtgtttcgctatgttggccagactggtctcgaactcctgacctcagatgatctacccgccttgctccaaaactgctgggatttcaggtaggagccactgcacccggcctatggaatagttttcaatgccttgtctagctagggatcattgaacatgttgtatgcggggtagactgcagctgcaggatctgtaccagggtgttggtgaagacgcaatggggttgccccagcgtccttgagaaagactaccaccttgtggccgggcgcggtggctcatgcctgtaatcccagcactttgggaggctgaagcaggtggatcacgaggtcaggagttcgagaccagcctggccaagatggtaaaaccccgtctcttccaaaaatattttaaaaattatctgggtgtggtggctcgcgcctgtaatcccagctactcaggaggctgaggcagagaattgcttgaacccgggaggcagaggttgcaatgagtcgagatcatgccactgcactccagcctaggagacagagtgagactctgtctcagaaaaaaaaaaaaaagcaaaaacctaccaccttgcacttcgttcaacagagtgtccagttgctccacagagcctgcactccacagtctgccgccacccgtgccacactcacagcaaagcagagttcccactgctcagcccagggacctgctcaatcctgctcgctcactggagcccttgacggactgggacctcggctggcaggtctttggcttccttcccttagcataatgtccttgagcttcatccatgttgcagcatgtgtcagaatttccttcctttcatgaataattgtttaaggccagggtggtggcacaagcctgtagttccagcactttggaaggccaaggtggatggatcacttgagccaaggagttggagaccagcatgggtaacatggcaaaacctcatctctattattattatttttatttttattttattttattattattttttgaggtggagtttcgctctgtcgcccaggctggagtgcaatggcacgatcttggctcactgcaagctccgcctaccgggttcacgccattgtcctgcctcagcctcccaagtagctgggactacaggcgcccaccagcacacccggctaattttttgtatttttagtagagacagggtttcaccatgttagccagtatggtctcgatctcctgaccttgtgatctgcccgcctcggcctcccaaagtgctgggattacaggtgtgagccaccgtgcccggcctattattattattttgagacagagtcttgctctgtcacccaggctggagtgcagtagtaccatcttggctcactgcaacctccgcctcccaggttcaagtgattctcctgcctcagcctcccaagtagccaggattattggccgcccgccacaatgcctggctaatttttttgtatttttagtacagacagggtttcaccatgttggccaggatgctctctaactcctgaactcaggtgatctgcctgccttggcctcccaaagtgttgggattacaggcgtgagccactgcacctggccttcatctattttatttattttattttattttattttattttattttttattttattttattttattttattttattttattttattttattttattttatttattttattttttgagacagggtcttgctctgtctcccaggctggagtgcagtggtgctatcttggctcactgcagtctccgcctcccgggttcaagcgattctcttgcttcagcctctcgagtagctggaactagaggcatgcgtcaccatgcccagctcaggtttgtatttttagtagaggcagggtttcaccatgttgcccagactggtctcgaactcctgacctcaagtgatccacccaccttggcctcccaaagtgctgagattacaggtgtgagccaccacacccggcctcatctctattattttaaaaaacatattttttggccgggtgcagtggctcacacctatagttccagcactttgggaggccgaggcgggtggatcacaaggttaggagttccagaccagcttggccaatatggtgaaaccctgtctctactaaaaatacaaaaattagctgggcgtggtggcgcgtgcctgtagtcccagctacttgggaggctgaggcagaagaatcacttgaacccaggaggcggaggttgcagtgagctgacatcatgccactgcactccagcctgggcgacagagtgagactctgtctcaaaaaaatcccatattttttaattgtttaaaattattattaatatttatttattttatttatttttttttttgatggagtctcgcactgtcacccgggctggagtgcaatggcgtaatctcggctcactgcaacctccgcctcatgggttcaagtgattctcctgcctcagcctcccaagtagctgggattacaggtgcccgccaccacgcctggctaatttttttctatttttagtagcgacgaggtctcactatgttggccaggctggtcttgaactcctgacatcatgatccgcccacctcggcctctcaaagtgctgggattacaggcatgagccactgcacctggcctattatttttttcttgttttttaatttccatatattttttttcttcttcttcttactttttaaaagttttatttatttatttatttattttttgagacagtttcactctgtcacccaggctggagtacagtggggtgatcttggctcactgcaacctccgcctcccaggttcaagccattctcctgcctcagcctctcgagtagctgggattacaggtgcccaccaccatgctcggctaattttttgtgtttttagtggagattgggtttcaccatgttggccaggctggtctcgaacttctgacctcaagtgatccaccccgcccccaccttggcctcccaaagtgctaggattataggcgtgagccactgcacccggcctatttcttttttatttttatttttatttttattttttggagatggagtttcactcttgttgcctgggctggagtgcaacggcacaatctcagcttactgcaacctcaccttgcaggttcaagcgattctcctgccttagcctcccgagtagctgggattacaggcacacaccaccgcgcccagctaattttgtatttttagcagagatggggtttctccatgttggccagactggtatcgaactcccgacctcaggtgatccgcccgccttggcctcccaaagtgctgggattataggcgtgagccatcgcgcctagccaattattattttttaagagactggggtctcactatatttaccaggatggtctcaaactcctggcctcaagagatccttccgcctcagcctcccaaagtgctgggattacaagcatgagccattacgccaggtctttatctaggtttttctattgtctgtatttcatcatccaaccatcccctaccagagtgtgcctggccaattttcttcccttcttccaccacacgtttctttttttttgtttgtttgtttgagacagtgtctcactctgtcacccgggctggagtgcagtggcatgatcttggctcactgcaacctccacctcctaggttcaagcgattctcatgccttggcctccagagtagctgggattataggcatgtgccaccacacctggctaacttttgtattttcagtagagagggggtttccccatgctgtctgtgctggtttccaactcctggcttcaagtgattcgcctgcctcagtctcccaaagcgctgggattataggtgtgagccaccacacctggcctccttcctttttaaggctgaataatagtccattgtgtgtatgtaatgcattttgtttatccattcatctgtcaatggatactttggtcgtttctaccttttagctattgtgaataatactgctgctctcctttacactttttcaaagcactagatccctgatgagcccacagcctagaaatggagtctgagcacagtaagccacaagacagctgcttctgccgagaggacagcctgggaccttttgggtcaggggcaagagacttggaggttggcaggctgctctctgactgagaagtggggacaagtatggttcccacacactagggaagcaatgacagactagcaagagaatagaaactttaattcatgcactctcaggccaggcatggtggtgcagacctgtaatcccagcactttggaaggccaaagtgagccactgtgccctgttgtgttttgatttttgagacagaatctggctgtcacccaggctggaatgcagtagcacgatcatagcctcaacttcctgggctcaagtgatcctctcacctcagcctcctgagtaactgggactacaggtgcatgtcaccacacctagctaatttttcttttttttttgaaacatagtcttgctctgtcacacaggctggagtgcagtagcacgatctaggctcactgcaacctctgtctcccaggctcaagcaattctcttgcttcagcctcccgagtagctgggattacaggcatgcgccaccacgcccagctaatttttgtatttttagtagagacgaggtttcaccatgttggccagggtggtctcaaactcctgacctcgggtaatctgcccactttggcctccctaagtgttaggattacaggcatgagccaccatgcctggcaatttttttgtacagatggaattttgccatgttgcccaagctggtctcaaattcctgggctcaagcaattcacctaccttggcctccctacaggcatgagccactgagcctagcctccagctaatttttacattttttgtaaagacagggtcttgctatgttgcccaggctgatctcaaacacctggcctcaagagatcctcctgcttggcctttcaaagcacttggattattggtgtgagccaccacttcccacctagcctgttccatcactttttacttaatttcacaactttccctgaccattgcctcaaatcagctttttttctgacagctgcgttgtagtctttgtcagagttatgaggggcacccccactcttcactccagcccccacctgttttattttcctccataaccctcatcaccccccagcatgttacctaggtttttatctttttttttttttttttaattaagacaaggtctcggccaggctcagtggctcacgcctgtaatcctagcactttgggaagccgaggcgggtggatcacgaggtcagcagatcgagaccatcctggctaacacagtgaaaccccgtctctactaaaaatacaaaaaaattagccaggcgtggtagcgggcgcctgtagtcccagctactcaggaggctgaggggcgcctatagtcccagctactcgggaggctgaggcaggagaatagcatgaatccgggaggcggagcttgcagtgagccgatcgcgccactgcactccagcctggatgacacagtgagactccgtctcaaaaaaaaaaaaaaaaaaaagacaaggtctcactctgtcacccaggctacagtatggagtacagtggcgcaaccacagctcactgctcactgcggccttgacttcctgggctgtcgatcctcccacctaaacctcccaagtagctgggactgtaggcatgagccaacatgcctggctaatttttgtattttccgtagagacagggtttcgttcaagccactgcacctgatcgtgtgttttgggcaactctgggagcagtggcacaggaaagaagaaagggactggggacaggtgccaacccatcagctggtgtggacctcctccccctgggagggttacaagtccagggaggaggacctcatgctgccgccagggggcagcctaggtgcactttagggtcattctccaggggctgcacacctggcagagctgcctgggccacacctgcctgcccagtgtaagggggaataggaaatactgtatctttttgaccaagcaggcctggaatccacaccccacccgaccagccccattctctccctcccttctccccagagcaccctaggcagcccaccccccacataaccgagaggggctgtccttccaggggagcagggaccagtgtcaggcctggtcattctgacacccacccacagaaagatctccttcttcacccctctggcagccctgctcccctaaatcctcaacttcagaggccatgggcagttttaaagaagcataaggctggagaggcagggccacagagccactgggctccagaacccagtcactggatccaaatgccagcctgctcacagacagctgcaaggcctctctgagcctcattttcccagactgtggcagaactggttttgttttgagcaggtcaggtgtgcagaacacttggcctggtgtcaggaccccgagaaagacccagacagctgatgagaaggggggcgtcatggcttgtgcctgcaatcccagctacggcggaggcagagaggggaggatcacttgcgaccaggagttcgagacaagcctaggcaacatggtgagactctgtctctacaaaaaaaatttaaaataggccgggcgcggtggctcacgcctgtaatcccggcactttgggaggccgaggcgggtggatcaccaagtcaggagatggagaccatcctggccaacacggtgaaaccccgtctctactaaaaatacaaaaaattagcggggtgtggtggcacgcacctatactcccagctactcaggaggctgaggcaggagaattgcttgaacccgggaagcagaggttgcagtgagctgagatcgcaccactgcactccagcctgggcgacagagcgagactgtgtctcaaaaaaaaaaagaaaaaagaaaaaaaaagaaagctgatgagggcacaggtcgggggtgggggcaagggagcacagttctaagccccagcttggctccccgtgcagagccctgagaatctggagactttcagcagaagggaaggccgcacaggtctagcaagttggcaggctgctggggggtaggggtgggctgggaaggaggtggatgcctggctgtggcctgcaccaggccccttccctgactgactgcacgacctggaggcccaaaacctgtccagtccagacctgcccaggaggggaacgaggggggatgggcagcccagccggcccgaaggcagaggagcctaacgagtgggcgaaggggcggtgtccggagagttctggtgcaagggtcactaagcctgtccaggccccatccacccctgcccaggcgcctctggcccatctgccccctccacctctagctgacctgccccctctcgctcactgcggctatggattttgaaagcatgaggctaactgatcaatttcagagtcattgtaaaaaatctggagaagatttcacaagaacacgatatgaaagatacgactttttaaaagctcagagatatctctgcagcctattttaagctcattccaccttctggtcacaccctactctccctgtctcactactggggtggttgaatttggaggctgggtggggtgtgcaggaggtcaggtgttccatctgaggcggaacaagatgggccaactctagtcttgtgaaacaaagcacattgccaggtggagctggctccaggaacctaggcacagagggttccacacacggtggcattgctgacaccgcagccggccgcacaggtcctgccagcctccaggctcagccccacctgtccctgtcttcggtgctgggtggggtctataatgggttgttcccccaggctggaatgctctgtttggaagatctcctaaacatcccccgcccacagggcccatccaccctccccataaagccctagccctcactatctatatctgatatccacaggcttctgtgccgtctttttgccctttcacggggtccctagaagccccagtaaatcctcctgtcactgacggcctggctggttgtacctaccttggtggaactccaggacctgggcctcagtcttagggttgccacggtgcacagcctcttggtcagggtgctttgggtcgaaggtgccctcctgagggcaaagtaccttcctgcccagcctgagaatggagtgggggctgaatgtgaaccctggcccactcacttctcagttgagagacctcaggcagttcctttgttttttgactttcagcctcaatttcctcttccctaaaattggccttccagctgccctgtgcctacagccagctcactcccaggtatcctttgaaagcaccctccaccacctcttgcaggcagccttccccattctcccctcccttacaggatttagctacccctcccacgtgctcggacagcccttaggcataatcccaaaacgcacccaggaattactcattcatcctgctacctcacccttcagactgtcttactccaccctgcaccctgaatgcaggtacctggacctggcatggaccaggcaacgggatttgtggactaacccatttccaacttaggaaaggcaccaaccagctcgtgaatgagaagcactagactgaggctctcagcggccatacttcccctggaaaactgacctttcctgagctcacatattgctcagcacagcatacccagctagtttaattatttcccccttttacatagggaataactcagatttggagaggggtgtggtcatttagcaggttgggggcagagctgggggcccgaacccaggtgtgtccctttgaccaatgcccttatctgtaggattccttcccccaccctggggcagggcctgggtctagggaggaggccagagggagagataggaattcaaattggtggtgctggtggtgggggaaggcgaggccctgggagtggccagtactcagggcttgggcaacagggtgctctgcagagccactgggtggggggaacagcaggggcaggcacagacctgctgagtcagagacgccgcagggactccagggggaggtgtttggcagatggctgtgggctggggcccggcaaaagcaccacagggtggtgggtcaaggagtagaattgggtgctgaggccctagccaggaccaggggatgtaagaaggaggaggccttggagagggcagggggcaacgttttccagaaggagggagtggtcagtctccacaaggtcaggcaagataagcgctactgcacccagcctccctcatgactgtgaccagaggctgttgccccagctcaggggcttcctagcatcttggccatgagggatatgtgtagcccccgccccaccccccgccatctgaggccctgctgggccctggtgatggaggaaggctccccagagaaaactaggaagataaagtttgcaaattccatgccattaggccttggtccactcccaccctctttattattattattattattattattattattattattattttattatttgtttgtttttttttttgagacggagtttcgctcttgttgcccaggctgcagtgcaatggtgtgatctcagctcactgcaacctctgcctcccaggttcgagagattctcccaggtcagcctcccaagcagctgggattacaggcgcctgccaccacgcccgactaatttttgtacttctgtagagacagagtttcaccatgttggccaggctggtctcgaactcctgacctcgagtgatctgcctgcctcggcctcctaaagtgctgggattacaggcgtgagccaccacgccaggccctctttttattttagacacagggtttcactctgttgcccaggttggagtacagtggtgctatcatagctcacttcagcctcaacctctccaggctcaagcaatcctcccacctcagcctcccaagtagctgggactacaggtgccaccaccacgcctggctaattttttaaaaagttttttgtagaaacaaggtcttgctatgttgcctaggctgttctggacctcctgactctgtctcccaaagtgttgggattacaggtgtgagttcattgcacacagcccatccctttcactacaggaggcaagccagagccccaaagaggttcttggtgcctcaagaaccctgttcctcagcccatattgaggaggggatgtgttttctccactcctgccccacctccaaactgctagagaggaacctcagcagggaaatgaagcattgcttcaccttgcctctacctctggccctggggtaccctctctgtccacttgacccccactcctccaaccactgaggctgtgctgaccttctgcctgctccatcctgtaactacctcacattcacacaacccaatgaagtagatatggctctgagttccatttcacaggtatgaaaactgaggtccatagaagtcagttctagggcgtctggcctagtggcacagccaggacttttttttttttttgagaccaagtctcgctctgtcaccacactggagtgtagtggcacgatctcagcgcactgcaacctctgcctcccgggttcaagtgattcttctgcctcagcctccggagtagctgggattacaggtacgcgccaccgtgcccgcctcggcctctgaaagtggtaggatcataggcgtgagccactgagttcggcattttttttttttttaatttttggacttttttttttggagactgagtctctgtcacccaggctggagtgtaatggtgcgatcttggctcaccgcaacctctgcctcccagtttcaagtgattctcttgcctcagcctcccgagtagctgggattacaggcatgtgccaccacgccaggctaattttgtatatatatgtatatatttttttttagtagagatggggtttcaccatattggtcaggctggtctccaactcccgaactcaggtgatccgcccacctcggcctcctaaagtgctgggattacaggcgtgagccaccgcgcccggccggatttggttcctggttcgactatctccccatgggtttcaccgagaaacagccctgctggcccttgtctccacctatcacagaagaacaactgggtcccctcctttacccatcctggggccactgtatcctacacacagaccccagaagacagaccctgccagtctaatggtggagacaactctgagatcaaatggcacgtggcagattgatcaggagcaggagacccaggacctgggagagagagagcactgaattcacaaactaccccaagcagagggcaagcaaagctccctaagaaagtggagccaggccagacacggtggctcacgtctataaccccaacactttgggaggccgaggccggtggatcatgaggtcaagagttcaggaccggcctggccaagatggtgaaaccgtgtctctactgaaaatacaaaaattaggccgagcacggtggctcacgcctgtaatctcagcactttgggaggccgaggccagcggatcacgaggtcaggagattgagaccatcctggctaacacggtgaaaccccgtctctactaaaaatacaaaatattagccgggcatggtggcggacacctgtagtcccagctactcgggaggctgaggcaggagaatggcgtgaacctgagaggtggagcttgcagtgagccgagattgcgccactgcactccagcctgggtgacagagcaagactccatctcaaaaaaaaaaaaaaatacaaaaattagcttggcatggtggtaggtacctgtaatccagctactgaggaggttgaggcagagaatcacttgaacccaggaggcagaggttgcagtgagccgagatggcaccactgcactccagcctgggcgacagagcgagactctgtctcaaaaaaaaaaaaaatagctgggcatagtggtgcacacctgtagtcccagctgcttgggagactgaggcaggaggatcccttgagcccatgagtttgaggctgcagtgggttatgattacactactgcactccagcctggatgacagagtgagaccctgtctctaagaaacagataaaaatacaaataaaaaagaaagagcatggccaggtgcggtggctcaagcctgtaatcccagcgctttgggaggccgaggctggtagatcacgaagtcaggagtttaagaccagtctggccaagatggtgaaaccctgtctctactaaaaacacaaaaatgagccgggtgtggtggtgggcgcctgtaatctcagctactcgggaggcttgaggcagagaattgcttgaacccaggaggccaaggttgcaatgagccaagattgcgccattgcactccagcctgggggcgacagagtgagaatctgtctcaacaaaaaagaaaaagaggccaggcgtggtggctcaagcctgtaatcccagcactttggaaggccgaggcgggcggatcacaaggtcaggagatcaagaccatcctggctaacagggtgaaaccccgtctctactaaaaatacaaaaaattagccaggcgtggtggcgggcgcctgtagtcccagctactcgggaggctgaggtgggagaatggcgtgaacccgggaggcggagctggcagtcagccgaaatcgcgccactgcactccagcctgggggacagagcgagactccaaaaaaaaagtggccgggcgcggtggctcacgcctgtaatcccagcactttgggaggccaaggggagttgatctggaggtcaagagattgagaccatcctggccaaccaatatggtgaaaccccgtctctactaaaaatacacaaattagctgggcgtagtggtgcacacctgtagtcccagctactcaggaggctgagacaggagaattacttgaactcaggaggcggaggttgctgtgagccaagatggtgccactgcactccagcctgggtgacaaagcgagactctgtctcaaaaaaaaaaaaaaaaaaaaagagcagccagagaaaaccacactaggagtgaccttagagcaggcactgaagaacagcaaggcatggcaggcagagggcatggcaagggcacggccccttccttggctcctcagaccagggaagtcagttcccctcttatgaccagacaaagcagcctgcacctttttgcccagccccagcacccttgtgagtattctgtcgtcttctccttagtctgtgggcttctgaggccagggaacacatctgtgctgttcactagcccagtgcccacctcatcattgctgtcagcatctgttggttgaatgacagttccatgagtggcctcccttgggctcaaggtgcctggctctgctaggggtgaaggagtggtgacttgacagggaggtgtgtggtgaggagcggggcacccatcacaggcctggcctttgctatagggaataggcttgctggggatgcattcttcagatggtgttcctaagagggtgaactgagctcatgtcagtctgaggggctggagtctgaggttagctacggaccttgggcaggtgacttaacctctctaaccttggttttctactgggtcttgccctgtcatcatggctaggctgcagtgatgcaatctcagctcactgcagccttgacctcctgagctcaagctattctcccacctcaccctcctgagtagctgggacttcaagcactcaccaccatgggcctggcttttttcttttttgtatttgtagagacagggtttcgccatgttgcccaggctggtctgtaactccagggctcagctgacccacccacctcagccttccaaagtgctaggattacaggcatgagccaccacccctggcctcattcatttgactttcattttcgtttttattattatttgttttagactcagggtctcactcagtctcccaggcgggagtgcagtggtgtgaccttggcttactgcagcgtcaaattcctgggctcaaatgatcctcctgtcttagcttctgagtagctgggactataggtacatgccaccaagcccggctaaaatttttttttttttgaggccgcgtctggctgttgcccagctatagtacaatggcgcaagtatagctcactgcaacctcgaattcttgggctcaagcaatcctcccacctcagcctcccaagtagctagtactatagacgagtgccaccatgcccggctaattttaaaaattttttgtagagatgagatgtcactgttttgcccaggctggtatcaaactcctggactcaagcaatcctcccgccttggcttcccagagtgctgggattataggcgccagctaccatgagtggtctcatttgactttttttttttttttttgagacagagtcttgctctgtagcccaggctggagtgcagttgcatgatctcacctcactgttacctctgtgtcccgggttcaagcaattctcctgcctcggcttcccaaatagctgggattacaggcgtgcattaccacacccagctattttttttttttttttttttgtatttttagtggagacaggatttcatatgctggccaggctggtctcgaactcctgacctcaggtgatcctcctgcctcagtctcccaaagtgctgggattacaggcgcgaaccactgtgcccgacttcatttgactttttttttttttttgagatggagtcttgctctgttgcccaggctggagtgcaatggcgcaatcttggctcactgcaacctctccctcccgggttcaagtgattctcctgcctcagcttcccgagtagctggaattacaggtgcctgccaccacgtctggctaatttttgtacttttagtagagatggggtttcaccatgctggccaggctggtctcgaactcccaacctcaggtgatctacccgccttggcctcctaaagtgctgggattacaggcgtgagccactgcacctggcccctcatttgacttttaattgagaacctactttgtgccatgtataagctggatacaagagtgaacaagaccaagccttcctgccctcatgccaactgctcagcagtatttcaggactgtatcagggtgattagcctgggatcacaggagacttcctacaagagatgatgtctgaactgagttgttcaccaggcacaggtgggagaagggagaaggctggcctggacaggaggagccctggtgtgaatgcccagagatggcaggagaaatcatggcgtatataaggtgtcttgagcttgggatatgggaaggtgagaagtgatattgtatgggacatacttttttttttttttttgagacggagtctcgctgtcacccaggctggagtgcagtggcacgatctcagctcactgcaggctccgcctcctggggttcacgccattctcctgcctcagcctcccgagtagctgggactacaggcgcccgccaccgcgcccggctaattttttgtatttttagtagagacggggtttcaccgtgttagccaggatggtcttgatctcctgacctcgtgatccgcccgcctcggcctcccaaagggctgggattacaggcgtgagccaccgcgcccggccgggacatacttatattaagcattattggttgtttatccgaaattcaaatttgggcatactgttaaatgctaaatctagctgtcatagtaagaagctgaaatttactgtttgggggtattttgtatatttgttttctttctgttttttattgaaaacagataatggtaaaataacagacccttcctacatgacacaacaatcatagtcactgtaccagggctcaccagagcctgagttccgtgctctgcctgctcaacctcatgtcattcaagcctcccaagggggtggtgccctgattcccaaatggatgaggaaagcagatcatagtggttagatcttggactagacacacagagaatccggagggagtgaggacacaaaatgaacccatttctggcgggtcttcccatccctgctaatctgtagtttttatatttccatattaccttccgcccagatctagctttactgggttgctgccagggagaacaaatttttgaaatctgctattttatttatattaattaattaattaattaattaattaattactttaagacgaggtctcgctctgttgtccagcctggggtgcagtggcatgatctcaactcactgcaacgtctgcctccctagttcaagtgattctcccacctcagactcccgagtagctgggattatccgtatgtgacaccatgcctggctaatattttagtagagacagggtttcttcatgatcaccaggctggtctcaaactcctggcctcaagtgatccacctgcctcggcctcccaaagtgctgggattagaggtgtgagccactgtgcccagcctaaaaatattttttaatagcaccacagtgtaggctgggtgcggtggctcacacctgtaatcccagcatttagggaggctgaggcgggtggatcacttgaggtcaggagttcaagaccagcctggccaacatggtgaaaccccgtctctacgaaaaatacaaaaattagccaggcatggtggcagatacctgtaatcccagctacttaggaggccgaggcaggagaattgcttgaacccgggaggtggaggttgcagtgagcaaagattgtgccattgcgctctagcctgggtgacaggagcaagactccatctcaaaaaaaaaaaaaaaaaaaaagaacaaagaaaaaagaaaacaaaaagcaccacactgtaaataaactgaacaaccatggttaacgaagtgtgaataaattacagaagctccatactctggaacatttgtcagctcttaaagaatgaattatgatccttttgtagttcataagcatgatgattatgtgttcacacacgttcccatgtaagatgtgccaccttcaaatatttttttttttttttttaagagggagtcttgctccgtcacccaggctggagtgcagtggcgcgatcttggctcactgcaagctccgcctcccgggttcatgccattctcctgcctcagcctcctgagtagctgggactacaggcacccgccaccacgcccggctaatttttttgtattttcagtagagatggggtttcgctgtgttagccaggatggtctcaatctcctgaactcgtgatccgcccgccttggcctcccaaagtgctgcgattacaggcgtgagccaccgcgcccggccgccaccttcaaatcttgttacgacataggcacattacccgtctgacatgaaaaaaaaaaaaaagaatgaattatggaaatgaactagaaaaatgtctatgatttcaaaatagtaggatcttttttgtaaggtgagtagatacatattgatgtcagagaagagagttaaactgttaatgttacttcagaaaggactgattagggtggaggaggagggagaatttaactttaaaaaattgctgggcatgggctgggcacggtggcccacgccggtaatcccagcactttgggaggccgaggtgggcagatcacgaggtcaatagatcgagacaaccctggcaacatggtgaaaccccatctctactaaaactacaaaaattagcttggtgtggcggtgctcacttgtaatcccagctacttgggaggccgaggcaggagaatcgcttgaacccgggagtcggaggttgcaatgaacggagatcgcgcctctgcactccagcctgggtgacagcgcgagactccatctgcacaaaaaaaaaaaaaaaattaccgggcatggtgtctcatgcttgtaatcccagcactttgggaggctgaggtgggagaattgcttgagtctgggagtttgagttcagcctgggaagcatagtgagaccctgtctctacagaaaataaaaaattagccgggtgtggtggtgcatgcctgtagtcccagctgggagaatcacttgagcctaggaagtggaggctgcagtgggccataatcacgccactgtgctccagcctgggcaacagagctagactctgtctcaaaaataaataataaaataaaaataaaatgtgcttcagcatctctagaattgttccgattagaaatgttactttcataaaataaaaataacacacacgctaaagtatacatgtgtagaaaaaaaattcccaacttccagagagaacctccgtaaatatttttgatttattttcttcagttgcttttccatatatcaatatttttgcatgcatttaaaaaatgcaattaaaaaaaaatttttttttgaggcggaatctcgctctgtcgcccaggctggagtgcagtggcgtaatcttggctcactgcaagctccgcctcccaggttttcacgccattctcctgcctcagcctcctgagtagctgggactacaggcatctgccaccaggcccggctaatttttttgtacaaaaaatacaattttttttaagacagggtctagctctgttgaccaggctggagtgtgcagtggtgtgattttggttcactgaaacgtccacctcctgggttcaagtgatcctcctgcctcagtcccccgagtagctgggactacaggggtgtgccaccatgcctggctaatatttttgtgtgtatttttagtagagatggggtttcaccatgttggccaggctggtatcgaactcctgacctcaagtgatcctcctgcctcagtcttccaaagtgctgggattacaggcgtgagccactgcacctggcctcttcttttttttttttttttaaattatttttggctgggcgcagtggctcacgcctgtaatcccagcactttgggaggccaacgcgggtagatcatgaggtcaagaggtccagaccagccttgccaagatggtgaaaccccgtctgtactagaaatacaaaaattagctgggtgtggtggtgggcgcctgtaatcccagctactcaggaggctgaggcagagaattgcttgaacctgggaggcagaggttgcagcaagctgagatgatgccactgcactccagcctggatgacagagtgagactctgtctcaataaataaataaataaaaattttattttttaattaaaaatttactttattattattattattattattattggagacggagtttcactcttgtcacccaggctggagtgcaatggcaggatctcagctcactgcaacctccgcctctggagctcaagcaattctcctgcctcagcctcccaagtagctgggattacaggcatacgtcaccatgcctggctaatcttgtatttttagtagagacgggcttttaccatgttggccaggctggtctcaaacttctgaccttgggtgatctacccgcctcggcctcccaaagtgctgggattacaggagtgagccaccgtgcccatcctactaatttaatttatttatttattaatttatttattttctgagaccgagtctcactctgtcgcccagactggagtgcagtggtgtgatctgggctcactgcaacctccgcctcctgagttcaagcgattctctgcctcagcctcccgaatagctgggattacaggtgcccgtcaccatgcctggctaatttttgtatttttagtagagacggggtttcaccatcttggccaggctggtgttgaactcctcacctcgtgatccacctgcctgggcctcccaaagtgctgggattacaggcgtgagccaccgcgcctggcctatttatttttttaaaatggagtcccactctgtcgcccaggctggagtgcagtggcaccacctcggctcactgcaacctctgcctcccaggttcaagcaactctcgtgctgcgcctcagcctgctgagtggctgggactacaggcatgtgacaccatgcttggctaattttttttttgagacggagtttcacttttgttgcccaggctggagtgcaatggtgcgatctcagctcaccgcaatctccgcctcccgggttcaagcaagtctcctacctcagcctcccgagtagctgggattacaggcatgcgcaatcacgcccagctaacttttcgtatttttagtagggacggggtttcaccataatggtcaggctggtctcgaactcccgacctcaggtgatctgcccgcctcggcctcccaaagtgttgggattacaggcatgagccactactcctggcctaatctacattccattatgtggactatttaaccccattgtgagaaatttgtatatgcttttttcttttttttttttgatacggagtcttgctctgttgcccaggctggagtgcaatggcaggatctcagctcactgcaacctccgcctctggagttcaagcaattctcctgcctcagcctcccaagtagctgggattacaggcatacgccaccatgcccagctaattttgtattttcagtagaaacggggttttaccatgttggccaggctggtctcaaactcctgacctcaggtgatcctcccgcctcagcctcccaaagtgctgggattacaggcgtgagccaccgcctgtatatgctttctttcactattatacatgacacttaaaaaatattatcatatattagttatcttttttgttgttttttgagaccgagtctccctctgttgcccaggctggagtgtcatggcatgatctcagctcactgcaacctcagcctcccagattcaagcaattctcctgtctcagcctcccgagtaattgggactacaggcatgcaccgcgatatccggctaatttttgtatttttagtagagacggggtttcaccatgttggccagggtggtctcaaagtcctgacctcaggcgatctgccggccttggcctcccaaagtgttgggattacaggcatgagccagccacattagttttcaaatgcagatgaaacaagggaccgtggaatgcctgttgtctcaggtgtgctcctaggcatgggttccaaacttacaggtacaaacttacttatgggtagagagacagataataagtacgtggtctgcaaacgtggctaatttccccagaacagaatcctggaatactggtctgagagggtataattattttaaaatatttttggggccaggtgcgttggcttatgcctgtaatcccagcactttggaaggcaggaggatcacttgatcccaggagtttgaggctacactccagcctgggcaacagagtgagactccgagtctccaaaaaacaaaaaaagacaaaagaaccccaaaaaaacaacttttggctcataccgccaaactcatgtccaggaattttgaggtgatttatgtgcttccaaaagtatatgagagtgattacctatcagaccttgtgtttgaaggttatcacttgaaactgatttttaatttgtttaggagaaaacccagcttcttatagttttattttatttatttatttatttttttgagacggagtctcgctgtcgcgcaggttggagtgcagtggcacgatctcggctcactgcaggctccgccccccggggttcacgccattctcctgcctcagcctcccgagtagctgggactacaagcgcccgccacctcgcctggctaattttttgtatttttagtacagacggggtgtcaccgtgttagccaggatggtctcgatctcctgacctcgtgatccgcccgccttggcctcccaaagtgctgggattacaggcgtgagccaccgcgcccggcctatagttttaatttatatgtcttgggttagtagaatggttgactttttttttcagtcgttccttcaaatagtgagtcctctgctaggctctatttgtggaatattcttgttcttcttcagggatgtttgatagctcttttttttccacagatgtttgatatttcctttttcatctattgtgttcttaccatttctaggatgtttctaggctttctattctatttcctgttctgtaccacactgaaatgcctgcggtagctttacaatttgttttgatatctgttagggcaagtctaccctcatgcctgcttttgttcccaaggggggaaaaccatagctgttttcggctatttatttttccaggtgaacttagaattttgtgaagtctaagaaatgttgttaggatgacattaaacctatacatccattaggaaagaaaggttgcatcatcagcttggcgaagggttattgaaactggtttttgatcttgactggagctggggcacaacttccctgtaaggcagacctgggctcctcttggacttgggcgacctcgatagcggtgtgttcctttgtttggtgttcaaagtagagagaggtccattaactagctccctagagaagcagtggcggctcaggccagcccagcccctgggaaggctatctgcatggcggccgggagcccgggtcctggtgggccggctcgggcaggcgcttgacccctggggcctgcgaggggctgcggccaccggaaggggctggctgagcgcagcgtgctgggtcctccgcgccctcggagcaggtagggttcgcgggggtgcgcccgcgggggcccgaggggcgctggggtcacgggaggggcgccccttctcttttgcacccaaccagcccgggcttccccaggagcccagacccccgagcttgcagtcactgctggctgcgcctttgagcctcgggcaaccgcagggagcgtcgagcaggggtcgcaaaggggtcggggagggggcgcgtaggccgatagaggtccctaattcggggctcctaggggtcagggtagggctaaaagggggtaagtccaccagagtttgagggggtgggcgtcagcctgtcggggggggccagggtccctgtcccgggggccggtatgcggttcgggtatttcaggggcgaggtcgcggtcctgccctggcgcttgaggtcggagtccggttagatgtccggggtctgggtccccgtctcctcccgcgcaccccttccccacggcgccggaccccggcagcccgcccgcctagtgctgggaccgctgtccggcccggccccgcccccgaggccccgcccctgttcacaggccacgcccccagctgccccctgtccccgccccgccgctcgcccattcagatgtgggtcaggggtgagcgggcggcgccgacgtcacaagcttccaagatggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaggggcggccttggggggcgggggtcgcggggagcgggcgggggccggggccgcgggctgggcgcgtccccggggagaggggcgtggacgcgcgcgcgcccgggcgacgtgggactgcgcgcgtgggggacgcgctagcgtctggcgggcctgggctggggcgcacgcgggacccctggcaggcccgggctttgtgggccagatgcccggaggggcgcgggcggtggggcacccggggcacaaagcccaccgggccgcgccaggcccaggcggcgcgggtctgcggagcgggggtcggcgggcgagcgggcgccggctctttgtgccttttcattagcaatctaatccgaacagcgtcgggcgagctgcgctgcctgacaggcgggagggctcccattatgcaaacggccctgcgcccgcggccgccccctcgctagaggattttgcgatttccaggactgcggtcctgcaccgtctgcggtctcctctcctcttgcctcctccccgcgggaagactggccacggcaggggcaggggcgggcctggaggggccgctcccagagggccgggctctgcggctggtgggctcgctgccctgcccccagacctctcctgtaggcagccgcttggcaggaagagagatgggcttgggggagggggtcggctttcagggggaagggaccggctggctgagggagggggctgaggggccccagcttgtcactctctgtttatcttccaagatggttcatattcacacaggcctgggtgtgtgcgtggttgggggggggggggaatgcctctccctggggggcagtgacttgctgagaggagggaatgaggccagataatgctcccaacggccccacccagaactgcctgggactgcctgtgtaagggagcccagtgctgagccggatgggttggagcggtgttaaagttatttatccatgtcttctcctgtcccccgcacccctagtcttttctagtaggagttgccaagcacatctggaaagctgtgttccccgaccccccactcccccaacagcaggaggggtgtaacccagggaagccacccctctgacatatgtgctggggggaggggcagagccttgcccctaggaatcctgtggcggtgggttgttgactgatgtgggattgctgtgtctcttgtgctgtcggagagctggcaggtagtggaggggccttgggagctcctaggctgaacttggggctgtcctccaaggatccaggatggagggatggagctgggtcactcaaacctaaggcctttctgggtctagcatttattgcttcctggcttctggcttggcttcttttcgtccattctcatctgccagtgtctggactccctgggccttcaggcaggcattttcaggagcacaggccatgtggttggtctggagccctgtgtcaaggagagtgtgcgtgcttggtggagcagggttgctggagtagtgtgaaaaaaagcagatgagctggcctctggagacaaagctgtgtggcaagactgctggtttagtgggctctgaacaccaagaacagggccgggagtctgatacttgggggctgaactgagtcctgtggcccaggattgttgcctggaagtgaacgttccgtcttgtgccattgagactgtgaagatctctgggtcccacaggacgagcagtagacttggaaggctgggaagaggctccccagctgcctgccttgggaggtcagagctctcaggtgggtcggcaggccagtgtcgggctgggggagggaggttgtagtagagtgcctgtggcccagcttctctggtcagttggctctgagtgctgctgtgtgcccagcaacctctccctgcggtgtttttctgccagttgttggaacttgtagattagtcactgagtttttacgaccgattcctgaaaagaaaaatctccctctggttgctgcctctgtgtagaggaagaagcagcccgagggagtcaggcctttaattaaagcaaaaccgaaatgattgtcgaagttgctggaaggagaagagaaggcgcaggtggggcaggggtgatgagtcctgttgtgctgcatgatacctgctctggggacaggtaggcacgatcccatcctcgatccttggtcttggccagcagcccagccttctccacaagctgcagtcgcggattaatcctcacgtagtgttttctttccgtagatcagatttctcattttgttaataagcgcagcctcccatccacttgaagtcagctgttgtggacgaggagcaacagggttttgcattattgagctgatagcctgccgcctcccctcaagtccttattgtttgcggggtcagatctgaggggtggggaagtgccatttaatcagcagccagcccctggagaagagctggcggggcagttctggagagtgagagccgtgaggaaggaataaagttcagtttacccaggggacttgtggttccaaccttattgcttggtctgttggcctggagcagtcagccccaccccataccttgtcctgcccgctgcccccagtacctgatccctgggagagtggggcacttcttctgggctgctcttgctggcctgggaggcagctttcaccgcgggaagaaagaacacattgggttcctcccttcttgtctcctccgagcctggcctaggacggacccctgtggggcagtgagaggggaactggacttggtcggtcgcaaagtctgtagtgcattgctggctctgccatttactcccgtcatgaccttgagcagtgattgactctcctgcctcgtttctacaatgggaacagaactggagtttacattcatgtatcgctgttttctggagctcagcctagggaaggcagacactcaacaaatgattataagatggggtgataagggctggcatctagcggagcgcagagggcatagcggtggcgtgggaggagccggccgtgggctggctgagaaccctggatgccatgtgggttggggttggcctggaggggaggggttttaaccaggaagtgactgctactgggttttaaaaggcagtggtagggtagagggtggcagtggagacagctggagagcactgaggacgcggacccacgggtactgtgtgagctgtgaagcccgcttgggagaccccactgccagccaggcatgtatgcggctctttttcaagctttttattcattccgccacattttctgagcgcaaagtcagtgcctggcccccttggtttagaccaagtcatgttggcccctgctttctggtgctcacagacttgcctgggcggggtgatagaggcgcttgcagttcagcacgcggcccgttctcctctggaggagggaaggagctgcttttggaagttaagtagcttgctgggggctggagggtaaatgcctttgactccaccgcctgtggaggcccatatagtgtggtgtctggagagatctgagatcgcactagggaggatggggctgaaagccccctccctaagagaggtcctggctcccatttaggggcttctgaaccagcccttccagtttgactctgcctggcaccgccagggttcgcttcctgctgggaggggccttgccctaagggttagggacctgggctgggggagggctctgaggaggggctgggccccgagggactgagggactgcaggcttgcttgccttgagcccagttttagctgggagtggcaaagcgagaaaagctggtggggatgggagctctgtgtgggcccccagtgagcttgataagggaggagaggctgggagctggttccagcccgccaaagttcaggagggaagggccagactgcctgagaggggtgtggcgggactgagtggggagagggactccaagaaactgcttgggaccctcgggaaggtggccaggctttggggagcccctccttctaactattcaatttattttttatggtaatgttagtgggtggagagtgggagtgcagcctcggtgttagaacagggggacttgggggtccttctaatggtgagagggaacagggatgggtcagctaggtgctcttacctagaggcaccggttttttgtgaggtgggcagcgcatcgtaggatcttaggtgcatgttttctgtttaagggtgatcacacatggggtgtggtgaggagggagtatgtggagtccccagccttcctgtggcagttcccagtgtgactaaaagaaggcagggattgggtttggttaggtgggtgcttccaggtgagagttggcctgctgtggaaatggaagagctcctggctctggcaggggtgtggctgctgtacagacttgtcccctgccgtcccgggctgttgccctgcggcttgggcttcggcttcattccaccgggtgggtgggttctctgacaagtgtgggaaggggccgctcccattaccacactgaggcctgagcccctttgagggggaggatctgttgcatggcctttgcaagccctcacccctgctgcgggtcgggcggtgaggccgcagcactcggaagacggtaaactgttggtgagctctcattcacaaagtaagtgagaagggagagtggggactgggacttcggtggcctgtccttgtgtggacacagtggggctcttctgggtgatgagtgcaggccgcacattcacccagcacacgttgcccatgctgcctggcagaggcctgcctgctggtgctctggttctcaccttgagctatacctgtctctggggtgggcccaaggcactagcttttcctgaagcttttgaagtgaacctgatgtgcagccaagtttgagaaccgctcttctagcaggtgatgcatctttgttgataatagaatccacaggcggagggatgagtagcccgcgcttttacctgcggttctcactaactgctttactccgagggcctggtggggtcagcggttacccagtgaatgagttggcagagtcagtcatgcctgttcctgggtagttactgggcacagagggtgaacagcaggaggaacctagcccatgtgcactgttggcttctcctgggaggtcctctggagagctgcctatagccctcagctgtaggcgggtcctactgaccccgtagcacgggcttttggagtctgcctggcctggtttcctggctgcattcttgggctctcgttggcctgtatgtagtctggcgggacctcacatagtgcagtttgggttgagcggaggtggccagtaatgggggcccctgggactcctgggacctctgtcttcttctccctggaagagaagagatttgtccctgaggttggtttcttgggctgtgttatctggacaaggtatatgaggccactaataggggcagagaaggacgagtgggaggggactgaagggggacgggagacagagagcttcaggtagggcctggctgggcctggccccctttgctggaacagaacaataggttgttctggggttttgtttgtatttgagggagagaggctataagacggctcctgccagctaggagcagcctatcatgtgaggggacgggtaggcccctgggtgtggttttggtcagcatcctgggtaggaaatcttgcctcttagaggtgggacagcaacctggccaggggcagtagaggagatgggaaaaggggctcagaaggaagggggtggtgcacatcttggtagctgggtccaggtggtcctgtcctgagtgagtgatctgggggtggattcctgccctaggtcttgtgccccttcaccccagccctgtccgggaccccatggcccttcccctttatggaagcagctgctattatagtttctgtctggcttgtaccagggtacttggcttagaagatgggaagaggatggtccccacggagttctgacagaaggctaggaaggtagtggtgaagagggtaagcactcatcctgggctcgttcctgggctcagcctggcagtgggcattctatgcccggttcagttgtcagaacacaccggtgtggtcctcatcatcttgtcagtcctcgttgtacaagtggctcagagaagtcagagtcgtacatctaagaagtgagtggcgaagctccaggtgaagtgtgtgaaagcctcggacacatttgtgagtgaggactccttactctgcgcagtgcttgggctggagggcagctgaggtgttcattttgagtggggtagtgggttggctgctctggacaaagccagggaatctggctcccagagtgggaaggtggtcccctgcaggtcccccattcctccccaaggaccaggggccagagagcattctctgggtcgtcctcatccttccagtcacacgcagctccttactgtctggtatgtgggaatcttctgccccacggcagcctgtgcctttgccgaacacctccaggagagccatgtgggggatggtctggacattgcagggaccagagctgagctcttgagattctctgagtgtggacaaacgaggtgctcagacacggcccttggtggtgtggggacacaggcaggatagctcctctcggtgactcttggtagattgtcttctggtagatgggctgggggtgcgggttctggtgcttcaaggtggttgtcctctgactgtgaaccagagcccagggaccaggcgtcagccccgtgctggccgaagggagagggttgttgccaaagtcccacattccaggcatgtgttgatgctgataaggcagcctagggctggcctagccactttgggcaggaggggactttgacttcatgcccccagcaggcagcatgcacatcttgcttcctggtagcacccctcccccaccgaccccctctgcttccaggtgcagggcccccgccgggtcctggtcacacagcctgcagaggcagtgccgctttcagcagcgttgctggctcttagtagcaggcctctggaggcctgttgatggattctgccagccccgcctcttagagtattcgaggatgccattggaaatggcacttccttttatttgctgaaatttgttactcttaggtttggcagtgggctccttgtccaagagttcagcttttggggaagtgtagttttgtggaaagatgactcctgcttcctccgtgggccagtctcttaagctctccaggcctcattctccttgcctgtaaacgagttgttagaaatatttgaggcagtgcttgtcagctattctcaaagttgtttgcagaccctgagggtccccgatacctttttcagtatatttagaagttacaaggtcagatgcggtggcccacgcctgtaatcccagcactttaggaggccaaggcgggtggatcacctgaggttgggagttccagatcagcctggccaacatggtgaaaccccgcctctcctaaaaatacaaaaattagctgggtgtggtggcgcacgcctgtagtcccagctactcaggaggctgaggcaggagaatggcttgaacctgggaggcggaggttgcagtgagccaagattttgccactgcactccagcctgggtgacagagcgagactccatctaaaaaaaaaaaaaaaaaaaaaaatcactggcctctgccctgggtggacacttgcactgccagagttgtgttccccactgttagccagcactgggggctgagacccaccagttctacacatgtccaggggaggcagtacagatgactgagtattaaatctagacctttaattacacatatttttacttttctgtgtgatgaaataggaaggatgcatgaggcttttttttttgagatggagtctcgctgttgcctaggctggagtgcagtggcgcaatctcagttcactgcaacctccacctcctgggttcaagtcattctcgtgcctcagcctcccgagtagctgggattacaggcacccgccaccacgcctggttaatttttttcttttttttttttttttttgagacggagtcttgccctgtcgcccaggctggagtgcagtggtgcgatctcgctgactgcaacctccgcctcctgggttcaagcgattctcctaccccagcctcccgagtagctgggattacaggcgcctgccaccacgcctggttaattttttctttttttttttttttgagacggagtctttccctgtcgcccaggctggagtgcagtggtgcgatctcgctcactgcaacctccgcctcctgggttcaagcgattctcctgcctcagcctcccgagtagctgggattacaggcatgcgcctccatgcccagctaatttttgcatttttagtagagatggggtttcaccatgttggtcaggctggtctcgaacttctgacctcgtgatccgcccgcctcagcctcccgaagtgctgggattacaggcattagccactgcgcctggtgtaattttttctagttttaataaagtctgggtttcgccatgttggccaggctggtcttgaactcctgacctcaggtgatccacccgccctggcctcccgaagtgctgggattacaggtattagccaccatgcccggcatgaggctttacaattttttttttatttttaattttttttgacgatgtggtctccctcagttgcctaggctggagtgcagtgatgatgtaatcacggctcagtgcagcctcaccttctgggctcaaatgatcctccttcataagcctcccgagtagttaggaccacagtcatgtgccaccacacccagctgttttttttttttttttccagagatgggatcttcctggtcttgaactcctaggctcaggcagtcctcctaccacgacctcctaaagtgttgggattacaggtgttgagccactgtgcccagcctacatagcaactttttttttttttttgagatggagtctctgttgcccaggctggagtacagtggcacgatcttgggtcactgcaacctctgcttcccgggttcaagcaattctattgcctcagcctcccaagtagctgagattataggcacgtgccaccacacccggctaatttttgtatttttagtagagactgggtatctccatgttggtcaggctggtctcaaactcctgaccttgtgatcgcccacctcagcctcccaaagtgctgggattacagatgtgagccaccgtacctggcctacatagcaacttttatttatgtttttccttgaagcggagtcttgctctgttgctagtctggagtgcagttgcgcaattctcctgcttcagcctcctgagtagctgggattacaggcgcttgccaccacacctggctaatttttgtatttttagtagagacgggatttcaccacgttagcgagactggtcttgaactcctgacctcaagtgatccacctgcctcagcctcccgaagtgctgggattgcaggcgtgagccaccgcgcctggcccatagcaacttttaagaaactcatttgtcgagctttagtgtaatatcaatgaagaatagacagttttctgaaaaagttattaaaatactccttccttctttctgtgtaaggccaaatttctttaaagactttaatcaaaaccgcatatcctaacagactgaatgcaggagatatgagaatccagcttcttctattaggctagacattaaagagatttataaaagtgtaaagcaatgctatccttctttttttcttttcttttcttttttttttttttgagacagtctcgctctgtcgccaggctagagtgcagtggcgcgatctctgctcactgcaacccccacctcccgggttcaagtgatttgcctgcctcggccttctagctagctgggactacaggtgcgcgccaccacacctagctaatttttgtatgtatatatatattttttagtagagatggggtttcacctgttggccaggatggtgtggatctcttgacctcgtgatccgcccgcctcggcctcccagagtgctgggattgcaagtgtgaactaccgtgcccagccctttttttgttttgtttttcggatagagtctcactcttatcacccaggctggagtgcagtggcacaatctctccttactgcaacctccgtctcctgggttcaagggattctgctgcctcagcctcctgagtagctgggattacaggcacctgtcaccacgcccagctaatttttgtatttttttaaatgttgttgttttttttttttgagagggagttttgctcttgtccaggctggagtgcaatggcgtgatcttggctcactgcaacctctgcttcccccaggttcaagtgattctcctgcctcagcctccccagtagctgggattacaggcatgcaccaacacatttggctaatttttgtatttcaccctgttgggcaggctggtctcaaactcctgacctcaggtgatccacccgcgtcggcctcccaaagtgctaggattacaggcatgagccactgcgtccagcctatttttttttttaagacagagtttcgctcttgttgcccaggctggaatgcaatggcacaatcttggctcactgcaacctccaccccacaccctcccctggggtaaagccattctcctgcttcagcctcccaagtagttgggattacaggcacctgccaccacgcttggctaattttttgtatttttagtagagatggggtttcaccatgttggccaggctggtctcgaactccagacctcaagtgatccacctacctcagcctcccaaagtgctgggactacaggcgtgagccactgtgctcagcctttaaaaaaaatttttttggccgggcacggtggctcacgcctgtaatctcagcactttgggaggctgaggcggcagatcacgaggtcaggagatcgagaccatcctggctaacacggtgaaaccccgtctctactaaaaatacaaaaagaaattagccaggcgcggtggcgggcgcttgtagtcccagatactcgggaggccgaggcaggagaatggcgtgaacccgggaggcggagcttgcagtgagccgagatcacgccactgcactccagcctgggccacagagcgagactccgtctcaggaaaaaaaaaaaaaaaaactgaataagagggcactgttgtagtacatggtaacatcaaatacagcaacagcccagatgcagtggctcacacctgtaatcccagcactttgggaggctgaggctgcaggatggcttgaagccaggagttcgaggttgcagtgagctatgattgtaccaccgcacttcagcttgggtgacagagcaggaccctgtctcagaaaaaaccccacaaaacagtaatagagaagccacataagcagatgctcgttaggagccctgactatttcagaatgtaaacaacacaattttagaaccagtggcaaggagggtactggacatttccatcttccccacgtgcctccttatctttcacatgttgtttcactctgtctcttctcagcattgggtctgaccagcatttgctcacctaatgaatgtttatgagtgcctgctgcatgcctgctgctgtggctgcttgggacacagggtctaactttgggtactggtctatggggtggtgggggtaggcaggagggaagcagcttggcagctggtgctgacgttggaagcggggggacaacagaggcagttctggcttcacagaggagggagtcgtgagggggcaggctcctcccagagtagggcacggcctgcaggagctctcaggtgtgtctgtggaagggatgaggtgggcttgatgcccctgtgggaagtgctttgcatgccaggcctgagcatggactttatgctaggcatcaggaatttattgaaagctttatttatttttttaattttttttttttgtattttgagatagagtttcactcttgttgcccaggctggagtgcaatggcgcgatcttggctcactgcaacttcctcctcccgggttcaagtgattctcctgcctcagcctcctgagtagctgggattacaggcatgcgccaccatgcccagctaattttgtatttttaatagagatggggtttctccatgttggtcaggctggtctcaaactccagacatcagatgatctgcccgcctgggcctcccaaagtgctgggattaaaggtgtgagccaccatgcccggcccattgaaagctttaagcaggggagtggcttgatgagatgggtgttgagaaagataactcagggttattggactctgaattggagggtacagggactaggcgagggttggctggaggggttgcaggggggtgattgtgttctaaacgctgatattttcacttagagtggctctgattctgcccttctttctcctgtagaccttgggaggttgcctgggatttctccctcctggacaacttctgttgagtgaagcatacctgctaccccaggtgtggaggccccaggttcttttgctttgtatgattaggacagggtgatattttctgggttatctcttgtgggaactgagccctccaaagccctcatttgtgcattgttgtcatagctgcccaagtgtgtggccttgctgagtttgacggctgtggaccaggtgatctctcgggtggtgaaagggaggtgctctgtgagtgcacctcagctttagcctcttggcttctccctggattgggatttccagggaggtctctttcctctttcttttttctctttcttttctctctctctctctgttttttgtttgtttgtttgtttgtttgttttataaatgagacagggtcttgccttgttgcccaggctggtcttgaactcctgggctcaagcgatcctcctgcctcaatctcccaaagtgctcagattaaaggcatgaaccaccacacccgactttcctttcttttgagacttctgcacagagcaggctcagcttccttagtatacttagccattgaactctaagaagttatttacaaaggtgtaaataggccgggcgtggtggctcacccctgtaatcccagcactttgggaggccgaggcaggcggatcacttgaggtcaggagtttgagaccagcctggccaagatggtgaaaccctgtctctaccacaaaaatcagctgggtgtggtgatgggtgcctgtaatccccagctactcgggaggctgaggcaggacaatcgcttgaacccgggcagcagaggtcgcagtgagccgagattgtgccactgcactccagcctgggcgacagaggaatactcaaaaaaaaaaaaaaacaaaggtaaattacacgtatatatgtgtgtgcacaaatcttaaagaatagataagtagtggtaaacccactattggttgaatcgtgggtgtcccactaagcgtgacaccgttgttccctcatggccacataagaaatagcctcccaagttcctgggacaccccatgcacttctccctggcttattcccacttccctctagaagccaacagtcttctgaattgcgggtcagccattcgctggcttttgtcggtttcccacctttgtctggatcctgaaactgcgaatgattttggctcagttcgctgggagccgggtgtcctgcactcttgggacaccaggagcagcagttcctgcgttcccattctccatttcagtgtccaaggtggcgccatccacacataatcacctgtcctgctggcagtgagcatttgggtgggtttctgggttttgtttttgctgctttctaagtagctgacttttcacccccaagctatgcttcttgaggcagagaagtgccagtttattttgttttctgtctctaaatccagttccttaatgcaccactgagactcagtttagaagtacagtgaaactttgtgagcatttttctccctgagtttgaatggatccctctctcattctttgagttcttgggcacttgtctcttagacactttcaagttacctactggacaggagagacctcttctctataaagtatcacacttggaggcttttcaggcacaggaccatagattgtaatattttccatagcagttgcccaattttatctgtaaaaattgctttttaaggcctggcacagtggctcacacctgtaatcccaacattttggaaggctgaggcaggaggatcacttgagcccaggagtttgaggccagtctggaaaacatagtgagacctcatctctacaaaaaattttaaaaattggttgggcatcgtggcatgcacctttagttccagctactcaaaaggctgagacgggaggatcccttgagcccataaattagagctatgatcgcgccactgcactccagcctgggccacagagcaagaccctgtctccaaacaatcacaaaacttccaatggatgccgaatgtataactttttcttttttttttctttcttggagtaaaataacttgatccttgatctttggctgtagctcctgagccatttgaggcactggggggtttgtgtgttgattacctatgaaggagcaagtgggctgtttccttctcccagcggcttcctttgaccccaaatccctgagagtctcgcccattttcttcttggcttcctccctttgatatgcccagctggctcctgccctacctggctgccaccaggacctgctggaggcggttgctgggaattatttggtgtcctgtttgaaccttgcttgccgtgctcccagatttcctgtttctcctgggcttgcctttcaggatttgcagaaccccttctcctttagaagtgtcaactggggctgggtgtggtggctcacgcctataatcccagcacttttgggaggccgaggcgggcggatcacctgaggtcgggagttccaggccagcctgaccaacatggagaaaccccgtctctactaaaaatacaaaattagccaggtatggtggtgcacacttggaatcccagctactcgggaggctgaggcaggacagtcgcttgaacccgggaggcggaggttgcggtgagccgagattgcaccatggcactctagcctgggcaacaagaggaaaactctgtctcaaaaaaaaaaaaaaaaaaagtcaattggaccttaggacaacttaaaaacattatcaggtttttatcttttagatagcagacatgagtctgctcttaataaggatttacagtagtctctctgtttcctgtgggctcctggctggcttgtgtgagctccctcctctaggatgggcactccatcctggacattgccgcgttgccagctgtcctgccaatattttgcttcctgtgttgttgttattggttgggggtccaggagaggttgctgcctggactgagtctacttgctgatcaggatgaagttgatctctgcttcccttctgaaggtttctgtgcacgtattgaattcaaggacagcctacgtaagaagtgtgcacagctccaagagttcttcacaaatgattatgcccttgtaactagcatccagagtgcgaaacacaaccctggaagcccctcacgtatcctgaagcttgtagtcactctcaacccccacccataagattagtgctgcctgcttttgaatgtatgcaaatggaactgtaatagtctttttggctctggcatctttgctcaaaagtatatttgagagattcatctgcgttgtttgtaagtcaaaccatgtgaaattatcagcagccagctgtttttttacccctaaaaggtaaattcatacagttcaacctaaacgttctgtcctgttcactgctggctcatagtcttttatacctgcagctgtcccttctcagggtgggcatagttgttttccattgttgggccttcatgagtgtgcctgcctgtttggtgtgcatacgtgtgcattcttgttggcgtataccttgggtgagtttttgggcccacagctagctagctagctagcttgtttgctttatttatttagagacgaagttggctcttgtcgcccaggctggagtgcagtggcgcagtctcagctcactgcaagctctgcctcctgggttcaagtgattctcctgcgtcagcctcccaaatagctgggattacaggagcctgccaccacgcccaactaatttttgtatttttagtagagacggggtttcaccatgtttgccaggctggtctcaaactcctgacctcaggcgatccacccaccttggcctcacaaagtgctgagatcacaggcgtgagccaccacccacggccttgggcccacagttttagattgtgccatccaagggttttctaaaccatgtgagttttctggccaggtgcggtggcttatgcctgtaatctcagtactttgggaggctgagatgggcagatcacttgaggccaggagttggagaccagcctggccaacatggtgaaaccccatctctacgaaaaatacaaaaattatctgcgggtggtggcgcactgcacttctgtaatcccagctactcgggaggctgaggcaggagaattgcttgaacctgggaggcgaaggttgcagtgagccatctcgccactgcactccagcttgggtgacagagcaagactctctctcaaaaaaataaaaaattataaagtatgtgagacttctggttgccttactgcctggccaacatttggtgttacctttttcctgatgggctttgacgttcttattgtttctggaacagtcctggtcttgtttaaaaacatccccattttcctttcatccctgggagatactcttttagtctttgtttggctagtcaaaatcccgtctttagtatctgttgttgaatttttgtgtttttgttttttctgattccctttcagcatgtcatctcagtcttgtcccagcccgggggtcaggcggtgttgcgtacagacggtgcagtggctccttcatgctggttgcctcagagcctttgccaggcctggagaactgcataggtgcaggactgccagtagttcttcctgctctttgatcattgaaatgttttcttttgtgaagtaatgatggtagaagatgatagggtttctgtttgtttctaattctagtctttacttggcattaagaaattgttagctgctagggttgattttgaaattgtgaagttggagagtccctcctggagctgtgggttggatggctgcagctctgtgactcagctgtgctgggtgcctccctttggggctcagttacctccttttaaggtgtccctagggtgagagagatgatcacgatagtcccttccacctgggcggcccaggctttcctcgcccatttagtgcctttcatgtagaatttccacctgttgtctgctgtgctgccactgcttgtcctccctccctgccacacagagctgtgttctctgcctgccactcacgcctacttctctgatcagggtttgtggaaccctccagcgtggtcaccattctggtacctgtggtaacacgctcagccttggtgtggcacattctaggtctaccgtttgtattcaccagcctgtgagcttgtgtacatgggacatgtatcttcgttttgggggctttctccttccacttgatgcccatcccttgagcgtttactacttgtggagcgcttggctttcaggccgtagagagctttccaatcagtggtgtccaggtaaaaacaaaagaaggaaaaaaagcttctaacctagcccttctcagacttgactgtgtgtttgagcccccagggttctggtggttagggctggatggagtctgagcctctgcgtgtctaacaagatccctggtggtgctgctgctgtttcttgggtcatggccagtgagcaagaagagcagggaagtgggctggagaggactgcagaaaccagcacagggcctgttttgcctcctgacatgtgtggatgccagattcctgctttttcctcacctactaggaacagcagctgcacatcctctggtggtcttgcgtgggctcctgctctgtggctgtcagcgagccttttaccccatgctcaggcccctcttagggggcagggtagtgttgggatggagtttggaggtgagcacagcattcgtagtcactatcacaaccttaaattgttattctgcttcttttttttgagacagagtctcactctgtcacccaggctggagtgcagtggcgcgatctcggctcactgcaagctccgcctcccagggtcaagcaattctgcctcagcctccggagtagcggaactacaggcgcgtgccaccacacccagctaattttttgtatttttagtagagatggggtttcacagtgttagccaggatggtcttgatctcctgacctcatgatccacccatgtcagcctcccggagtgctgggattacagaccgcacctggccgttattctgcttgttaaagcaatgttcccctgcctgtctccaatatcctgtctcagaactgtcagccagactgtgccaggcctggggccctccttggtgccagcactagcaggggaaatcagctgcaggtctccaaggtcttcctggcctcattccttgctggctccaaacccggaagtgatgaggagagggaggggactgaggctgtaccttctgggggaagcacagtttggaggcactttcggtccagctctcctctcagcagcccattccagccttttccttgtgctggggtgttagcccgggcttcctcacctcagaagggacagtacccatgggcgggtggctcggaccatgcagggcttggccctgctgtgggcagtacgaggtcatcagtaggtcccatgggcatttcaggatgggcttgggaaagtcactgggctggggtggatgctacctccctcactttaggccacagggctggcctgaggagcagaggaggaggaggccagcctcaggtcccaatcgctgcatcaccaatgtgttgagtggaacccgagtgtttattttgtagaagctgcgttggagagagctgggctcctggcatttgtggagcctgttgctttccaggaggatggtctgggaggagagccaggagctgctggccggcatccaggtctgggctggattacatggctgggcttgcccagagcagtgagccccacccaccaccagcccattcctgaagggacagggaaggaggtcatggagggtgggggtgttcccagaggagcagcaagcacaacctgggcctccaaagcaggctgcatgggggctccaccttgtcacttctggtggaggagctgggcagaccccatgccctcacagtgagtttgggagaatacacccaggtggggccctgctgtggataggcaggtggtgctggggggtgggggagtgagggtggaggtgcagactggagtccctgctcctggcacaccagtgcatggagggcggtgcctcctctagctcccccaagcagcttggcagttggaagccatgtgtgagtggcatccctggccctgcctgcgttgggcgggggggtcatcagactacaacactggagtcaggctttaggtcctcactctgctacctacatgctcttgtgaccctgggcaagttgcttaacccccaagaacctttaatttcttatctgaaactgcagagataacgccccgctcactgggcctgtgggaagattgaggagatcagacctgcccacatgtaggctgccatctcatacagggctgtggcggtgggcgaggtgcagccttcgccccttggagctatctcttgtctaccaaggcttcctcagggaggactccaggccatggggataggatgaacaaagtcctgggcttgtgactgtgcagggctggttggtgtgtccaggggctgggccttggggcacttctggatactggctgcctcctgcctggctgccttgtgccttccaggcagtctctcccatggcttaggggctcctgggaagaggctgagctcacacagggccacccgttgcagctgcatctgtcccggccacacctgaagtatgaggtgactatagttgggggttggtctggaaccagggccgatgctgaccttagactgaagtttgggagcagtggcagcaagtctggggctctctctgaccctggtcagatgtacttagacctctgggttgtggaagttgcctggtggccctgccctgcctagcatggcttctcagcctggcatgcttgtccctcccacctgacagtggagctcgggcgggccgtgggcggccctgctcactctcagctgtcttggcgttagctggagggttctcatttcactgttacttttgtttaggctgggaggtggttaaggtgctgctccttgggagtgggctggggggagcttctcctcagtcctccagcatagctccaggcctcctgcaggaagcccctttcttggtagtaaaggatagcttccagggaggaaggtggatgagaaggatcctaggagggctaggcgggatggcctgcttggggtggcgccctttcctggtcttcacccttctccccaggcctccctcctggctgggcgtgagccagaagtttcagtctgaaggcagggttatcatgtggctgagatgagtttgaccctgagtttgacccccgcctgtgggcctggatatgggcgtgagatgtgttcctgtctcccagagtcatggcctccagaaggagccatgtggaggcccagcacctggagcagttctgaatgcctggcttcttggaggccaaggttctaggcaaggtgggtatccaggctgggttggggcagtgcctctcagaattggggctggagttttctgctttctgcctcagcagggatcactttgatctgaaaacctcctctctcctggcctttgaaagatgctgactagagcacactctcctgccctttgctgggtgcttagaagaaaggccttgaggtaaccctgttccagcctccccacaggcccctgcagccatgtggactgaccagaggctccacacacgggcaggtgtggcctgacctcgctcgcgtaggatcatgggctagtgggtcccccaatggggggctgcttcgagtgtcaggaggcagcgaggggtgcacagtgccctggcctctgccatccccgttggttatttggctggtctgtgtttggtgagcgagtagagggatccagagtgcagggtggtcttggcctggggcttttgactgccctctggagatgcactgagggccacccagctggagagcagccgggagggataggaacctgttcccaccgtggcgtctttgcccttccaatctgcttcaccgtcgcccttgatctctgtgccagttggaaaattgaggcagaaccaatacccctgggtgatctggaaatcatcagtgggaaaggttgcctttgcccaaggctaaagatgacatgtccctgcacactttcagccccaggttttcctaccttgtggggaggtgagaggtcagggtgagtgctgggtttgaggctcagctgtgctgtgtgaagattgagaggagcccacctgatcacatggacagaacgcacaggctcctgggtggccctgcggctccagtgacatagcacatggtcgggcatacaacagtgcccaggaaaggttagctggtggtgtttccagggtatcgtgctgagcttctgagatgagaatgtcctgtgaaagcctctgtctggaggtttcattggaagtaaagtttacatacaattaagggcctaaaattgtattttcatttaccttaacccagattcccagcaagctagagagctgccctcaccccaaagagttcctcatgccccgtcctggataggcctgtcagggccaggcagtgggcgcttgtccctcgccccatcctggacagtcctcacctgtcgctcacagcctgttctgctctggtttttaccctcagtccgttttgcctattctagaacttgatgtaaatggagtcatgcagtctgtactctcgcaaaagtcttcttccactcagtgccacgactgtgaggttcatccatgtctctgcatcatttctgccctttgtatttttagggttttaaaagtaatacttttggctgggcacggtggctcacacctgtaatcccagcactttgggaggctgaggcaggcggatcacaaggtcaggaggtcgagaccatcctggctaacacggtgaaaccccgtctctactaaaaatacaaaaaattagccgggcgtggtggcaggcggctgtagtcccagctactcgggagactgaggcaggagaatggcatgaacctgggaggcagagtttgcagtgagcccagatcgccatggcactccagcctgggggacagaatgagattccatcaaaaaaaaaaaaaaaggtaatactttttaaaatgttgagtattacagaaatgaacataatatacagatactatggtttttctgtaatcccgctccccagagataatcttacttagcagttgggtatgtgtgtccccaaggtttttcttgccacagaatggacttgctgggccgggtaggctctgactgggccttgcagagcagctgccttactgtaagttctttgagggcgaacagagcgggggtggggctgctgtggctggcccagttctacagagcttgggcatgtgccaccagtggcttgagaggctggagtatctgagtgctgttccagcccgctagcacctgcctgggccctgggcctgccctcagtgtctggggacatggctttctggcttttttgtggcggggactgggaggggaaggaaaggagagcagttggcatgttggctgttccgtaaacagggccgtgtgtctgctctaacagatggcctgggaaggtaaccccgaggctttgtgttccttcctgcagaccttcaggattccgcagagagagctggccctccctccagctgctggggctcttgtccttcccagctggggccagtccacctacagggggaatcctggagctgagggatcctaacttgggagatagtttctgtgctacccttcttgcctctcccctggacccctgaaggctctgtcctagggaggggatgggtcacagccttaggcgaatgcccagctggccccgatagcccaggcctgctgccctactgcctcagatcctgggcgtcctgggagccagcgtttctggatgggcagtaggccagggctgggcgtgctagcctgggggctgataggcgtgctgcccgggcctgctgccaggggctgctgggtgctaggtggcattctcatcgcagcctgcagtcagctgcttccagggctgagcaccagcatccgggccagcacccagagccgtgtttctagttacctggcactccccaggcggagccctccaggataggcacttgctgtttcatgtccagcggtgagcgggtagggcagagctctgtggctgagaaggaaggagcagtgcttagtaggcgtttcgcagcaggatggcgtgtgccaccccctgccccgccatggggtgaggctgcattgctgctcgcagacacagtggcggcctagatgtggcccagacttggcccagctggtgtggatggcacgcatggtggcattgtgcttgctgtgaactttctgcaggtggctctgacaccccctaactcaagtggagggttcagggaggagccctgccctgttctacatcacagctgacccagcctggggccatccttccttggtggggagacctagtgctagccttgggcttgtaaagtgcccgacagggccaggcagtgggcactgacggagggtgttcccacccccatggcactcaggtgccccccagtcctattctgccacccactccctgcgcggcatccagtagctggcctggcctctggcaaggtcaggtgacccctggctgcagagtttggcatgcgctctacccatggttgactgggtcctgaggggcagtggttggggagcagatgaagtggcacagggctggatggtggtatctgattgcctccagtgtgccaccgagaccctctacccagtttttcgactgctcccgccagtgtttcagtggcccctgccctactggcctcatcccagcattagcccactgggcccaacccttgctaactgtggacgcccttgggcttcctaccaacagagctggttctgctgccctctgggcctttggtggggtcctggaccagccatgcaccccctcccctcacaccccccacccagaggggagctgcactaggggctggagagacagctggccagctgcagcctaggcctcccagctctgggccggcaccccgggtctggtcacattcctgagggacctgctgagcctccctggccctgggggtggagtgggggaaggggaaacggggacgggccgctgcacgccccttccccgaccccggctctattccgtgggggcccaggctggcaggtgtggggtgcaaggacccaccacctcaggatcccccctcctgcaggacccagagctctgggggtgggagggaacccctcgtttcctggcggcagctgcccaaggctttggtgggccggtattgaaagcccaggcctgcagcttgggtgagcccttaggcagtgaaacctctggagagggaaggccatgtggtcaggccaggcgggctagggggctgggccctctgggcagggaggcggtgagagcagatcaggaagggaaggaacgggggagccaaaagcggttgagactggttcttataaatagcccttgcacaagtggctccaattttgaccttttgttatgtaaatgtggccagcttgggaagggccctgcccaggcctcctgctaccacacccgcaggccaagaattgtgtgtctgccaccagcgccccctggcctaggtggcccctgggtgtccttaatgtcctgtgttagaggggcaggtattgcacccaccgaactccctagacctgttcgctggtccttactcttcctggctgtcagatccaactaccaggctctgtggtcacagtctcctgctgggctgcccctggtgccccagccagagacccccaggtgcgtcccttcatcgcccttccctcccttcttcgctgatggctgtctgggtgactgtgttcgtcttctcttccccaggtgaccaggcattgatgcacccccaggaaggccacgggctcaggaggcccccccgccccgctggctgctgctcacatggtgtctgggcccttggcactctggtgaggcgcaggggaggggggaccgccactggcccctttccccggagtttctgggtggcacacagccccacagctcggcctctatctgtctgacccgtggtcctttgtgtgcacacagcactgggcagtgtggagggagcctggaggccactgccctcttccagtccccttgccagtctcggggtaccaggtgtctgggtgctggcagagccggcactgatgttttctggggtcaccagaaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggcagaggcgggtgggtcacctgaggtcgggagatcgagaccagcctgaccaatatggagaaaccctgtctctactaaatatacaaaattagccgggtgtggtggcatgtgcctgtaatcccagctacttaggaggctgaggcaggagaatcgcttgaacccaggaggcggaggttgcggtgagccaagatcgcaccattgcactccagcctgggcagcaagagcgaaactccgtctcaaaaaaaaaagaaaaagagtaggggctgtagccgttcccatttcacagggcactgggggtgctcctgaccacgtgtcagccctcacattgtacctggggctctggagcccagatctgtctctctcctctccacttccttagtccaggtgcccttgaacctctggcctctctgtctggtcctcagataggagtgggtcctcagataggagtgggttggttgacccctgggggcagggcagttggagtacagatatcactagcaggtcccagatggtaggaggacagatcagctcagggaaagctgctcacagcctccttcagagttctgggtcttgaaagcagctgttttgggagcctaactgcttttcccagggacttaaggcctttgtaatttttgtagccctttcatcctccagaataaagggaccttcttgagctcagggccttctcagtactggcatgccccagggctcctcctccctgcctggctactctggccagctccactgcttacccagcccagtcactcctagtccaggtggatcccttcagtggcttggcccacggcctgcatggtgaactgattagcagccccaactaatgggtccgacctcagctccagacaccgctgcactggtcgcccatccgccatcactgttgatgccagggtggttcttcccttcactgttgatgccagtggggcccctccctttactgtagatgccagtgtggcccctccctttactgtagatgtgagcgaggtccctcccgtcactgtagatgccagctaggtccctccctttactgtagatgccagcgtgacccttcccttcactatagatgccagcgaggtccctccattcactgtagatgccagcgaggtccctcccttcactgtagatgccagcgaggtccttctctctgctcagacatctttgactccctcttatgcacatcccactgatgactctcagcacatcccatcaccttcacctttgaggtttatccaggatctgacaagtcccagcatcccagctgctgccccctggcctggcctcctgctccccaaccccaggcatcttccccttctccacatgcggttggcgcaagccaggggggaatcagagcccccctacagactcgaaggtgggcttgtttctgtgacctgcaagcccccttcccacctgacttccatcctctctcttcccctcgcttgctgtgctgtggccatgctggggtcctgcttgcacttcccacggatgattctcagcacatcccatcagtttcacttttgaagctgccctcctgggctgctcccaccataggccgcgtcatgcattccctcttctcagatggccgtgccttgcgcctcactcctgcgtctcctccagggctcatctcagatgtcccctccttgccagggctctccctggccacctggccacacgctcactcgcactgctgtttcttagtgtttctcagtgtgtgtagcttatttcttgttgtctgtggtccccaccatagactgtgtggtcatgtttgtcttcattcagagcaccatgcccagagtccacgaggccctggcacagaggcagccaccaggatgtggttgtttaacaaatagatgggagtgtgtctcttcgatggcttcttgtccgtggcagttctggggtcccccccaccgccatttttttgctcccttgtctgcttccataagactaatcggtctgcaggaaacacaaagcaggctgtagtgcctcgtcccccaggagtcctcaccccatgggcagcttagagggaagcagcagacagagccccgccccaggctcctgtcggctcctggccatcctgggcttatgtggcctttgtctccaccctcacagcctccagatggcttctgtgcctcccagcaggaaggaagacaaggacagagtgcaaagggcagaggccagctgccttgaccttatgaagctcaccctggcatgtgttcccagggccttgcccagttcactctccctggctcattagagtggccggggagaacagtggccgcctcagccagcagggaccctggctgagagccctgtgactggccacgtggccaccctgatccacctcatgaggaagaagggaggggatgggtactggggagggagccgcggtgtgtgttctactcactaggcctcgttgccacctctgcacaggcgcttggagcccttgtagaagctggtgctgctgggacaacagagggatagaatcctctttggccagatgccaaatgctgtttgttggtctccttgtaaaaacacccagaaatcatgggggctttccatgtgtgagctgcacctcttactctctgcagcacccaggtgtctcccgggcaccatgctgctccctctgggcacccctcatgcccccccacggaatggggacctggctgagcatgactgggccatgggagcagcctgaccctgggctcccaggcctggccatggtggctgcaggctcgcctcggctccatgggccttcctaatctggttagcgggatgaaggtatcgggtagggtctgtgtggggtggagaggaggagccaggccctggatccagaaccctcttctgcccttgccagctcagcagcccacagaggggtcttcccgctcacagccacagagggttatcagggttatagagaagagtcacctacccagtgcctgtcagggcatcaggtacatcccgggtgctgccacctcacacctgcaatgtccacacggtgaaccgggttgaacagaatgcagcctcgagaggctggagaaaatacaccaagcactgacacagatgaccctgggatgtgggactataggcgatcttcatttttttcttcatacttttcttggtttctaaatcttattcagtgagcacgtgttcctttttttaattagagaaaacttgacagtagcccctttttgtgtttcacagaggagctaacattccttctgtacctgtagttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacgtacgtgcctgttccccgaccaaggctgtggggtgctccacctggggggccaggactgttcctggggtgggggtagccgagcccaaggccttcggcaagctcggccagtcagcccagaacccctcctcagctgtctctgccggccccagggttagcccggctcagccccaccaccacagcgtcttcctcttttcgctcagttcctggtgcagcggtttgagatcgccaagtactgcagctctgaccaagtggagatcttctccagcctgctgcagcgctccatgtccctgaacatcggtggggccaaggggagcatgaaccggcatgtggcggccatcgggccccgcttcaagtgagggccctcttcctggggagcacagggcccctggtgtgtacagtgtgtcatggggcgtctgtgtatcacggtacttctgtagacggggaacacatttcagtgagctgctcctggaagggcagggaagagagtccataaggtgaacttggccccaggccaggctcctgctctgaccgggtccggggctccctcacaggctgctgaccctggggctgtccctcctgcatgccgatgtggttccaaatgcaaccatccgcaatgtgcttcgcgagaagatctactccactgcctttgactacttcaggtactcccccaagatgtgctgtgcggcatccagggacggcccagcccctccaagtgctccatcgccccagacccccaggaagtcactcacaggaatacacagttgcccagttgtgctcaccaacctcctccttcagtatccctggccctgtggatttaaatacccttcagccctgtgcatgtgtcccgtgtacttagagctagcctcccagcgagatgtaggcaaattttccctcagttcaactgatttaggagattaagtgcgtccatttaatttccctgttaatgtgaaggcttattgcacgaagaattgcaaacacccactgcctggggctctgcacccataggctgtgctgttgtgtgagtgcagcttccttgccctgatctgccacaagtgcagcttcagtggaaagctgtaggggctgctgtgggcagtgagggaggagggcataagagggctcccgagccaccacaccttcccatgggaatgggccagatcatccttgctaatgactggctttgggctgaccttttgtcattaagaaattgtctgcatcaccttctcactgctttgtgtgactggcctctagtccctgactccagacactcagccgttgtcctcttatggttgtttgaagctgtcccccaaagtttcctactcaaggagagaagcggctgcgtgaagacataagcatcatgattaaattttggaccgccatgttctcagataagaagtacctgaccgccagccagcttgttcccccaggtaaccctcaacagtgcagctgctcatggtggaggcaggcaggacaggggtgcaacgtgggcagccctgagggtgccagaggtagggacggaaaagcagttagacccccctgagccctggccttgactgtgttgcacggtcattggaggccggtgcatgcctggctctgcttctcctctggcctgagctgagaagcataaacacgcacccgaggcagctgagcagactccactcaccgcactttccctgcactggcaccagctgcgttcacacacccctctgagcagctgacggcccaggattgggctgaggctggtgcacacctacatgactggggtatggtctgttgttgtcttgtaggaggcagtcaaatggacaggtgatttcaatttgagggaactgtgggagcagtcctccggtacagacacttggcccatccagagttggggaatcagagatggttttctggaaaagagacagttgagctgagtctgaaaggctgcaccggcatgcagggtggacagggcagagcattccagggaagggaatgccaaatgaaaacatgccacgcaaagaagcagcaaacctctgtaaggaggccatgccctgttctctcagcgcctagctgattactaagcacagactgagagacgagagagggctttcttttttttttgagagacagtctcactctgtcgcccaggctggagtgcagtggcacaatctcggctcactgcaacctctgcctcccgggtacatgccattctcctgcctcagcctcccaagtagctgggactacaggcgcccgccaccacgcccgcctaattttttgtatttttttagtagagacggggtttcaccgtgttagccaggatggtctcgacctcctgacctcgtgatccgcccgccttggcctcccaaagtgctggtattacaggcgtgagccaccgcacccggacttttttttaaattttttttttttgagacggagtctcgctctgtcgcccaggctggaatgcagtggcgcagtctccgctcactgcaagctccgcctcccgggttcacaccattctcctgcttcagcctcccgagtagctgagactacaggcgctcgctaccacacccggctaattttttgtatttttagtagagatggggtttcactgtgttagccaggatggtctcaatctcctgacctcgtgatccgcccacctcagcctcccaaattgccaggattacaggcatgagccaccgtgcccggccaatttttttattttttagtagagacggggcttcaccatgttggccaggctggtctcaaactcctgaccttctgatccgcccgcctcagcctcctaaagtgctgggattacaggtgtgggccacattgcctggctgagaccttctgatccgcccacctcggcctcctaaagtgctgggattacaggtgtgggccacattgcctggctgagaccttctgatccgcccgcctcagcctcctgaagtgctgagattacaggcatgagccaccgcgcccggcccagaaagagtttttaagggaagctattgagctcacagcagcagatccaagttttccaaaaaaatgtttcagttcctttgagtggaagatttattttttgttcattttcaggaaaacatctgccacatccctaagtctgaatagctatatgttgtctgtcagtcatttcttcaagtaaaaacaaaggtctgtgaaaaaggttagtccaggctccaaaatcagacaagctccaggtgcttctcaggacagcgcctgccttagatgcggcaagagtgcttcgtgcacatcccgtttcatcacaaaggatactttaaaagccagatgtggtgatgcgcacctgtagtcccacctactagctgtagtcccagcaactcaggtgactgagacaggaggatctcttgagcccaggaatttaaattcagcctgggatttgaatagtgagagacactatttaatatagagccccgcccactgtgtgcctctattaaaaaaaaaaaaaaagacatgtattcagggtagagtttaataagaattagttttcattgcttcacctgtgacattcataaatgacacgggcttttttctccctgcgtgtgcagcagtgaggattctatgccctgtgacattcataaatgacacgggcttttttcttcctgcgtgtgtagcgtgtgcagcagtgaggattccacgtccacttgtgcgcttggcccctaccttgagctccgcttaggcaccagcttagcttcccagcagtgtcggctgtgtcaacacagcaaaaggggcacacagcagctgttatggtctcaccaagcctgcagagcatactctgggcaccgccagtctggggcctgggaaacagggctggtattcctgaggggcctctgccacagccacagagactcagcctctttgtttccttggcagctgacatcggcgacctccgggagcagttagtagaggagaacacaggctccttgtcgggcccagcgaaggacttttaccagcgggagtttgatttctttaacaagatcaccaacgtgtcggctgtcatcaagtaagtgcagtgcttcggaaaccaccttctggaatcttgttccagtccctgcagcttaacagaattgcctgggaagctttaaaaatacccgtgcgtggccccaaccagatgaatgagagtctctagcagcggggctgctggtggttctgatggacagccagggtgggtggggaagcactgcttggggtgagtcagggctcttgaaggtatggcagaatgcacggccacgccagtttcaggaaacacagcttagtttcattcctgagatttgtggaatttagcacatggctccacaatttgaggtcaccctgccctctccacactctgaaggatcgatcctcttggtgtcaggaaaaccagactgcctttgcagctcctgtcatcgttttcctagaccttccattcatgtggacctgacaccatccttggatgttggtggctttgtgcattcataagggatgaaaccctggagtcatcaatgctgggcacgccggctgggctgtctccattgcgtacactgctctgaccttggtcactttgaggcccttttctgggctgggtgctgagaatagcagtgctggcagcttctaacccaagagatgaaggacgggagctagcgtttcctgggtggcagcaggtggcaggcattattacccccaccacccccagccacacacccccgcacacagcaggggcagagcctgccagaaaacagcccttccggggctgtcggggattctccatgaggaatgcagggcaagaatcgctgccagtggtgcctggctgcgctaggagcagctagagccgggaagagagggacagagagggcaatccaggcaggaggggccctgggctgtcccccagtagccagttcctccaggagacaaagcaagaatttctttcctgtttctcaggccctaccctaaaggcgaccagagaaagaaggcttgtctgtcggccctgtctgaagtgacggtgcagccaggtgagcaggtggcttctggaggctcagaccaacctcttcctgcaggcgggcggcggggcgtgaaggctgctgccctctccaggcactgcaggatgtggacacagtggcttggccagccccacacctgcttgggcccacggtgcctggtgccccaggaccccagcccctccccaaaatctgccgctagtgagcgggagctgctcgtcagtgggtgcccttcatcttccttgctgcctgctgtttttctggaggctcacactgacctcagtagctgttactctagaagagggttcctaggctccagcattacaggagcaggtcacacagacaaggggatggcgggcccagtgtgggagggctcaggtgtgctgggacccatcagcaccaccccctcaccgcctccatgggaagtcgctcctgggtgcctgtggctgtggccacatgggaattcaagccgagcttttcaagagaagatggaaatccagacttcactgggcagctctctctccatttctttttttttttttttgcgatggagtcttgctctgtcgcctcagcctcccgagtagctgggactacaggcgcccgccaccacacccggctaatttttttgtatttttagtagagtcagggtttcaccgtgttagccaggatggcctcaatctcctgaccttgtgatcctctcgcctcggcctcccaaagtgctaggattacaggcatgagccactgtgcccggcctctctctgcatttctaactattggcacaaacttgtcttccaaactctgtctgtcccgtgcagatgttcacagcggctggtccttgagtgccctgcaggaccccggtttaaccatttcttcccaacacattgtattgagctcacacaacagcacggcttcccagagagggcaggacatgtatgcagggcctctgttcccgcattgggaaggccacaactgctggggaggggcaaaaagagctggaagcattgtactgcagggggcatgcacagaagtccccagcccctggctctagattgtgttggctgagtcttgccccagaggtcagggaagccagcagggctctagcaggagagcacagaggggcctgagtgtgagccacagcctggagcaggcagaagggcaggtgaggaagaggaggagatggcatgcccccctctccctgtaccccacagcaaggccaagcttggctcccctcaaagcccacctctcagggctcaaggagcacacatcccccttggggactggcagttccttggccagaaacaggctttcccttgtcctcttatttcacacatttactgagcactcactgagaaaggggagcctgggccgggcgcggtggctcatgcctgtaatcccagcactttgggaggtcaaggcaggtggatcacctgaggtcaggagatcaagaccatcctggctaacacggtgaaaccccgtctctaccaaaaatacaaaaaatcagccgggtgtggtggcgggcgcctgtagtcccagctactcgagaggctgaggcaggagaatggcgtgaacccgggaggcagagcttgcagtgagccaagattgcgccactgcactccagcctggatgacagtgcgacactcggtctcaaaaaaaaaaaattaaccaggcatggtgacgcgtgcctgtaatcccagctacttgggaggctgagaacaagaatcacttgaacccaggaggtggaggttgcagtgagccgagatcgcaccactgaactccagcctgggtgacagagtgagactctgtctcaaaaaagcaaaaacaagaaaagaaaaggcatgacattgggtattgtggctgttaaaaagatgagtaagacatggtccctgagctgaagaagcttgaactcacagagatataaaataagcataaagaaacaatgttggcctggcacggtggctcatgccttaatcccagcactttgggaggccaaggcgggtggatcacctgaggtaaggagttccagaccagcctggccaacttggtgaaaccccatctcaactaaaagtacacaaattagccaggcgcggtggcgggcgcctgtaattccagctactcgggaggctgaggcaggagaatcgcttgaacctgggaggcgtaggttgcagtgagccgagaccgagccactgcactccagcctgggcgacagagtaggactccgtctcaaaaagaaaaagaaaaaaagaaacgtgttagacaaaagtcctaaaggctgggagaaccaaggacagttcatggacatagtgacatttaagtaaggcttttgagagagtagtgttcaaatgggtaaggaaggccgggcgtggtggctcacacctgtaatcccagcacttgggagaccaagacgggtggatcacttgaggtcaggagtttgagaccagcctggccaacatggcgaaactccatctctactaaaaatataaaaattagccaggcatggtggcaggcacctataatcccagctactcaggaggctgaggcagaagaattgcttgaacctgggaggcggaggttgcagtgagccaagatcgcaccactgcactccagcctgggtgatagagtgagactctatccaaaaaaaaaaaaaaaaaaaaaaaaacagggactccaagaatggagggctgttcagaggctgttgctcaggcaggtggaggcaggacaggcctcacacacacccccagaagcagtagggctgtatccgtgaggatggggctcagtgctcctctaggaagagcatttcccagaaggtgcagactcatttggtcgatggttggaagagtcgaagagtcaaggaggacggacccttagcggccacagaataataagttagtggtgccctggacaaggaccagaggcccctccacaggggtggggtgtgcctgcagggtggacacgcacgtaacatccgtgttggaaactgactctggctcacctgtggtgacacatgcactccctgtgactgcctctgtccctgcacaggctgctccctgcccagcaaccctgaagccattgtgctggacgtcgactacaagtctgggaccccgatgtagaggtgagcgcctcaccctacccatcccccgcttccacagcgtccgcgtgtgaagtttttctcggctgcatcatgggtgccacattctttttgttgttttcagtgctgcaaaagccccatatctggccaagttcaaggtgaagcgatgtggagttagtgaacttgaaaaagaaggtcagtaaagaaccctgattttgtttgggagctcagtgcttttccttgctaatgccagtttcttctggcatgtgttaaatttagtacagctctccataaaagatgatgtctgtccatctgtctgccctcagtcagacccctcgctaggggatggcagggagctcaaatgcactgacagatgtgccaccccagaggtctgtctgccatgagtcagctggcatgctccagcaggctccttcctgaggctgaggggcccggggccgttggggggtgttagtttcctggggctactgtacggacgatctcagttctggaggctggagtccatcatcagggtcgtgccccctctgaaggctctgggcaggtcacaccttgcctcctcagcttctggtggtgttgccagcagtcctgggctcaccttggcctgcagatgctccactcccatctccgcctccctcttcacatgatgatctcccttgaaggacatcagtcattggattagggactgtcctaatccactgtgaccttgtcttaacctaattacatctgcaaagaccctgtttccaaataaggacacattctaaggtttggggtgaacatgaattttagggagacactcttcaacccagtacagacggtgtggccagctgtggagagggggctgccaccccttgcagggacctgcctcccatggccatgtctgcacactggccccgagccctcccaggaccccagtgtacagacacattcctcctgccccccagctcacagcacccaacactgactcaggcacacctgggtcttcactgcagatgaaatggggctctgtttttagttccatttaagcctaaatgttcttagactccaaccctggattccacctgctgttccaaggctttccttgggccctgctgggctcctccttggcctccttggggttttgaagaagtgatccccaagattgctggggttcctttcaggcatgtgagaggactcatccctggccccctcagagggcttctcactgcctacaggctaacagtggcctctctccctgcgggcaggtctgcggtgccgctcagactctgaggatgagtgcagcacgcaggaggccgacggccagaagatctcctggcaggcagccatcttcaaactgggagacgactgccggcaggtaagcagggtcaggcctcaagtaggcttggggactgggcttgctgctccccaaggctccaggcccaccagagtccaatctcatatgcagaaatgtgaatcttttccttctcttacatggttcaggtgccacggggtaaattagggcttctgcaaaacccagaggcctctccttccagcccctttcccactgtccctgccatgccagtgcccacctgagggaactgtccaggggttgggtgccttatctcacacaccccaccagacagctcagcctcatgctcagcccagggcctggtggtcccagcagcctgagtccagcccccggtggtcagaaaggaaggccttccagactcttgctcggctgtggtctccccacctcactccatctctgggttctcggcttttgccctgcatgagccagaagagctactggggtgcaaggacgccaactgaccgcatcctgcgcctcccggcttcccaggacatgctggccctgcagatcatcgacctcttcaagaacatcttccagctggtcggcctggacctctttgtttttccctaccgcgtggtggccactgcccctggggtaagttccctgagtggagccagtagggcagccctgggcacctcgcacccggcgggcctcagaactggcctttcctcctagtgcggggtgatcgagtgcatccccgactgcacctcccgggaccagctgggccgccagacagactttggcatgtacgactacttcacacgccagtacggggatgagtccactctggccttccagcaggtagccagggtggccacaggccggggaaagtcgtgtgcgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaacgctgtctctactaaaaatacaaaaattagctgggcatagtggcacgcgcctgcagtcccagctactcaggaagctgaggcaggagaatcgcttgaacccaggaggcagaggttgctgtgagccgagattgcaccactgcactccagcctgggcaacagagtgagactccatctgaaaaaaaaaaaaaaaaaaaaaaccagggcacctggccgggcgcagtgctcacgcctgtaatgccagcactttgggaggccaaggcgggcagatcatgaggtcaagagatcgagaccatcccgaccaacatggtgaaaccccatctctactaaaagtaaaaaaattaactgggcatggtggtgggcacctgtagtcccagctactcgggaggctgaggcaggagaatctcttgaacccaggaggcagaggttgcagtgagccaagatcatgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcctgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccaggctacctggctgtgcggtgagcctgggtgaggaccagggtggaggcggagggggtgtgtggaacgttctgagatcccctttaggatgaagggaatccggttccagagagtgaggtaggtgctagcagccacctgctgacctacacctgtcctttggtcacctctgtctgcccacctgtgccagtaaattcttgctctgggcatctaattccaaccaccttccccacaatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctctgcccaccgctccctcctgtctctccccaggccctacatggatgtggtcgtctccctggtcactatcatgttggacacgggcctgccctgttttcgcggccagacaatcaagttcttgaagtaggttccttggtggacacgcaggccatctgggggacagttgtccattagctgaggctccatccaagataggtacctttcatgtaattgtcactgtggttgtcatctccttggaacctcagagcagacagggttcctaggtgaggctctacccctagaccacaactgtgaggggcccctgcttgtgccggccacaccagagacccacccaggggcctctatttatgtcaaggatgctacgcccaccccacctccaccctaaggtctggggctgcagtagcttagctccccaatgcttagtcccctaatgccatggggccactcaggtgatgctgggaaggggacagggcccatgataggccaggtgtggccttcacagcaccccatcttccaacatgtggaccccaaaggtacatttccagggcatggctctcagctgaagtccgtccccatggaagaccctcctcccactgggccagggagccagcacggccctgcccatggcagccctgacacagcctcttctccaggcacaggtttagccccaacatgactgagcgcgaggctgcaaatttcatcatgaaggtcatccagagctgcttcctcagcaacaggtgagtgccccgcccccctgccttctcccactgcctcggtggccactgggcacctgcagggccttgcctgcaccaggcgatgaggattctgctgtccccaagccgcccctctcatgaagacccaagtcttgacaggaactcttgaggagcagtggggtgctggtttagggggctgtggtgtgccgaggggaacacttggcagaggccgggcccacctgggcagggctcgtgaggccgaaggagcaatagggacacaaggccaggagtattagaactgagtgtggtgtcaggcctccctcctcccaggagggctgaggagtcagagcccactccttccctgcgcctgcctcgggctgcttcgtgggcagtgactggaggtgcaggccgggctgctggtcactactgtggtgggaggagatgggtgcagggggccctggggagggctggctcagggtctgaaggcagagcaccgggctgacaggctccctgctgtgggagtcagaggtggctttgaggggtccggcctgaacaaagggaggatggcgatcccagcaagtgagccatccccgaagggggcagcacttaaacatgtggggttggtaaggccctgaggggcatgtgggagcccaaggctgtgccatgggacagaccacatccagactaggaggaggggcccaggtgtggccatctgcatggggaactgccggaggagcgtgagaggaagctgagacctgcccccaggtggcgcccaggtccgtcaccctaacaagggcactgtggaggctgggcacggaaggagctcttgctgataggaagcagagaagccaggcggccaggacctcaagaggggctggggcagggcgagaaggggctctccagaggtgcgaggagagcgtacagaccccttggaggcatctggccaggacgagccaaggggcccgaggcccatggggcagagcagtggctcccacggatggaagcggtttggctgaggagcatgaggtggcctcagagtcccccgggttggagcagatgtggtcactgggtgggggagggcacgcctgggacatttgtaccttcaggtgctgggcagccataaggggctgattggacaggtagggctccctgcagggagggaccccagaccctgctggctcctcgaatctcccttcactcttcttggcctttcaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggt

SEQ ID NO: 37968 - DNA, 1455 bp, Homo sapiens
ctttctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaagggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaaggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgtt

SEQ ID NO: 37969 - DNA, 8361 bp, Homo sapiens; identical to SEQ ID NO: 36117

SEQ ID NO: 37970 - DNA, 73325 bp, Homo sapiens
acccacgacgacagaaggcgccgatggccgcgcctgctgagccctgcgcggggcagggggtgagtgccccccatcgcgccccactctccttttccaggcttggtttggctgcagatctctcgggctgcgatactggggagaggagagacccccaaattcctggacccgggaagcgaggagacttactccggccccctcactgcagcgggttggatttctttcaccaagccagcagccgagagcccagctctatttaaggggccaccagacctcccagctactaggggctttgactcttctttgcataaagctagtgggtcccccaagccctcctacccccggagagcccttacctctctggtttctttttccattgctcttagcaaaggactccagggagtggagttcatggagtgggggtgggggttgcaaactgccagcatttcgagggccagggagttgaagcaataaactggcaatgaactgagggctttctctgtgcctagccttgtgcccaaccttgtgccatgctgctatgaactttgctgctattaatccatttaatacaactcatagaggtagagtctcgttttcccccttttacagggaaggaaactgagatacagagaggttaaagtttgcacagccggtgagttgtgaaaccaggaggagtaaaaagacagcggagagagaattgaagaggccacgtccactaaacttcaaatttcttctagggttagataggaccagcagacctgctgagatgaaaataacagatcaagctgggccggtggctcttgcctgtaatcccagtacctaggaggctgaggcaggaggattgcttgagaccaggagttcgagaccagcatagagagacccccatctctacaaaacataaaaaaaaaaaattagccaggcctggtgaggctgcttatgcctgtaatcccagcactctgggaggccgaggtgggaggattgcttgagcccaggaaattcgaagctttgttgagctttgattgtgccacttcagcctgggcaacagagtgagaccctgtctctaaaacataaattaattaataataaaaaataaaaacaaatcatacatcaagaccaccagtcgaacgaggtttggggtcagataagcctgggtcagagtcagctttgccacttcccatttgtgtgtccctgggggaggcagttccccgactggtgcctcagtctgctggtttctgaaatggagacagtactgtctgcgtcctggagttgttataaggattaactgacagtccatgcctagcaatgattatggagcccaggtctcctagaccacatggcccagttccctgggttcaaatcccagcccttccactcctcagctgggtaaagtcagcaaagttactcaacctctctggtcctcagcttcttcatctgcaaatcaatataattgcaactacctagggttaatgtcaggatgaaaggaattgagaattagtaggtattccaaagagtacttggtacatttttgtgtaaatgttaaagatccaaaaagttgcctggccccctgggcaggtgagctggggacccctgccttgtaccatcctaagggtcctctttgtgttccctcaggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtagctgccatccctgggagcctggaaccaggcaatgttcgggggaggcaggggacaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagagccacattaggatgaaccttttaaaaagttatgcatttatttttatgttcccccactggctgtattataggacaatttttatatgtgatatgtatttaccttagtgtgttaaataaacactggcattccaagtgtgagcctttctgctcatccatcctcttctactccattcttgtaggcttccaaagaatgttcttcagagttcattcattcttctgccattgtattaatttttacattatcacccgccaccaacccaggggttggcaaacttaaagagccaagcggtacacagtatttgagactttgtgagccaggtaatcttccttccgaacactgaactctgccattccagaatgaacgcaatagtcataaccatagacaatagtcatgactgtgttacttttttgtttgttttttttttttgagatgcagttttgctcttgttacccaggctggagtgcaatggtgcgatctcggctcactgcaacctccgcctcctgggttcaagtgattctcctgcctcagcttcccgagtagctgggattacaggtgcccacccccacacctcgctatttttttgtatttttagtagaaacagggtttcgccatgttggccaggctggtctccaactcctgacctcaggtgatctgcctgccttggcctgccaaagtgctgggattacaggtgtaagccaccacccccggccgactgcgtttcaataaaactttatttgtagtcactgaaatttggatttcatgtaattttcacctgtcatgacatatgctttttgtttttctttgatgattgatagtttgccaacttctgctttaaactgaggttctttgagcagttcctccaacgtaacctagctctggccttccctctggtgtgcccacgttctctcattttcttcctttcttttattcaatagagaaaccaaaatatattagagagaccctagagacttactggcccaacagagagttgctccttgatttcatagcagggattgaaaaatgacttggagaaaggatagttttttacctggtgagtacatttcatttcctgctgtttctccatacccacagtcatctcatatgtgcacgattggagcacttcctgcattttggaaaacactcggttggctcaagcccttcctgtgcattatttatatgacagttacaggtcaggagtgatctgcaatgccctttacacattgttcacattggcacgttgctagctggtgaccctggtatactcagtatcagccaggatgttgcagaaccagctcccagttggacatggggccgcctaccagtttgctgtgacctctcttattgccccccaagcttatctaagcctgtatcctcaggtgcttggattcgccctcatagtcctgtgtacctccagcgtggctgtcgctctttggaaaatccaacagggaacgcctgaggccccagaattcctcattcatcctactgtgtggctcaccacgatggtaatgatgccttcagtctggagcccggcttcctcccagctgctgctttgcctgccacagtggagaacaaggggaagagaagaggctcccctcagcctcccaccctcccctaaggggcctccctgactttcccgtccagagcttcgcagtgttcctgattcacaccgagaggaaaaagggagtccagtcatctggagtgctgtttggttactggcttctctgctttgtcttgccagctaccaacgctgcccagcaggcctccggagcggtaagtcggggcgtgggccaccctgggaaaccaaaatggtggctcatgccttgggtcccttcctttctcctcctgtttccacatacaacttattctctatacagtgacacacacaagccagtcacttacactctagagacacaaaatccactcccgcacctgtcagtacccatcatcccatacatttcttatcaacacaatttcctgtcttacaggcccacatcacacgtgccacttgcacacgatgcacacacttataggcactgattcatacatcgcacaagtacatgcatgcacgcacacacacacaacctgggcacagacacacctgtgtgcacacatacccctccgtgcacacctcccctcatgtcatggattcaccctccccatgttcctatgcacctatatttacacactcattctgcacaccactcgtatttctgttgcccaatctgggaagcagcttttttttttttttttttttttttttttttgagaggcttgctctgtcgcccagactggaatgaagtggcatgatctcagctcactgcaatttctgcctctcgggttcaagcacttctcctgcctctgcttcctgtgtagctgggattacaggtgtgtgccactacacctggcttattctaaatttctactaaatttctactaaaaatttctactaaatttctactaaaaatttttgtatttttagtagagacgaggtttcaccatgttggccaggctggtctcgagctcctgacctcaagtgatccacctgccttggcctcccaaagtgtcgggattacaggcgtgagctcttgtcattcggccggaagcagcgtttctctattaggagacatgatgggtcattttctctgtaaagagaaaaacatgtagcctagaccaacttccctcagcctcagctttagtaatgttgtggccagacaattctttgttgggtggacagggctgtcttgtttgctgcagggtgtgaaacagcatccctggcttctgcccataggtgccagtagcataccatccaattgcagtaacccaaaatgtctccagatattaccaagtgtccctgggggtgaggaggacaaagtcacccacctattgagaagcactggcctcgacagtgtgcttagccaaggcttctgggagagggagttatcttaacaccaatgaacaggctgcagcaggtttcagatattttacttcattattttatttttgtggagacaacatcatgctttgttgcccaggctgatcttgaactcctcggctcgagcaattctctgacctcagcctcctaaaatgctgggattagaggcatgagccaccacgtctggactcacagatcatttcttcagtccagtggttactccatcctgcccctaaaggagaaggtagagaagcatcaccctgtccttaaggacagagtttttattttttgtttgttcattctgagacagagtcttgctctattgcccaggctggagtgcagtggcacgatcttggctcactacaacctccacctccgggttcaatcgattcccatacctcagcctcccaagtagctgggattacaggcatgtgccaccatgcccagctaatttttgtatttttagtagagacaaggtttcaatatgttggccaggctcatctcaaatgcctgacctcaagtgactcacccgcctcggcctcccaaagtgctgggattacaggcgtgagccacagcgcctgaccgaggacagagtttttaaaagagtaacctttgtaactaaggggaaattccacaggttattcagtaatttctgaaatggtgggctcccacagttgacataagtcagctttttgggacacagcatagaaacaataatactgggaccatatacattctggggttccaaccatgtgccaggcactgtggcaggcacttacacacgtctcctcactggattctcacaagagttcacagtgatgggttctttatttttttaaatagaaatagaaacaaagtctcattatgttcccaaggctggtctcaaactcctgggctcaagcgatctttccacctaagcctcccaaagtgctgggattacaggcttgagccaatgtgccccagccaatgatgaattctagccgtcccattttaaagatgagggagactaaggctaggagaagggaatgacggcctcagggccacaaagcttgggagtgcagagcccgagttcatctcaggcaaattcagaacaaactttctgagagaaacagtggggaaaacagtgggagtttagggaagatgggccatattgtcattggaatatccaattgtctgctatctgccaaaaaacaaacaaacaaacaaaaacccaaaactagaagagtataaaatccagtagaggaatcatgatttaaaactagggctctggtttaaagccataaaacctcagttcacactagcttaatgaaaagggtaagtcaagggggttcattagctcatgcatttattagctcatacccatgggatctcccaggcatgactgatccaggcctgggaccaggtaccatcaccagatctccacttctgcctcttggctctgccatgttagcttgattctccaatggagtggcaagaagagccaccaataccttcacacttacattctagcatgtagcaaagccagcagaatctcccgatggttccagctctcaagtacccagcatggggtgctatgtgcattcctaaccctgccatggtagccaaaagaccagaacgtattcgttggccaggcctcattcacccacccagcctcggagtagagtcagttctgcacaaatcacacgcccgaacacaagcaaaaaacttaggaagaaagaaaatcagtacatggaagagatctctgcactcccatgattattacagcactgttcacaataaacaagatttggaagcaacctaagtgtccatcaacagacgaactgataaagaaaatgtggtatatatacacaatgaagtactatgcagccataaaaaagaatgaggtactgtcattttcaacaacatggatgttaagtgaaataagccaggcacagaaagacaaactttacatattctcacttatttgtgaaagctaaaaattaaaacaatgtaactcatgaacatatagagtagatggaaggttactagaggctaggaaggacagtgggtgggggaaatggggatggttaatgggtacaaaaaaacagaaagaataatatctatttgatagcacaacagggtgactatagtcaataataatttaattgtacattttaaaataactaaaagaggctggacacagtggctcacacctgtaattccagcactttgggaggccaaggcaggaggatcatctgaggtcaggagttcaagaccagcatgggcaacatggtgaaaccctgtctctactaaaaatacaaaaaaagtagccaggcgtgctggcacacatctgtaatctcagatactcaggaggctaaggcaggagaatcacttgaatccaggagacggaggttgcagtgagccaaaatcaagccactgcactccagcctgggcaacagagtgagactccaactcaataataaactaaaaaataaaataactacaagagtagaatggatcatttgtaacagaaaggataaatgattgcggggatggagacctcatttaccttgatgtgattattatgcattgcatgcctgtatcaaaatatctcacgtcatccagaaatatatatatcaggccgggcgcggtggctcatgcctgtaatcccagcactttgggaggccaaggcaggcggatcacctgaggtcaggagttcaagaccagcctggcctacatggtaaaactccatctctactaaaaatacaaaaattagccaggggtcgtggcacatgcctgtaatcccagctactcaggaggctaaggcaggagaatcgcttgaacccaggaggcggagggtgcagtgagccaagatcatgccactgcacatcagcctgggtgacaaagcaagactccgtctcaaaaaaaaaaaaagtatacacacacacacacacacacacacacacacacacacctaaaattaaaaaataaaaaatgctttaaattaaaaaaagaaagaaaattagggtgtttctgaccagatgacagggcagcagatgcaaaaatcattgtggtgtggcagcaggagcatcacaatttggaccagatcatctgcgtgtccttgaacaaggtgctgtcacttctctgagccttggtttccccctgagtcaaaggaagcaagtaaactccagctgatgagactgtgtatggcaagaatgccgcatgtgctcagggcagggtcagtgctcaataaaaccagctctcatctctgcaaaacagagaaccctggccaagggggagcagggttgaagattggggtagagggtggaacggagaaaggatttcttttgtggcacaaagaagaaggtaaattgtttcttcatctcattgtcccagcagctgtggccaatcatcatgtggctaaggacaaaacccagacgcagccctggcccaccatttgtatagacagaatattataaattgggtatttgaaaattaggacctgctgggcatggtggctcatgcctgtaatcccaacactttgggaggccaaggcaggcagatcactttaggtcagcagtttgaggtcagcctggccaacatggcaaaaccccatctctactaaaaatattttaaaaaagttagccaggcatggtggtgggcacctgtaatcccaactactaaggaggcagaagcaggagaatcacttgaacccaggaggcagaggttgcagggagccgagatcatgccactgcacttcagcctgggcgaccaagtgagactttgtcttaaaaaaaaaagaaagaaagaaaattagaaccactaggaaagccagggctctggctttcaaatactcttgccctggtccccagagtgggcactgacccaagatcagaaaccttttctctcctctgagcaccctcctctgtctccattccttatcttctgctttccctcccacagggcttccagagcgaccctgtccgccacctgtccacctacctatgcctgtctctggtggtggcacagtttgtgctgtcctgcctggcggatcaaccccccttcttccctgaagacccccagcagtctgtaagtcaccaagttccaacctcattcctgttccactttgaggtctcagtctcccccaggtgaccaaaagtctttaatttttttattcatttagccattcagcaaaaagtgtaccacatttctactcgatgccacagttggcagactttttctatatgggccaagagaaaatattttggactctgtgagccatacagtgatctcagtggcaattactcaactctgccattgaacgcaaaagcagaatatgtcaacaaattgcatggctgtgttgcaataacactatttgcagaaacaggcagtgggccagatttggtcatagtttgccaaaccccgctatgccctagcaagggcataaggatctatggtgaacaagcagatagagtttctgttctcacgtagctactggtcaagcaggggaaccagacactggtcacaaaattaaacaaatatgttgaaaattggatggtcacagtggctcatgcctgtaatcccaacactttgggaggccaaggcaggtggatcacttgaggtcgagagttcaaagccagcctggccaacatggtaaagcctcatctcttctaaaattacaaaaattagccaggcatggtggtgcacgcctgtaatcccagctactcgggaggctgaggcaggagaattgcttgaatccgggatgtggaggttgcagggagccaagactgtgcatttgcactccagcctgggcaacaagagcggaactccaccaaaaaaaaaaaaaaaaaaaaagaaggaaaaagaaaattacccttggggtaagtgctccatagaagaagctcatgagagattgagagatttacaataggtaacagtgaagcagtctgtgaaatcaagaaacaattcttttgtggaagagactgatctgacatcatataaacagatgttcaaatggggccagatgcagtggatcatgcctgtaatctcaacactttgggagaccgaggaaggaggattgtttgtgcccaggtgttctagatcagactaggcaatgtagtgagaccccatctctacaaaaaggtttttaaaaatagcctagtgtggtggtgcatgcctgtagtcccactacagagtagctctgtggagactaaagcaggaggattgcttgaatccaagagataaaggctgcagtgagctatgattgcaccattgcactccagcctgggtgacagagcgagaccctgtattcaaaaaaaaaaaaaaaaaaattgctcgaaggcttgagaatagttaaaactatcataggaatcttttttgtacctaccagagtagcaacaaaatttaaaaattaataagctgtgatggcaaaaacgtggtgaaatgggcaccttcacgccttattggtaaagagtacagactgttgtaatcttcctggagcacctgacaaaaatcgcacgacaggtctgtcttcacaacatttgccgagggatattgtcaaggatctaatttcttcgttatgcagtgtccttccttttgagaagcaaagcaaggttttggtttcagtataatcatagttgttcttctgagccactgttatttcttaccttgtggacattgtcaggcctgtggcccaacctctttttacgctgcctgctgggaagcaccaagctcactggtctacacccctggcaaggagacagggcacctcgatgtttactttcagtactaaatacaccgtcagggctgggtgtagtggctcatgcctgtaatcccagcactttgggaggccgagataggcagatcacttgaggttaggagtttgagaccagcctggccaacatggtgaaaccctgtctctactaaaaacacaaaaaattagctgtgtgtggtggcgcacacctgtcatcccagctctttggaaggctgaggcaggagaatcgcttgaacccaggaggcagaggtagtagtgagccaagatcacaccgctgtactctggcctgggcaacagagcgaaaccctgtctcgaaaaaaaaaaaaatacacagttcgtcctgtcttcctacccttgccacatacttcccttctccatttttgtctgttgcagaacccctgtccagagactggggcagccttcccctccaaagccacgttctggtgggtttctgggtaagtaaagtcgcacggaagggttggggtggtgcctcacccgcctgcatttgctgctctgattcccagccatggcccttcccctgtgcttacaaaggccagcaagtctttcttcatcccagcctcagtgctttcttcttcgtgttcagtgtctaccatctgcatcctgttcccattcactcactggagtgagatcttgatttgaatcccggctctgcctgttagcaggccatgtcgcaaacctccggagtctcagttttccctctgtaaaatggggatgactcaacctgcatgagacggaaagtgcttagtgcttgcacacagcgggtgcttaatagtaattagaattgtctccaatacttgatttcagtcattccaccaacatttaataggcacctactatgtgctaagccccaggggtgaggagataaaggagcaagtgtctactttctagagggttccaggcagattgagaaaacagctgcttctccagggccagctcacaaggcacttgaggatgtgctctctcctaaccacacggcattcagacctcagtagcacctgacatatggatttgaatcctggccctaccacttcctagctgtgttgctttggacagttacttaacctctctgtgcctcagtctccactccttcaaaatgggattgatagtagcacttagctcatagggttgtgaagcttaaataagatgagatctgtaaagcacttagaacagggcctggcaaataatgagtttaagtggtaattatttttttttcttttgagatggagttccgttcttgttgcccaggctggagtacaatggcactatcttggctcactgcaacctccgcctcctgggttcaagcgattctcctgcctcagcctcccgagtagctgagattacaggcatgcaccactatgctcggctaattttgtatttttagtagagacagtgtttctccatgttggtcaggctgatctgaaactcccgacctcaggtgatctgcccgcctcggcttcccaaagtgctgggattacaggtgtgacccactgtgcctgggctattcattttctctttttttttttgagacagagtttcactcttgttgcccaggctgcagtgcaatggcacaatctcagctcactgcaacctccacctcccaggttcaagcaattctcctgcctcagcctcccgagcagctgggattacaggcgcctgccatcatgcccagctaatttttgtagttttttgtagagaccgggtttcaccacgttggccaagctggtctcaaactcctgacctcaagtgatctaccccactcgacctcccaaagtgctgggattacaggcataagccaccgcacccggcctaaatggctattaaataaatgaaaaatatcaggctttgaatgtgtggaactggtagaaagagcttagaggttttcgaaacagctctactggggggtccagcccctgcttcccaaacttaagcatttatggaccactcttgatgcttttttgtcctactggggcaaaaactaaattgagtcactttttttactcgaataaactgtttttaaaaagaaactctctatcactgctaaaataggaaaaatctatagcatcacttgccatataggagaactccaaaaataatttcagggaaaatcaagccacgttaataatttctatgtcagaacggttgcttccccaagttggctctgcattagaaaagggaacttggtggcctggcgcagtggctcacgcctataatcccaacaccttgggaggctgaggcaggtggatcacctgaggtcaggatttcgagaccagcctgaccaacatggtgaaaccccatctctactaaaaatataaaaattagccaggtgtggtggtgggagcctgcaatcccagtcactcaggaggctgaggcaggagaatcacttgaacccaggaggtggaggttgcggtgagccgagatcacaccagtgcactccagcctgagcaacagagtgagattccatctcaaaaaaataaaaagaataaaaataaaaaagaaaagggaacttggtaaggcttagagaagagtcagagaccagaaccaggcaagaccttctggctggtgtcatcagaaagattaaagagacctgaggccaggcacagtggctcacacccataatcccaacactttggaaggccaaccctgacagatcacttgaggccgggagttcgagaccagcctggccaacatggcgaaatcccatctctactataaacaaaaaaattagccaggtgtggtggcttacgcctgtagtcctagcactttgggaggctgaggtgggaggattgcttgaggccagtaggtcgagaccagcctggccagcatggtgatacaccatccaaaaacacaaaaattagccaggtgtgatggtggcttgtaatttcaactactcagaaggctgaggcgtgagaatcgcttgagccagggaggcggaggttgcagtgagcccagatcacatcagtgcactccagcctaggcaacagagtgagactccatctcaaaaaaaataataataattaaaaaaaaaaagctgagggaggagttcaagcttcttctacaatgatagttttggtcaacggacttctgattcccagggaaatgtctgtttcccttgccaagggctatcccttggtttagccactgaatctctctgcacttctatttccttccccatctgtaaaatagatctataataatatactcatacatttatacaattataaactatcaatttacaggctgggtgtggtggctcatgcctgtaatcccagcactttgggaggctgaggcaggtggatcacctgaggtcaggagttcgagaccagtctggccaacatggtgaaactccatctctacaaaaaatacaaaaattagccgggtatggtggtgggtgcctgtaatcccagctactcaggaggctgaggtgggagaatcgcttgaacctgggaggtggaggttgcagtgagccgagattgcaccactgcactccagcctgggagacagaacaagactccatctcaaacaaacaataataacctaccttatgggttcatgtaagaattaatgagacaatctttgtgaaacgagaaatgccctgcagacattaggtggggttagtgaattgctttctttttacccaggggccagtagaggtacagagaggtaaagtgacttacccagggtcacacagctactcgcctggccaggatcctgcaggggtgaatggcaggaaaagctttccctggtgcccctcttttgcagcctggtctggaggggatacaggaggccactgagaccaaaagacctctggtcgcttgggagagaaaactcctcagaagaacttgtttcccggcttgaaaaggagtggatgaggaaccgcagtgcagcccggaggtaagtgggtggaggtcaagaactcacctgatgctacttcagaaaagctcatcattggccgggtgcggtggctcacgactgtaatcccggcattttgggaggccgaggcaggcggatcacaaggtcaggagttcaagaccaatctggccaacatagtgaaaccccatctctgctaaaaatagaaaaattagctgggcgtggtggtaggcacctataatcccagctactcaggaggcttgaggcaggagaatcgtttgaacccaggaggcagaggttgcagtgagtggagatgtcaccattgcactccagcctgagtgacagggccagactccgtatcaaaaaaaaaaacaaacaaacaagacaaaaacaaaaacaaaaacaaaaaaacctcatcatttgacccccagtccagcccccaacgctactctggcggcactgccgcctccccaccttgccttccagctgatcccactaagtagtatcaggcttaagatatggttcctcccagaacgcatcacaggttcctacaaacggggaacaaacaggttcctacaaatggggaaatggcagaatgacaggcagcaaacagaagaggtattttaaggccggggtggagggttgggaggtgactcaacacacaagcagctgctcacttactatataacctgagcaattcctttcctgggcctcagttttctcatctgttcagtggggatgtcattagccccagctcatagcttatggggatgaaaaaaaaggatgatttatggaaaagaacttgcaaatgtcttgcaaatgggaagtgctcaagcactgttagtcatccagagggtgttaagatctttggagttatccactctgtccactcctgccctcagtggcatctctggaaacttctctgcagcccttagagcctgggatgcctcatttgagaaactctggtctagataaatgagcctgcataggattagataaaattgggttaaatgctgccctgccttcaaatagtgatgaccttggacacgttgcttaacctcaccggatcttggtgttttaggagacagaacaaaaaaggaagttagctctgtgggaagttccctgcatactccgggattttgtggtagttgttgcagatggctgaatcccacacattaagagagacagaggagacagagactgatactataggctcacacagctaagaggatctagcctcaggtgttgctggatcaggggactcaaatgatgtcaggattctctcctttcatctcccatcccaactattatctatgtgttggtctctccataaggcctatcccttcccatgcaagttcagcaaactccagcagaataagagagcatctctctcctaacgtccatatagtaaatcccaaggaaggcctctaattggcctggctcaagtcatgtgcctgtcaggggccaatcccatgcccagggggctggtgccatgactggtggtcccttcagagccacagaagtgggtaggggctgttcccacaaaggaagggcatgtgtttttccaaacagaataagtagtgtgagagaaccaaaacatcagttctctctcaccccaggcatggcttgctggacccccttcactgggttgtggtatgatctcagctcactgcaacctccacctcctgggttcaagcaattctcctgcctcagccttctgagtagctgggaccacaggcgtgtgccaccacatctagctgatttttaaattttttttagtagagacagggtctcaccatgttggccagggtgatcttgaactcctgacctcaggggatctgcctgccttggcctctcaaggtgctgggattacagatgtgagctactgcacctgactcaccctctacttttgaatgattttacggaagtggcagaatccagtccacaggggctctggaaggagcctctgccaactcctggcatccccagccaacatgaaaattacaggtcacccaacactagaactaaagggtagaaacattctccagaacagtttgagaatcctcccataaacagttgacagaaagaaaggggaaagatggggttatacaaagaccaggctccgtcagcttctgaaacaaccgactgcacccacagagaactttggttttctttctgaagtattttgcaaccactgggggaagggagagggcgtcctcctgagaggccacacaacagccacctgctggtccagtcggcttcactaatttttgtattttttattagaggcggggtttctccatgttgctcaggctatcagactggccctgaactcctgacctcaggtgattcgcccgcattggcctcccaaagtgctgggattacaggtgtgagccaccgtgcccggcctccaccactcccttttgtatcccccaactcacaccttgcccatgccactcatgcataccccctgccttgccccaccatcatttgtgagatctgcactaaatggccttcagtccagagaccagacgtcagacagcaatctggacatcttccttgatgggaggtgagacctgcaggagaggaaaacacttgctatggagcctgcaggctgaacacactgactctctgggttaaacagctcaaatagaactgagcagaacctcagccagaaagaaaactttccagtgaactcttccccgaccccattttgcagatggaaacactaaggctcagaggagaggagacagagcaggcattggaaccacagtctcctggctccaaagccaagttctgtccacccagccaagctccttccttccttctataaatttttataacagtatgtgcagggggcactcttattaggccctttgcacacatcactcaatctgtttttcccattcatttgacaagtgtttattgagctcctactgtgtgcaggagctggactctatactagggacatcttggtggaaaacacaggcaaagtctacccacctggggttctaacgagacaaagagagggttggagccatggacatggctgtgaaggcaatgaattaaatggcaggatcaaacaggaaagggtgggcagggatgctctctgtatggaaggggcatcttcttggctttgagatccaaatgccaaaatatttgtgagcagcaggccacacccactcagtaacagagctgaaccacaaccctccatagatgccaaaccaaacaccagatcagaccaataatgtgggacagagaccttggccttgaagggtctggccacctgagctcaccagaggtttttcttatgcttctttttttattattattttattatggtgaggttgggggtccttagtgcacaagaaaccctttacaaaccataaatcaagatctaggctcaaatccctgctctgcccttgctgtgtgacctcgggcggctgtcgccatctctcagagcctcagcttccccttctgtaaaatggaaaacctaataatgctcacctggcaaggggatccaggggagtcagtgagctccttcgtgtaaagagctgatcccagcacgtggccccgggtcacagatctgtaatggggattgaaattactgataagtggccgggcatggtggctcacacctgtaatcccagcactttgggaggccgaggcaggtggatcacctgaggtcaggagtttaagaccagcctggctaacgttgtgaaaccctgtctctaccaaaaatacaaaaattagccaggcatggtggtgtgtgcctgtaatcccagctacttgggaggctgaggcaggagaattgcttgaacccaggaggcagaggttgcggtgagccgagattgctacactgcactccagcctgggcgacaagagcgaaactctgtctcaaaaaaaaaaaaaaagaaaagaaaaagaaaaagaaattactgataaccttataggttgtcagagccacaggggactcagcaggggaccacacccatcctctcacacacagagagaggagcagtgtccccgcccaggaccacacagcaaccggactgtcagcagctgcatcgccccagcctctcctttctggcccagggcttctgacctgcctcacaggggccctcgggcctcccccatctcctcctctccctccctcaccttagctcttctctgtggcccctggttatagccaaaggctggggatcttattagtttgaggcagcctgagcttctgtctgcactttcacccagagctagagcaccaggccccatgcccatcagccgtgattctccaccagttcaaaaccacctaagggctggctgattgtgtgtgttggggacggggtgctgttcttcctccaggttgacaacacgataggttgaaaagtacatgagaggccaggtgtggtggctcacatctgtaatcccagcactttgggaggccaaggcgagcagatcacctcaggtcaggagttcaaaaccaacctggccaacatggcataaccccttctctactgaaaatacaaaaattagctgggtatggtggcacttgcctgtaatcccagctactcgagaggctgaggtgggacaatcacttgaactgggaagtggaggttgccgtgagctgagatcacaccactgcactccagcctgggcgacagagcaagacttcgtctcaaaaaaaaaaaaaggaaaagaaaaaagaaaagtgcatgggctctggaggcagagagctggaatcaaattccagttcttttacttctcagctgtgtgcccttgggcaagttcgcttctctgagccccagttttctcatctgtgaaatgggaacaacacctggcttctcagggggtcttaggatgactggggagtgcctggcacatagtaggtgctcaacaggtgtgctttcccatggccatctaagaggcctcagagtgccctcctgccctgccccccaactcccatgattgcctcttaagtgggtactcagggtgataaggaggaacaggtgagggagccaggctagatccacacccacccatctccactgttgggaaaacaaccctttaatgcctggccctgccgctggcggctgagagtataaaatgggacccagagctaatctctcccttcccctcaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcaggtgagtcccagacctcaagtgccctgctaaggtgggtggtctcttagtggcatccttccagggccagggggcttcagctctcctgcctctgcctatacgtctggtgctcgggacactggatggtgggtgagaaggacactgaggaagggaaatggattaatgagaaagtgactgacccccagaagggcaaataagcaagctcttacctgactgcatcaattagtttttgctgtaaaatgccccaaaagtgagtggcttaaaatgacaaacattcttttatttagttcatggtaatgtgggtcagtaatgtgggctgggctcagctgggtggtggttcttttcttggctgggttttctcatgtgcctgcagttgtgtatctgagactgggatggctgtctctgctccatgtgggtccccatcctccaaaaggctagctcagacttgttcatgtgggtgcttgggagggttctaagaaatagaccaaaaaccacattttctcttgaggcctaggctcagagccagcatggctttacctccactgtactctgttggccaaagccggttttgtagccagcccagattcaagtggtgtctgctcagctgacataacaaagcatcacagactgagactgagtggcttgaacaacagaaatgtattttatcatgattctcaaagctggaagttcgagattagtatctgcaaggtggttccatctgaggcctctgtccttggcttgcagttggccacctcctccctgtgtccccatatggtctttcctctgtttgcgccccctggtgtctccttgtgtgtctacatttcctcttcttaaaaggaccccatcagattggattagggcccagcctaatgacctcatttttaacttcattgcctctttaaaggccctatttccaaatacagtcacattcagaggtactgggggtcggggcttcaacatataaactttgtgaggacacaatttagcctataacaagtgggaacaaaaactccacctcttgatcttgaggagctgcagtcagattgaaaaggagtatggacagtgggggaaataacggagaccattattgcaaaaaaaaccacactgactgatcctccacacctggactagtttgggccgactgatcctccacatctggactggtttgggcaaaggcaacacccttaggcacctcctctcaccagctgtaccttctccctccttcccctgcaagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtgagccctgggggacaagggcaggtcttcccagccaggaaaagcagtatcactgagcgggcagtaatgttatcagcagctgagaacgcattcagtccttgcttattagagtcactcaccatacattctcacttccttagttatttctctgtattatatgtatttatttttttgagatggagtcttgctctgtcacccaggctggagtgcagtggtgcaatctcggctcactgcaacctccgcctcccgggttcaagtgattctcctgcctcagcctcctgagtaactgggactatagacacgtgtcaccacgcccagctaatttttatatttttggtagagacaaggttttgccatgttggtcaggctggtctcgaactcctagcctcaagtgatctgtctcagctccttagttattcctgtaaggtcttgtgtgatctgtccctagggtgtctctgacctcatcccgtcacctcctcccatgctcactctcctccagccacacaggtctcctttcagttcctcaaacactccaggcccccacccaccctggggcctttgcagctgttctcactgtctaggcaccacttctactcccccaatctaattttaatttttgagcctgattttaacttccactcattcccccttgaggataaaggattaaccttctgataaggtggcctgtcagctgtgttcccagacaatactgcttggggtaaaaatgacccctaggctgggcacagtggtgcacgcctgtaattccagcaatttgggaggctgagacaggcggatcacttgaggtcaggagttcaagaccagcctggccaacatggcgaaaccccatctctactaaaaatacaaaaattagccaggcatggtggcatgtgcctgtaattccagctacttgggaagctgacacaggagaatcgcttgaacccgggaggtggaggttgcagtgaactgagatcacgccactacagcgcagcctgggtaagagagcgagacctcgtctcagaacaaaaaaaaaacaaaacaaaaaaacccaaattgcatctgggctggaagttctgtccattgactgtgaatacctggttggaggccatagctttagacttctctctgtgcagtggctcttgtccgttcctgggactctggaagctaagtccctggactgctgccccaagagctattggctcctgtggggtatggagcatctgagccagggcaggtcccgtcccatgtaagtgtcattccctgacacctgagctgtcacctaggggaggaggggacagaggggacagctcctaggtggccgagagggcagctcttgatgctttcctgccagagtgctgcatcccaggctcctgttcccctgagcatgccagagctaggtgtgccctatcctgtcttgagagtccacatttccttgagcctaagaggaaggccgcctggtgagcaggcattgatcttcctattccccacccacacgccaggaggccttctttgatctcctgatgagatcagatccctcctctctaacctctgggcttttttttttttttttttttctgacagagtttcgctcttgttgcccaggctggagtgcagtggcacagtcccggctcactacaacctccgccccctgggttcaagtgattctcctgtctcagcttcctgagtagctgggattacaggtgtgcgccaccatgcccggctaattttgtatttttagtagacagggttttaccatgttggccaagctggtatcgaactcctgacctcaggtgatccacccacctcagcctcccaaagtgctgggattacagacatgagccaacgcgctcagcctgggctacttttttatgttactcatcataactgccattaaagcatgagttttagaaatatttttgttttgtcttatttttttgagacagagtctcactctgtcacccaggctgtagtgcagcggtgcaatcttggctcactgcaacctctgcctcctgggttcaagcaattgtcctgcctcaccctcccaaatagctgggattacaggtgcccaccagcatgcccagttaatttttgtatttttactagagatggggttttgccatattggccaggctgatctcgaactcccggcctcaagcaatccacccgcctcagcctcccaaagtgctgggattacaggtgtgagccactgtgcccggccagttatataaatctttattatagagccttgttccccacctcaaactccaggcccgggagagcaagcctcatctctgttgttcacagctgtattttcagttcccagctcagtgtgagtcacacagtgagcactcttcaaagacttgctaagtggagaatttctatgtccagtcattcctggatcacttcttcacaccctcacgcagtcacaaagggagggctgcatttggaatttagcattcaacaggctggaagaggtccactgtgaccccagggttaaggcagatgtgaggctgccagagaaccaggttggtgtcacagaagcacatgaaaggtctcacccttgtcatgccttcgtcaccctggattccattccttgtgtaggagcttacaaggcctgtgactttgggcaagttgctcaacttctctctgcctcagtttctttagccatagaatggggttagtaaatgttcatttcattgattctcgtctcacatttttttttcactctaatacttccaaaatcgagatgtctcttacatgtcttaatttaactggaagtggtattttccttggtgagagaataatagagagcaatttatccatagaattttttttaaagacagggtcttgctctgttgcccaggctagagtgcagtggcaccaacatggctcactgcagcctcaacctcctgtactcaattaatcctcccacctcagcctccccagtagctagctaggaccacaggcgcaccacaaccatgcctggctaattttttcttttttcccccccgaaatggattttgctcttgttgcccagactggaatgcaatggcttgatctgggctcactgcaacctctgcctcctgggtttaagcgattctcttgcctcagcctcccaagtagctgggattacaggtgcctgccaccatgcccagctaatttttgtatttttggtagagacagggtttcaccatgttggccaggctggtctccacctcctgacctcaggtgatctgtccacctcggcctcccaaagtgctgggattatagacgtgaggcaccgcacccggccccctggctaattttttaaagtattttgtagagcttgggtcttactatgtcgcgcgggctggtttcgaactcctgggatcaagcaatcctcccacctcagcctcccagagtggcgggattacaggcagaggccactgcacctggcctggcattagagggaatgaatatggtagtgcctgcttggtaccattcatggctgtgagcaccccgggaaaggataaggctgttcatttagcacagtgcctgcgacatggtgagcactgggcagatgaccaccgttatctgtgttaatctggtgttttcgtgcatgttattcattattatgcctcccgtgctttagggatcttggaggattttcatttttgtcatctctgtggatcctcaaagagccctgagaggttggcctaagagactttactcacccacctcgcagacgtgtgaggtggggctcagtgggtggagaagccacctggggcatccctctgccccggcctccccactttacttctctccttctgcccacccgccaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcaggtatgccagaggaggaagacgggatttgaacggagtcccccaccccctccttctccccctcctccttccccctcccacccttcctcctcctgacttagcattcaagaggctggaagaggtccgctgtgaccccagggttagggcaagtctgaggctgtgggagaaccaggttggtgtcagagaggcacatgaaaggttttacccttgttctgccttcatcaccctggattccattcctggtgtagaagctcataaggcttcctcccctctccctctgccccagcctcctcctcctgcccccctcctcttgcacccctccctgcaccctccctcctcctgcatctctcccaccttctgcccacgcaccccctcctcttcctgcaccccttccttttcctccttccccctcctcctcctcttcctctctcctgctccaccttcttcttcctttctgctccctgtcatcttccctcccacttcttcccttctcccttcttctcctctaccgtcctccctctcttccctctgctcttccctctccttctcttccctttcttcttcctctcctcctttttctcctccccttccacccccatctcctccttctcctcctcctccaatcctgtctcaatttgcctactattgtctgatacgatgggaaaagtcctcaataaggatgaccttcacttgaccttgggcaggaagttcaccctctctgggcctcagtttcctctgtagaaagatgatgatgatgacgttgatacttccccatgtgctattagggtacccagtaggcaagttaaccatgttttgaagttaccagtaaccctgaggcaccaccatagccactgtccacaaaacacaagaggagaacattttagggggaaaaattgctacttagtgttcaaaaaacacaaagtagccatcaggaaacaaccaaacaaaacaaacaaaacatttactttccaacttcattcctttaacgttgtggtataggattttctttttttaaattaaaatcagactctgggccaggcacagtggctcatgcctataatctcagcaatttggggggtgaggtaggtggatcacttgaggccaggagttccagaccagcctggccaaccccgtctctactgaaagatacaaaaattagccgggcatagtggtgggtgcctataaccccatccactcaggaggctgaggcaggagaatcgcttgagccttggaggtggaagttgcagtgagctgagataatgccactgcactccagcctgggtgacagagtgagactctgtctccaacaaataaataaaagtaaaaataaaattagactctgtatcgggaactgcctaggctcaaatcctccttctgaccacttatcagttgtgaatctgtgtgcaaggaccctactctctctgtgcctcctgttcttgtctccaacgtgaggatcataattaacagtagcactcctgccccagaggggctgaggcattaaacgagcccatatgtagaaagcacttaaaagggtgccgggcacacaactgcaccctgtaggtatttgtaatattatcattagttacttttccataaaggataagacagtagatgctttttacactggaggccacaccatctctcctgcaaatattcatctctgcccttggagtgcagaagtggctgtagaccatactaagcaaacaggcatggtattcctccaataaaactctatttatggatgctgacatttgaagtgcatatcattttcatatgtcgtgaaatagtatccttttgattttttttttttttttgagacagagtctcactgtgttgcccaggctttggtgcaatggcacaacttcggctcactgcaacctccacctcccaggttcaagcaattatccagcctcagcctcctgagtagctgggattacaggcgtgcaccacaacatctggctaatttttgtatttttagtagaaactgggtttcaccatgttggctgggctggtcctgaactcctgacctcaggtgatctgcccacctcagcctcccaaagtgctgggattacgggcatgagccactgtgcctggccttgtaaaaactgttaatggcattttgattgtaattgctgaatattccaaaaaaaactcgaatgctcatgcatatgattgtttttgctaaggctaggggccaggactttttccagtgtcttcaccttgtattccagggccttgcaaacaataggcaggtgcttagcaattacaacataaggcactcagacagggcttcatgtgcagtacataaatgtcatcattaggaagaaagagagggagagaggaagaacatgggaaaattcagggcaattgatcaggttgaccccaccgttgctaaaaatcagatgagaccaggcggggcacggtggctcacgcctgtaatcccagcactttgggaggtgaaggccggcagaacacttgaggtcaggagttcaagaccagcctggccaacatggcaaaaccctgtctctactgaaaatataaaaattagccgggcatggtggcatgtgcctgtaatcccagctactagagaggctgaggcaggagaatcacttgaacccgggaggtggaggttgcagtgagctgagatcacatcactgcactgcagcctggacgacagagtgagactccttctaaaaaaaaaaaaaaaaaaaaaaaaaaaattagatgagaccaacaagatatccatagataatgcaccatgttactttgcttgtgtacttttcctgcctcttggtagacagttcctaacatcaccgtgaggtcttggtgaaggaggagtggacactgaggttgctacagtttaatgataccatttttcccccagacagagatgttcatcttctgctcacattccttgagtgtttttccaagccctgctgtgggctggtgtttaccctctgcgcccttctccattgagccactaggtagcgccattgccgcataaatgaaacaaactggcccaatgttagaaaatagtgttcccaggccaggtggggtggctcaaacctgtaatatcagcactttgggaggctgaggtgggtggatcacttgaggccaggagttcgagaccagcctgggcaacgtggtgaaaccccatctctactaaaaatacaaaaattagccgagtgacacatgcctgtaatcccagctactcaggaggctgagacaggagaatcgcttgggaagcagaggttgcagtgagccaagatcatgagactgcactccagcctgggtcacagaacaagaatccatctcaaaataaacaaacaaataaataaataaataaacatagtgttcctaaggactgagacgggaaactgaggcacacagactggagttggggtggggcttgtcaagagaatgggtccaaataacctgtgcagaaatctcagaaagtcacagcaacttaaaaatcatttattctaccccccacttccacattttccagatatagaaaccaaagccgagagggggaagataaccatcccaaaatcaccacgttggtgggggagcagggttgccagagaaaacacaggacattcagtgaagtgtgagtttcagacaaacggaagaatttctcagtgtatgtcccaaatatttcacgagacttagactaaaaccttattcactctttatcttcaaatgtaactgggcattctgtatgatgatttactaaatctgacaacccttgcgagggatgaaatgaagattaggaaaataattaaacgcaataagagaaaatgccaaatgagaacaactctattcccattttgcagacaagagaattgcacctaagggagatgacttgccccaaggccacactcaaaactctcagggtcaggatttgaaccaggtcccctgattccataggtctcaactttactgttgtggctgggaacaccccccagtcccactcgtgtgtgtgcacaatctgtcttgaatataactctctccctatcgtgtaagagggctgtttccctccctgacattgaaggaccccaccttcagcaggcatctcctgacacagcagaccccatgagcacagatccctgggacctggtggctgcccttatcagattccctgacatccccatcttaggacccaagtctgaccaccttcggggtctgcagctgtgttacagaaaaggggtcctgatccagatcccaaaagagggttcttggatctcgtgcaagaaagaattcagggcgagtccataaagtgaaagcaagtgtttgtttgtttgttttttgagacggagtctcactctgccacccaggctggagtgcagtggtgcgatcgtggctcactgtaagctccgcctcctgggttcaagctattctcctgcctcagcctctcgagtagctgggatcacaggtgcccaccaccacacctggctagtttttatatttttagtagagactgtgtttcactatgttggccaggctggtctcaaactcctgacctcaggtgatctgcccgcctccggcctcccaaagtgctggtattacaggcatgatccaccgtgcccggccaaaagcaagttttttagtaaagtaaagatctaaaagaatggctactccatagagagagcaacccagagggctgctggttgcccatttttatggttatttcttgatgatatgctaaacaaggggtggattattcatgcctttccttcttagaccatatagggtaacttcctgatgttgccatggcatttgtaaactgtcatggcgctggtggagtgtagcagtgaggatgacgggaggtcactctcgtagccatcttggttttggtgggatttggccgccttctttactgcaacctgttttatcaggaaggtctttgtgacctgtatcttgtgccgacctcctatctcatcctgtgacttacaataccctaaccgtctgggaatgcagcccagtaggtctcagcctcattttacccagtccctattcaagatggagttgctctggttcacgtgcctctgagagctgggctcctcgggatctcctgacatcctgccccttctatccccagctcctggggccctccgccctcactgccatcgctgtcttcctgagcctcctccctctgaatttcttcatctccaagaaaaggaaccaccatcaggtttggcttttgggaaagggacggaccaggcaggaagtagggaggaagccacaggtcctggtgtgggagatgcggaggggagagctgagtgcgagcccacgggtctggctttgttcttgtcgtctgtgagctgcccatcactcagacctgcaccccctccccctatcctctcaatggacagtggctccgtccctccaatgttcaggccacaggccctgggtcagttcaatgcctttttctctcacatcccatctgtcagcagatttgcttggcatcaccttcaaaatgcatccaaaatgtcacacttcccagcataggctctccgaaccccatgatctctaacccaggtcacagcagcaagcccctggctcactccccgcctctgccctcagcctctctccactcccagccagaggagacctatgcaaaccaaatacgttgtacccctcctctactcagacccacagcggccccattttcctcagactgagccaaagaccccacagtggcccaccaggcccgccctgagctggccttattgcttccaacctcaccttctacccatctcccctccttccctgcctttccccacacatctcccatcctcaaacctgcccgatctcacacatccctgcaggccttcgctttagctgttccctccacctggatcaccctcactcccgaagatcctctgtcacctccctgcagtcagggcggcttccctcaccaccctccagcaaggaaatggcacgtccatccctcccctcccagcagcagcctctcctttgcctgccctgggattgtttttgcttttttccccccacagcacttcccacaacctacagggtcctacaggaagcacccggcagggttgattgccttgttttccttaactggaagctttgcaacagcacaggccactgattgtggccaactcggcatctagttagtgcttggcaggcagaaggttctcagtaagtgtttgtgaactatggaagaaaggagggagggaagaaggaaaggaggagaggaaggagggaggggaaggagagaaaaggagggagggaaggaaagataggaaaggggaggaaggacagagggaaggagggaaggaaagaattgagggcggaagagaaggaatgagggagagaaggaagaaaggggggagggagggaaggaaataaaaggaaagagggaagaaagcaaaggaaagaggaagaaaggagatagggaaggaaggaaagaaaaggcgggaaagagagagggagagatgggggatggagggaaggaacttatttcctctcttggcccagctgtcccagtgtccgtctgtcacctgggctgtttcttcagcctcctgcgtggactcctctaaaacattctaggctgggcacagtggctgacacctgtaatcccagcactttgggaggccacacctgtaatcccagcactttgggaggccgaggcaggcagatcacctgaggtcaggagttcaaaaccagcctggccaacatggcataaccctgcctccacaaaaaatacaaaatttagccgggcgtggtggcgggcgcctgtaatcccagctactcgggaagctcaggcaggagaatcgcttgaacccaggaggcggaggttacagtgagccgagaccacaccactgcactccagcctgggcgacagaggaagactcggtctcaaaaagtaaaaccttctccaggcagctgcccctctgatgatgccccccgccccatggtgaagcacaggagaccctgaattcttctgcctgactttaaagtgccaagtgaccctgcccacacgctcctctggtcacactgagtgtcctctgagtcatgctattccctgtgcctgggttttaggtgcccccgccacccccctaccccccagcccccaccccccacccccatctcaagcccctcccctccctcttctccagctccatccccccatcctctgcctgctcagcacgcacttcctggtcatttaagatttagctcaggctgtaatcccagcattttaggaggctgagggcagaggatcacttgagcccaggagctcgaggccaacctgggcaacatagtgagaccccaactccacaaaaaatgtaaaaggtaaaaaaaaaaaaagacgtagctcaggcatcaaccacctccaggtagccttcctgatggtgtcatacccaggtgggctcaggctgcctctgttctccgggcatcagaggcttcctccatggggcacattatcccaggggcactcctgcagaagtccaggtacaggatgatggtggttggaccaggagtgagggtcagaggtgctgagaggcagacaggtttgggacgcagtttggtgagatgaatgggatttgctgaagggtggctgtcagggtgcagggaagagttctcaactgtccctgtcttcatctctctttttccctccgatcccaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtgacgtcactctagtctctatgctgagcagcactggggaaggagtgcgggggtgggggcagggtgaggtaggtggagccccccagatcctaccaccccgtccatcaaaacccactcattctggatcctgttctctctgggtccctgctgtcttctacaagaactaattaatcatattattctagcaaaggtggcagtggctgataaagtctgctgaactctcagagagagttccaggcttctaccgatgtggggaggagggtacagatgcaggggggtggcagaggtagaatcctgggtcagagtgacttccctgatcctggccagcagatgtccatagccaccctgtcactggacgtgatccttgtcctgccattctgtaatttatttcatattgctgtcagaacaaccttcctaaaccacagttttaaaaaatttgatacgtaggctgggtgtggtggctcatgcctgtcgtcccaatactttgggaggccgaggtgggtggatcacctgaggtcaggagttcaagaccagcctggccaacatggcgaaaccctgtctctactaaaaatacaaaaattagctggttgcagtggcgggcgcctgtaatcccagctacttgggagtctgaggcaggagaatcacttgaacccaggaggcagaggttgcagtgagccgagatcatgccactgtactccagcctgggcgacagagcaagacttcatctcaaaaaaaaaaaaaaaagcaccacaaatggcaccaacacctagagccctcaagtgctgctcctgcctgcaactttagagtcatcttccaagggactctagaatcacaagttccaccacgtctagaacaacagggctaccaagatcaaaaactctgctgtcccccgatgcctggaacctagaggcattaggttctcccctaggttctagtgatgcctagagccgtggggctgcgcactcatcaccattagcaatgcgctgtgtctttagagagagccttatgtagcttatgactgcggagaggacatgtgttagcaggactgggagtgggatctacggagggaagcacatgcggacatggcgggtgggccacatggaccgtgcaggcaccacagcttgcccaggctgccctatccatgcttgcgtgtctcactgttgccccacgtgtcccccccaccccccaggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggtgaggtgggtgcaagggctggagccatcctgggagagtgcgtgggctacacctggctccagcttccctacccctgccatttgcagaggagagggaagacagagtgggagggagagggatggtgtggagctggaaaagaggcgggtaggggcaagaacagaggcgggcagagagtacagcaaatacatctggaaggggtcagcctttggagggcaatgtgcagacctttccacacacacctcagaacatgcatacttgtccatctgcccagcaattccacatacaagcaatcatgtcagttcccttttttatacaaagcgattttgtttctcttcctttgctatctctagtcctttcagcatggtgaaaacaagaaacggcggcatacctgagccatctccatgttttttattttttatttttatttatttatttatttgagatggagtctcactctgtcacccaggctggagtgcagtggtgcaatctcggctcactgcaagatctacctcgcagattcaagtgattctcctgccccagcctgccaagtagctgggaccacaggcatgcacaaccatgcccagctaatttttttttttttttttgtatttttagtagagatgagatttcaccatgttggccaggcaggtcttgaaccgctgacctcaggtgatctgcccaccttggcctcccaaagtgctgattacagacatgagccactgcacccagtcttatttatttatttattgtgtttttagtagagacagggtttcaccatgttggccaggccaggctggtcttgaacccccgacctcatgtaataagcccgcctcagcctcccaaagtgctaggattacaggcatgagccaccgcgcctggccgccttatttatttatttatttatttatttatttatttatttaatttatttattgagacagtgtctcactctgtcacccaggctggagtgcagtggcacgatctcagctcactgcatgctcaaactcctggactcaagtgatgcttctacctcccagcctcctgagtagctgggactacaggcatgggccaccacatccggctaatttttttaattttttgtagaaacaaagagtcttgctatgttccccaggtctccaactcctggcctcaagtgatcctcctgcacttggcttcccaaagtgctgggattaccggcatgagccgctgcacctggcctaatctctattttaacgactggtctctttcttccccaaagatgggtttgtgactgggagagagcgcccccaggtggacaacatttgaaattgttccacacaatggcttgataaccttattggaaaagccaccatcctcttcccagatcttgtctgcagaatggcagctggcttgcttcggtgtcactgatttgtaggatcgcagaggtgggagatcaccaccatcaaggtcaccactcgggttgcatcgtttcccatgaactagaaagctttgtcctcacgcctcctatgcacagagcttggtagacaggaagctgttgccacacatcttgagacaccgacacccaaaacctgagttctttgctcttcttgctgggtgacctgcggcttcggttttcctaggcccgggtgtcctttgaccgtctggtcaccttcctctgcctggaagaagttgaccctggtgtcgtagactcaagttcctctggaagcggtgagtgctgagtctggcaggaggggtgtgggagggatgggggatgtgggggccaccccagcccataatggcaagccagcatcagtactggggggagatgggggctgcgggcaatggatgacacgtgcagatcacgccatctgcgtgtcacttggaaactggcaccgtgctgctcttctttctgctagccattcagcgaccactcactgagcgcccactttgtaccatcctgggtgtacaacagggaacactctaacacagtggtccccaagctttttggcaccagggactggttttgtggaagacagttttcccacggaccggggagaggcgcgtggttttgggatgattcaaacacattccatttattgtgccctttattattattacattgtactatataatgaaataattatacaactcaccataacgtagaaccagtgggagccctgagcttgctttccgtcaactagatggccccaaagcgggtgatgggagacagagatcatcaggcattagattcttataaggaacacgcaacccagattcctcacatgcacagttcacaagtgttcgtgctcctttgagaatctattgctgctgctgatttggcaggaggtggagctcaggcggtgatgggagtgatggggagtggctataaacacagatgacactctgctcacctgccctgcgctcacctcctgctgtatggcccagttcctaagaggctgcagactggtaccagtctgtggcctgggggttgaggactcctgctctaacagaccaggtccttgtcctcatgcagaaagtcccaggtaataagcatgacagcattttgatcaagctggaaaatagcagcatttcaagcaccattgcacgatgagacttaccaagctcaagttacctgggcttccccctccaccccatccttcttttatgccacgggccaagacaccctcccccttgttgcactgaagaacctgggcaaactgtgtacctggaaaacacccacatagtggtaagaagccgagcctgtggcattcaactgcccaggtccaaatcccagccccagcactgactagctgggtgatcctgacaagtagatcatctctctgagcttccgtgttcccatctccaaaatgggcatgttaatcgttatagcagctaattgtgacgatgaatttaattgatctgggctaagccatgagagctttgatttttagaaaatctttcaggcaattctaactacgtcttaaggatcaagaaccactaatctaattacacttgttatcacagtgaaataataataataattagtagtagtagcagtagtatttttgagacacagtcttactccgtcatccaggctggagtgcagtggtgcaatcttggttcactgcaacctccgcctcctgggttcaagcaattctcctgccttagcctctcaagtagctgtgattacaggcgcccaccaccacgcctggctaatttttgtattttttggtagaggcagggttttgccatgttggccaggctggtctcaaactcctgacctcaagtgatcctaccacctctgcttcctaaagtgctgggattacaggcatgagacactgtgccggccacagtgaaattaataacacccccttcactctgggaaggctgggatttgatgataatttatttcagaaattcactaactttttccataaatgaccagattgtgcatattttaggcctgtgggccacacagtctctgtcacaactgctcaaagcatgaaatagagaaatgaatggatgtggccgtgttccaataaaactttatttataagaaaaggcagcaggcaggatttggtctctgggccacagtttgcctccccctggattatgtagccatgggacacggacagaacaagaaccctgcggggtcacccacaagccagtgagtagcagggcaatttgttcagtgggagagatttcttcctgcagcctctgcccctggggggggcgggggatggtgcctgggggcctctccgatgcagaggccggccaggtcaggggtctcctgtaaatggcctcttgtgccctgcagctgccgggaaggattgcatcaccatacacagtgccaccttcgcctggtcccaggaaagccctccctgcctccacaggtacagaacgacacccgtagtaaccagcctcatgtttttagggagaagatgcatggggctcctgctgcctcccacctgagaggtggtgtaggtttccagcctgggactggagggtgggtttggctgggctggggctctgccggggaggttctcaggatacatctctacctcctgaaggtggggacctgcacagcatagaccagtatctcctgcagacggggaccagggcatctgagcctcccccattagggggagacacccctgtgctcccaggctggccaagacgatgccaagggagggctggctgagaggagccccaaggttcagccctatcagctgtgctcacttctgtgcctcctgtatcagtccgaggtcatgatcatctatagtctccaactctatcgcttggtctttgtggccaaaaatctcagacagccctgaaactccctaagaagagaaggaatatgccccaggtagtatttgtattggttgtcattcactcacttcatcgatagagcactaggtatgggccacgctctgttctaggtattggggatagggcgaaggaaacagacaagggccctgctctcgtggggtgacatgctgatagaggtgaggcccaaacagaaaaccagagcaagggaacagagtacgatggcatgtctagcgagggaaggctttgcattcaagccgagatcataaggaaggagtgtctgggagaagagctgttctttttttttttttttttttttttttttttgaaacggagtcttgctctatcacgcgggctggagtgcaatggcatgatctcggctcactgcaacctccaccttccggattcaagcaattctcctgcctcagcctcccgagtagctgggattacaggcgcatgctaccacacccagctaatttttgtatttttagtagagatgggttttaccatgttcgtcaggctggtctccaactcctgacctcaagtgatccacctgcctcagttcccaaaggactaggattacaggcatgagccaccgtgcccggcctgggagaagaaccttctaggcggtgggaatggcatcagcaaaggtcctggggcaggagagtgcctggacctgggtttctcaacctcagcacggttgatattttgggctgaaactcctttgttgggggctgtcgtgtgcattgtgggatgtttagctgaccccagtctctacccactagatgccagcagcaccccctactggttgtgacatccaaaaatatctctagatcttgccaaatgactcctgggggatgcagtcaccccctggtgagaaccactggccttttgtgttcaagaaacagcaaggaggtcagcaaggccagggccgagcagctgaggcacagagcggaaggaggcgggagatgtcattcctgatcgtcaggactttagctttgaccctgagtgaaatgggagtgctggcgggtttagctgggaagtgtcacgatctgacttgggttttaacagatccctctggtcactgggtggaggatgggctgtgggacgtggacaggagtggggcgggaccaagagtagcgggagggagggaggaaagagcctatttatcgcaagagccaaggcaggaggccaggctggtgaaaccctcaggctatagtcaaccctgtgtgtgtgtgcgtggtgtgcatgtgtgcacacatgtatgcgtgtgagcatggattgattgggtatgtgcatgcacttgtgtgtgtgtggatgcgtgcccacattgtgttgctgtgcatgctagcatgcttgtatgagtgtgcaaatgtgcatgcatgtgtgcacgctttgtgtgcatgtgtacatgcacagatgtgcacaggatagttcctcaaatagctagacaaggactgggaaaaagaacagccccacaggtcctcttggagactcccagagcaggaaagctcagctccgtctggggctcatccttcctcacagaggcgggctgaaccctaaccaaggtcatgtctcccctcttgcgtgtccagaataaacctcacggtgccccagggctgtctgctggctgttgtcggtccagtgggggcagggaagtcctccctgctgtccgccctccttggggagctgtcaaaggtggaggggttcgtgagcatcgaggtgaggccacccccagcctgtctgctaggatgtccccatcctgaaagtcccacttcctcgctgccttcccaccctccccatcccagccaagttcactttcactcattctctccacctctcacccaccactgagagcccagctcccactgctcctcaaaacctatcccacctctgtccccatcatcctcctgtgaccaaagtaagttgtgttttagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcaggtgagagtttgggggtctttttgggacagggagacattgcagttgggagtcatttgggtccccgactcatcatgggcagtatgatggagaaatgagaggaatggttagggaagtagcggagaaaaagggctcagctcagcgtcaagcacgtgctaggtgctcaatacgtaatcactaattgataagcagaaatagacacaaagagagaggcagggagttgtggcagggattggcagtgaggagctctctgacaactgagagtgagaagacctagactcctgtcttactctgccctgccttgctgagtaatgttggtgtaattgcttcccctctctgggcctcaccaaggggtctggacagagatgtccaagaaacaggatatatgcatctggagctatggattgggcaggggttggcaaactgtgaccccaagccaaatccagcccaccacttgtggttttgttttttgttttgttttggagacagagtcttgctctgttgcacaggctggcatgcagtgatgcaatctcggctcactgcaacctccgcctcccacgttcaagcaattctcacacctcagcctcctgagtagctggaattacaggcacatgccaccatacctggctaatttttatatttttagtagagacagggtttcaccatgttggccaggctggtctcaaactccggacctcaggtgatctccccatttacctcagagacaaagcccaagtcatgacaatccctggcaaggtccctgtgacctggctctggtatccattagccccatctcccatcatcacctctcagctttactgcagccaccttagtctctgtgatattccctgatcccccacagcacactctggccccagggcctttgcactgctgttccctctgctggaaagctctccccaggagtccccagggctcatccctcacttctatcaccttcacagagaggcctttcctgaccaccttatctaccaccacagccaccctactattgttagtgcaccctacacctgcacctgctttttctcttttttttttttttttttttttttctgagacggagtctcgctctgttgcccaggctggagtgcagtggcacaatcttggctcactgtaacctccacctcctgagttcaagcattcctcccacctcagcctcatgagtagttcaagcaatcctcccacctcagcctcatgagtagctagaattacagccatgtaccaccacaactggctaatttttttttgtacttttagtagagatggggtttcaccatgttggccaggctggtcttgaacttctgacctcaagtgatccacccagctccgcctcccaaagtgctgggattacaggcgtgagcccctgaacctggctccccctgctttactatttattcttcatagcactttccacctgatgtgctgtctgccttacttgtttatggattgcctgtctctgtccccttcatgagaatgatggatccattaagagagcagcaactttgttttgctcattgctgtttctccagagcctagaaccatgcctggtttatgataacgaggcagtggttattagtggaatgactgaatgtaagaatgaatgaatggctgggtacggtggctcatgcctgtaatcccagcactttgggaagccaaggcgggagggttgcttgaggtcaggagtttgagaccagcctggccaacatggtgaagccccatctctactaaaaatacaaaaattagccaggcatggtggcgtacctgtaatcccagctacttgggaggctgaggcaggagaatcgcttgaacccagtaggcagaggttgcagtgagccgagatcaagccattgcactccagcctgggtgtcagagtggaactccatctcaaaaataaataaaaataagttttaaaagaatgaatgaaagacaagaaggcctagatagaaggaataagttaaagtaatcaatagtgcacaagggaaattatagttaatgatcatttacttgtatatttcaagatagctagaagagaaggatggttgtgttcgcaatacaaaagataaatatttgaggtgatgactatctcagttaccctgatttgatcattacatattgtctacagcaggggtccccaacccccgggccatggatcagcaccagtctgtggcctgttaggaactgggcaggcagcacagcaggaggtgggcagagggcaggcgagtgaggtttcatctgtatttacagccattccttattgttcccatcaccgcctgagctccacctcctgtcagatcagtggcagcattagattctcataggagcacaaaccctactgtaaactgcacatgtgagggatcttatgagaatctaatgcctgatgatctgtcactgcctcccatcatccccagaagggactatctagtttcaggaaaacaagctcagggctcccactgatactgcatgatggtgagtcattatatattacaatgcaataataatacaagtaggccgggcgcagtggctcacgcctgtaatcccagcactttgggaggccaaggtgggcggatcacctgagggcaggagttcgagaccagcctggccaccatggtgaaaccccatctctactaaaaatacagaaactagccaggcgtggtagtgggtgcctgtaattccagctactcaggaggctgaggcaggagaattgcttgaacccaggaggcagaggttgcagtgagtcaagatcatgccattgcactcccagcctgggtgacaagagcaaaactccatctcaataataacaacgacaacagcagtaataataataatagaagtgcacaatcaacgtaatgtgcttgaatcgtcctgaaaccatcccccgggccatccccctgcccccaggtccatggaaaaatcgtcttctacaaaactggtccctggtgccaaaaaggctggggaccactgccctacaggtatccaaataccacttgtgcccctcgaatagttacaactattacatatcaatgaaaactaaaagaaaacaattaaaatttaaaatacaaaagtaggactgaaaagctgccactggatgagggaatagggaaatggatggtggtctcagtggagaaagggaaacaagagttggactcaaagagatagagagagtgagcaggaggagacagagtggattgggaagtgtaggtaactcctccaggaagcgtgcttgggaagtggagaagtgaggtcgggtaaggatggaggcattgttggcttgagagcgagtgccttggaagctgggcctgtccccagggaataggcatgttgagctgtacctcaccctgatgggcaggtgtgccctgacctgccacagcctgggcaccccagtttcaccctgtagatgctgactcaggccactgttccttttgtggccacagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacagtaagtttgggaacatgtgtcagacagtacagggcaaaggcagaggaagcacttagcatccagtcctaacccaagtttatctcacctcccccttccacttgagtccaatttcctctttgtattggtcagcttttgctgtgacaatgctatgtaacaaacaacccccagatcccagcagcttacaacagcaggtgtttcttccttatggatctgtgatttaactactacagctttgccttggatgattggccagggtcagatgtactccttgtcttcttgttttgagacacaggctaagggagtcccctctgtttctctatttggatatgctgtttacaagaaaggcggcaggagcacaagaaggggagctgtccccactctgagtccagggacaatacccccaccccaacccccagctcaggaggctggccaagcacatgtgtgtaacttttttctttttcttttttttttgagatggagtctcgctctgtctttcagtctggagggcagtggtgcgatctccgctcactggaagctccggctcccgggttcacgccattctcctgcctcagcctcccgagtagctgggactacaggtgcccgccaccacgcccagctaattttttgtatttttagtagagaaagggtttcaccatgttggccaggctggtctcgaactcctgacctcaggtgatccatctgcctcggcctcccaaagtgctgggattacaggcatgagccactgcgctcggccgtacattttttttttctttctttctctctctctctctttccttccttcctttgtttcttttcttttcttctttcttttcttctctttctttctttcctttcttgacagagtcttgctctgtcacccaggatggagtgctgtggtccaatctcgcctcactgcaagctccacctcccaggtttaagtgattctcttgccttagcctccaaagtagctgagactacaggtgtgcgccacctcacctagctaatttttgtatttttagtagagatggggcttagccgtgtcagccaggctggtctcgaacttctggcctcaagtgatccacatgctttggcttcccaaagtgttgggattacaggcatgagccactgcacccggccacatgtgtgtaacttctaccccttccctgcccagacacggattctcgtgacgcacgcactccacatcctgccccaggctgattggatcatagtgctggcaaatggggccatcgcagagatgggttcctaccaggagcttctgcagaggaagggggccctcatgtgtcttctggatcaagccagacagccaggagatagaggagaaggaggtactaggtgggctttgctgattctccaggcctggctcctgccacccttgggggaaaaggctcgaagggtcctactggcatgaatggagtgctctggccacaccctgtctgcaggcctaggcctggaagcagacagctctcttaataggtcacctttctccaagaatagccgataacatcatccatgagccaggggttgtgctaagtgcttctgtaaaaaatacactatttcatttgattctcacacatgccccagaggcatgtgaagttattgctgtcattttacagatgagcaaactgaggcaaagagagttaaatcacttgcccaaggtcacaagattagaacttgagtatgtccagctccagagtctatgcttgcagttgctatggagacagcccaagaaggactttgatgcctagcaagctacaccatgctagctagggtttctaataatccagaaaaacagtgtgctggatacatggcaaggttctggaagtaaagttgccaagccaagctcactcacaatgactgaaaagtagcaactaacagcacatcacagaggttagctcatttaatcaacataatgcccctgtgaggctggtactagaatcatttccatttcacagatgaggaaactgaggcccagaagttaaggaactagtcccaggttacatggcttgtaagtggcagcactgggatttgaacccaagcaacttgattccagagaatgtgttttttaattgctaccctctacactatcccttcatgacaaagcaaggattcacatccaggtctccctcaatctcaggctttgcttcttctgagaacatctgcttagcactggcccaacctggttaaaaccttaagtgttgattcacaatgtcacagtcctgaagcttgaagatagaacttgcctgtttgtgttggtcagcttttgctgtgatgatgctgtgtaacaaatagccccccaaatcctagcagcttacagtagcagttacttgttgcttacaggtctgtggttaaactactacagatttgctttcagttactggccacacctgggggatagtggtggggaggtgtccttcctaggggagatggtacctgagggtaggtgagagttagccagaaaaaagcattccagacacaaggaactgcttgagcaaggctgttgggggaaacagaggtaacttgactttgtacagtgttaaatgctgtttttccaacctcaagttcatagtaggtgctcagttatcactgattgaagaaatgaatgagtgagtgaatgcctgaaggatgttcctggaagaactcagagtggggtgttgagagaggttgctggagacgtggcaggagccagatcaggggaaatggatggtcagagcggttaaggccacatagtcagtgggtgtcaaagtgggtatctgggccgtgttgcgtgacaggactctcttgaccttgcagaaacagaacctgggaccagcaccaaggaccccagaggcacctctgcaggcaggaggcccgagcttagacgcgagaggtgagtccaccatggtgccacactcagaagggcacaggctgaagctgaagtagctgaagggaccacccgcatctcgggcagttaggcgggcaaccaaaaccattatggatagagaacctgctgaagtcccccccatggtgccctgctgagggataatttaccaaaattggtccagttagccaagatgattaggcccctataaggccagttcatggaatgaacaatatgccttccaattgatggatgtcttcaagtgggccgaggccagcttgctggagttgtctgaatgctgcagtagggcaggactggttcctccccatagctgtaaaccaccatgccaggcctggccacttatgctttgacaggctggctatgcacagggcttgggtctgtatgcacagcatcacttgacgctggccagaacacgtgggcaaggggccaggaggaggcctccggtcccctcttttctcagctccctccagccaggacacagctgggctcactgtggagctgtcggcagcagaaggacctgctgcctgatactctcccctcttaatgagaggggtcttgggaagcagaacaacaggccactgataccagatggcctgagcttaagtgcctgctatacaggggtggtgggcggcagcgatcttgaggggcctcagtccccagggaccattggggctgacccccatcccagctagccaccctgagggcacttctcaatcacacacacactgagaaatcccaccaccttcacagcgcacaagaatctgaagtaagatcagatggataggtagtcatgttaaaagaaaaccagtagacacattaaggctgggcatggtggctcacacctgtaatcccagcactttgggaaactgaagcgggtggatcactagctagaggtcaggagttcgagaccagcctggccaacatggtgaacccgtctctactaaaaataaaaaataagtaaattaaaaaaaaaaagccggcgtggtggcatgtgcctgtagtcccagctactcgggaggctgaggcacgagaatcacttgaacctcggaggcggaggttgcagtgagccgagattgtgccaaattaacctctagcaaatttaatgtgtctgaggttttttgttttttgcgggggggggttttgagacagaatcttgctctgtcgcccaggctggagtgcaatggcacaatctcggctcactgcaatccccgtctcccaggttcaagcgattctcatgcctcagtctcttgagtagctgggactacaggcacatgtgaccaggcccggctaatttttgtatttttagtagagacagggttttgccatgttgtccaggatggtctcaaactcctgacttcaggtgttccacctgcctcagcctcccaaagtgctgggattacacgcgtgagccactgcacctggctaacagaggttaactaagcaaagaatgatccgcacatcgggcagtccctgaaccagaatacgtccagagaggctctggtacagccacggggtcaaagattaatagacagaaaaaggaaggtgaaggacagaaaacagaagtgaggtacagaaacagccggattggttacagctcagcgtttgctttattggaacatggtttgaacggttggttgcctttgattggctgaaactcagtgattgacacaggagtaggttgcagtctgtttgagtccaattaggttacagttcactatgtacggggaaaacctttaggccaaacttaaaatatgtaaggaggcagctttgggctaacctcaatttaatagaaggtaggtagacatgtatatgtagatatacaggtatgtagatgaatggataaatggatggatggatagatagataatattcctatttttacagctgaggaaactgaggcacagaggttaagtcagcccactcatccacagataaaacattcaaagagtctttagcatctgaattgtgcataatttatattctgccagttggactgacaaatctgatggtatacagtaggaacaaaacaattgcacgaaagcttaagccaaaataaaaattctgagaacaggctgggcatggtggctcatgcctgtaatcccagcactttgggaggctgaggcaggtggattgcttgagctcaggagtttgagaccaacctgggcaatgcagcaagaccccatctcaaaaaaaaaaaaaaaagaaaattctgagaacagagttccaatggtgggcaagttaagttcatcctgtgaattggcatcagaagaatgggcttgcttgaccctggggtaatagatggcatttagctgggtaccatatgggaagaagggaagtgtgatatctggtcagtattctgttagataaatgaatgaatgaaagagtacagagtgtacccagagctcagtggctgtcagtgggcctgagggttaggcacatacaccccaccattgggagagatactgactttgtcttcatttcctctaaatgacaggtccatcaagtcagtccctgagaaggaccgtaccacttcagaagcccagacagaggttcctctggatgaccctgacagggcaggatggccagcaggaaaggacagcatccaatacggcagggtaaccaccagcttcacccacccctccccacccactgctgccacctccaggggcccaagtcttcccaccaaatgtagcacttggcagtgatactcacctttcttgagcacctactatgtgccagtagcattctagatgttcattttcttaatcctcacaaccaccctaaaaaatagatatgataggtctatttcagacataaagaaactgaattcttttaaaatttattttattttgattttgagaaagtggctcgctcactcacccaggctggaccgcagtgatgtaatcatagctcactgcagcctcgacctcctgggctaaagcaatcctcctacctcagtctctcaagtagctgggactacaggcgtgtgccaccatgcccagctaatgtttgtattttcagtagagatgggttttgccatgttgcccaggttggtctggaactcctgggctcaagtgatcctctggcctctgcctcccaaagtgctggggttacaggtgtgagccactgtgcccagccaagaaactgaagtcttaaacagttaagagacttgtttgtgttttcatatctagcctgggacacaacctgggactcaaatctaggccaatctgagtctgaagcttacactgtttctcatcttctatactgctatgtatctccacccacctacttacccattccatcatccacctagatgctcatccacccacccacctatccatcccacccactcatttatccatcccatccattcacctacccactgatttatccatcccacccacccatttatccatcccacccactcatttatccatccatcccaccccctcatttatccatcccacccactcatttagccatcccacccactcatttagccatcccacccactcatttagccatcccacccactcatttagccatcccacccacccatttagccatcccacccactcatacccatttatccatcccactcactcatttatgcatcccacccactcatttatccatcccacccacccatttatccatcccacccacccatttatccatcccactcactcatttatgcatcccacccactcatttatccatcccacccacccatttatccatcccactcactcatttatgcatcccatccattcatttatccatcccacccactcatttagccatcccacccactcatttatccatcccacccactcatttatccatcccactcatttatgcatcccacctactcatttatccatcccaccctcccatttatccatcccatccacttatttatccatcccacccacccaaccactcatttatccatcccacccacccatttatccacccacccacccacccattcatttatccatccatcccacctactcatttatccatccctcccaccaactcatttatccatcccacccactcatttatccatccatcccacccactcatttatctgtccatcccatccactcatttatccatctatcccacccactcatttatctgtccaacccatccactcacccacctactcatttatccatcccattcgcttacccatccatctatcccacctaacaatacatccaaccattccctcacctatgcatctgtctgttcagctgttcatccattcattgatctttccatccattcatccactcattcacacacctacctacctacccacccgctcatttattcacccacctaccctctcatccatccagcaaacatgtacacaatacccactatgtgccaggctaagtctggtagagattagacactagtgaggatagacggagagtaaataattatgctaataagtaagctatgtccaataacaataagtgctataaagaaaataagaatgatcaggcgcagtggctcatgcctgtaatcccaacactttcagaggctgaggcaggaggattgcttgaggccaggagttcgaggctgcagtgagctatgatcatgtcactgcaatccagcctgggtgacagagtgagaccctgcctcttaaaagaaagaatgatgaaatagagaccactgagaaaccctaccatggttggtatggacaggatgctctgagaagtgacatttgagcttccccaaagaatgtgtgaaggaaccagtcatacaaagggcaggagaaagagcgctccaggcagagagagcagcaggtgcaatggctccgaggtgggaagtagcttagggtgccagagaaaggggtcccatgaggctggcaggcagtgagtgggggcgagataagaagcttggaatttctttctttctttctttctttctttctttcttttttttttttttttttttttgagacagagtttcactcttgtcgcccagagaagagtgtaatggtgcaatctcagctcactgcaacctccacctcctggcttcaaacgattctcttgccttagcctctcgagtagctgggactacaggtgcctgccaccacacgtggctaatttttgtatttttagtagagacggggtttcactacgttggtccaggctggtctcaaactcctgagctcaggtgacacacccgccttggcctcccaaagtgcttacaggtatgagccacccctcctggctgggatttcttctaagagcaagagatagccatggacaggccaacgacaagatataattagattaatgttttcaacagtcccgtctggctgcagctgtgcagagaacttcagatttgtaggagcaggaccttaagccagtggctgaacctctctgtgcctcagtttccttatctgtgaaatggaggttgttataaggagagacacatgcctgacctatggtgggtgttcaagaaaacccttctagctgggtgtggtggctcacacctgtaatccaagcactttggaaggccgaggagggaggatcacttgaggccaggagtctgagactagcctgggcaacacagcgagattccatctctttaaaactatgaaaattaacaaaacatggtggtacaaacctatagtcctgactactcgggaggctgaggcggggggattacttgagcctaggagttcaaggctgcagtgagccatgatcatgccagtgtactccagcctgggtgacatgggcgacaaagcaagaccctgtcctcaaaaaaaaaacaaaagaaaaaatattaatactagctccctggggattgtataggagatgggggttctaaggctggctggggcctgtcggggaaatggtgcttctggtgggaggcacagcgggagaaccagtgaggtctgcgtggtggtcccatctgccatgggcatgttttctgggagcctcgcctggccttgcctcaacccacccctcccactgggggctctctctgcctccctctccctcatgtgtgctacaggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaaggtacgcctcacctgccctcctcatccctctcctcccagctgcaccaaggggtgctcaggactcctttaccccacccctccctgggtcaccctgtccccctggaacagtgtgcaaaacgtctggggtccaggcaaagatctgcgtccttaagatgaggctggagggaacgggaaggacagggcacatccctccttttctggaagcttcagaacctctcccagtccctccccactagcggaaggcgtctgcaaggcctgcctgctggtggctttcagtgcctgcccccaaacctccagacagagccagaccctccctaacaaatgcatcaccgctatcactccttcttctcctcctcaaaaatggaaagacttcttcttgaaataattgtagattcacatgcagttctaggaaataaggcagccagctaccttgaacagtctgcccagtttctcccattggtgatattttgcaaactgatagtaaagtatcacacaaaggatcctgacacccatcaatccatggatctcaattatttatttatttatttatttgtttattttattttgagacagagtcttgctctgttgcccgggctggagggcagtgctgccgtctcggctcactgcaacccccatctccgaggttcaagcagttctcctacctcagcttcctgagtagctggaagctgggattacaagtgtgcagcctggttaatttttgtatttttagtagagatggggtttcaccatgttggccaagctggtctcgaactcctgacctcaaatgatctgcccgcctcggcctcccagagtgttgggattacaggtgtgagcccccgcacccggccctatggatctcattgtgatttccccagttttgcttgcacgtgggtgtgcgcatgtttgcctctgtgcagtcgtatcccctgttcagtctctcgcatccatcacgatggttgacagttgagatactgaacaaccccctcaccacgaggcgctctcgtgttgcccttttgcaaccacacccacccttctcctgcctcgcccaccctgtccccaacccctggttcttctccttttaatacgtggcctggctgaagggagtaacaggagtgcacatgtgagtttggcttcttatttatacacacacacacatatatatagactgggtctggctttgtcacccaggctggaatgcagtggcacgaactcggctcactgcaacctctgcctcctgggctcaagcaatcctcccacctcagcctcccgagtagctgggactacatgcacatgccaccatgctggctaatttttgtttttgatagagacggtttcgccgtgttgcccaggctggtctcaaactcctgggctcaggcaatcctccgcctcaacctcccaaagtgttgggatcacaggcatgagccaccacgcccggcctggcttcatctttaaaggacagttgcctcgttttcatgttgattcgtcctcattcactgggtgacattggccacatcaccaaaatgctgtgagcctgtgacctcccctgtaaaatagggggcgccaggcctgaacttgaggactcttctagtcctaagaacctgtacacctactcaccacaactgcatgtacagtggaatactcaaggcgaatggttacttaaccaagaggaaattagggattctcagagtcagccgagccctggaattaacccaaatcctcatttgggtggcaaatagccctttcaaaatccttccacttccatccctcatttgatagctaagggcaagtcttactctcccctaaagatggagagatgggagctgagagagagaaattggttatgactctcgaatacaaagaataaaaaattcagctccaggccagatacggtggctcatgcctgtaatcccagcactttgggaggccgaggcgggtggatcacttgaggtcaggagttcaagatcagcctggcgaacatggtgaaaccccgtctctactaaaaatacaaaaattagccaggcatggtgtcagtgtttgtaatcccagctacttgggaggctgaggaaggagaatcgcttgaacctgggaggtggggtttgcagtgagcagagattgcaccactgcactccagcctgggtgacagagcaggactccgtctgaaaataaacaaattcagctccaattcaaagtgtttaagcaacaagagaattgattggctcttgggaccagtatccctagatttctggcttcaggtatggctggatgtaggggtccaaacaagaaatcgctttatttccctcctctgtgacagcttcctgtccagcttagctgctccccctggcagtaagatgatattccacggctccagcttggctacctccaacaaccaagtaccacttttccaaaagttctagtgaagtcccaggtctccctgtcattggcctgacttgggttatgtgttcatccctgaaccaactgcagtggtttggattggccatgggtgaaatttgccccaccccagaggagaagttagccccaccccaggcatacagattagcactgggaggaaggatgtgcatttctctcacagggctactgccaaacaagttgccacaaacttgggagcccagcacaattgaaatttgttctgtcgcagttctgaggcctgaagtctaaaatcaaggtgtcagcagtgttaactctttgtggaggtttttttggtttttttgtttgtttgtttgttttttctgagacggagtcttgctctgtcaaccaggctggagtgcagtagcacgatctcggcttatggctcactgcaacctctgcctcctgggttccagtgtttctcctgactcagcctcctgagtagctaggactacaggtgcctgccaccacgcccagctaatttttgtatttttagtagagagtagggtttagtagggtttcaccgtgttgctcaggctggtctcgaactcctgacctcaggtgatccacccgccttggcctcccaaagtgctgtgattacaggcatgagccactgtgcccggcccctcgtggaggttctgatggagaatacgccccaggcttctctcctggtttctggtggtcgccggcagtcgctggcattccttggcttgtagatacaccctcccatctgtgtcgccatcttcatatctcctgctgtgtctctgagtatcctctagtattcttatataaatggcagtcactgaatttaggacccatcccaaatgaattttgggggacactcttcaacccattacatcaagaaacaagcagggtacaggcgcagtggctcatgcctgtcatctcagcactttgggaggccaaggcaggcagatcacttgatcccaggagttcgagaccagcctggacagcatagcaagatcccatctctacaaaaataccccaaattagccggcatggtggcgtacacctgtggtcccagctactcggagggtgaggcgggaggatcgcttgagtgcaggaggtcaaggctgcactgagccatcatcatgctactgcacttcaacatgggtgacagagtgagaccctgtctcaaaaaaatataataatcagggtggccaagccataagatgtccaccatggggtagcgggagagacctgcgcagggccccgtgggccgctcctgagggtctccagccctcatgctcttacctcctctccctccccagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcaggtacggagaggtcagggaggcttccgggaccggctgaggtcaactcagccagtcccctgtctctggggaagactccatatatgaggtttcacccagctggacatctaggggctgttcctagaattcccagggacagggacactacagtctttctggtatctccactagtgtctgtctctaaatgttcacatcaaagttcttttttttagagagacagaatcttgctctcctgccaaggctgaagtgcaataggtgatcatagctccctgcagccttgaactcctgggttcaggtgatcctcctacctcagcctctcaagtagctgggactacaggcacgtgccaccatgactggctaatttttaaatttatttttgtaggacaagtgtcttcctgtgttgcccaggctggtctcgaattcctggccccaagtgatcctcccaccttggcctcccaaagttctgggattacagggcatgagcccctgtgccccacggcacagttaaatattaagggccagagcctttcacgcgtaatgtttttatcctgccgtaatttcttcctctccaattatctggaagccaaaaaggcattgcaaggtctcaaaggctattatatgaagctagattctttcaattgctgggaccagcaaccaactaaaattagcttaaccaaaagaatagaatttaatggcttatatttccttgggggcatgggcccagttgtcatcaggacacagtgactctctccatatcttcactcagtgcttctcaaagtgtgaccccaggaccagcagtagtatcacctggggactagttagcaaagtacattcttaggccccagcccaggactactgcctcagatactatgtgggtcggcccatgaatctaggttttaattaaccctccaagtaattctgatgtacacaaatgtttaggaaccactggcttacctctggtctaattttgtacacgctctctttccagggcaggtcttatggccactagctatcatatcatctcaccttagcaactcaacatgcaaaaaacgtttcttcagctcagtagtcatatattaatcccagggaaggttctgattggccctttgtggatcatgtgtccatctctgaactcgtcacagtaactgaatggatagtagattctgatacactaggctgcatcatgtgaccacctctctgatcaggtcccatgattgacagcaccccaacccagccctttcccacaggaaaccagaagtagaaaacatggtagtcagataaaaaccatggctagggctaggcatggtggctcacacatctaatcacagcactttgggaggctgaggtgggcagatcacttgaggtcaggagttcgagaccagcctggtcaacatggtgaaactccgtctactaaaaatacaaaaatttagccagtgtggtggcgcatgcttgtaatcccagcttcttgggaggatgaggcgggaggattgcttgagcccgggaggcagaggttgcagcgagctgagattgcaccactgcactccagcctgggtgacagagagagactccatctcaaaaaacaaacaacaaaacccatggctaccactgtccccgacaattgtcctaggtcttctctaagttcacttgactccgaggatgggctgtttctgtctcaagctttagagtcaagcaaagatgggtttaaatccaggctctatcacttactgtggcactcaggacagctgctgaatcccccgagccttggatgttctcaccactaactgatgaatgacgcgaatgctcactctgcaatgaatgagacactgtgtgaaaagcctggcacatacagttgggtgttcagcaaattcagttcctccctgcctgcctgtctgccagctgcacccaacctgcagctgcaaaccaaataacgaatattttctgcacatcacctggcatgtaacccttgggttacatgagtgaaactgacttggccaactgccttcattgccccttacagttttgttctcccactgaccagccgtaaatgaagtagtcggcctcagtgctgggaagtgagacacttaaactaaattggtggtttctcaaccctggctgtcccttagaatcatctggaaggctatttaaacagcaccaaagtcaaggtgacatttccagagattccgattcagtcattctggggtggggcattagaggtttttgaagctccccaggtgattttcaaaaaaaccatagaactctgattctgcaaggaaatgagaacccagagagggcaagcaactagcccaaggtcacacagtaagctgttaacagatcctggtctggaatcctgtacttggggctctctgtgcttctggaaactacctctctatgtctgtggcttctcctcttccctctcccatccatccttctcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtaggaagagccagggcagagaagaccttgcaattcatccatatccttagagggtgagacctgaggtcatattgtatggtagagaggtcacccagagagtcagggacatagttgaggctagatcccacaggcagtctatcagttctcaccgtgggcagatggaacatgaccgagagattctcaacagcaggtgggcggggggtacaggaagaagcttctgttgccaggcaactggatcaacctcttttgccttggtgataaagcagccatataagcatcctcagccatctttaggtactaagcaagaacaagaacacaagctttaagcacaaatagacacaggttcaaatcccagctctgccacttaccagctggttgatttcaggcaagttacataacctctctgagcctcatttgtcaaactgggatcgtgctcatggagtggatatgaggattaaatacagacactcataggtaagacctgtaacatgcttactgcatgcctggcactgttctgagcaatctatgtagattaatttatttaattctgctaacagcttcaccaggaagaaactgttctatagatgataaatcctaggcacagtgaggtttggaaacttgtccagggtctcacagctaatactggcagagccaggatttgaatccaagcagtctggtaccagagtgtggagagggtcaagtacacactaggtgctcaatacatgtgaagtcctttttcctttcatctcaggtccccagccagctggggctgtgtattagtccatcttcacactgctaaaaagaactacctgagactgagtaatttataaagaaaggaaggtttaattgactcagttccacgtggctggggaggcctcaggaaacttacaatcatggtggaaagggaagcaaggcacgtcttacatggcagcaggagagggagagcatgaggtgggaactgccgcatccttttacgccatatgatcttgtgagaactcactatctcgagaacaatatggggaaaactgcccccatgatccagtcacctcccaccagatccctccctccacatgtggggattacaatttgagatgagatttgggtggggacacagagccaaaccatggaggccatggttcaggccaggggaatggcaggtggacatggcttggcaaattccagggacagaaaagcagccacacagggatgctcttcagaacaccgagtgtaccccagaccctaaagtgggcttagttgagacaggacggtgtcatcttcctctactccctgagcctgggttgcatgtggaggccattgctgggacccctgtgtgtacaaagctggtgtgatgaccagtccttgtgcccagagaagcatctccctgcagatgagagtaaccactcaccctgctgtcgcttccctttgcaggtggcttgcggccaatgtggagctcctggggaatggcctggtgtttgcagctgccacgtgtgctgtgctgagcaaagcccacctcagtgctggcctcgtgggcttctctgtctctgctgccctccaggtactccccacatccccaaactgggcttgagggacagacagaggcagagactgtcggacccctgctagtgggacctttgaagaccctgtgtccaaaccaacatggtgtgtggagtccctccaccaaggagggacacgcagctctacaagagccagactcagctaaggtgaacttgcaaccttgggcaagagtctttccttgtggagtgtcagtgtgctccttggaaagacaggccagaaatcccactacttctgatgttataaagactagttgagacaaagcatatcctgtggaggacatttctagtgcattgttaacttttgttttgttttgaagacagagtctctctcttttactcaggctggagtgcagtggtgcaatctcggctcactgagaactctgcctcctgggttcaagcgattcttatgcctcagcctcccaagttgctggaattacaggcgtgagccactatgcctggctaatttttgttaactattaacagtatgtaatgtcagttcatgacatctatgaaaaaaatatatatatacactcataagcatttgttatggaggaggcattattctaagagctttatatgtttttgttcgttttggtttgttgttgttgctgtttgagacaggatctcattttgttgcctaggcttgagtgcagtggcatgatcttggctcacttcagcctccatctccaggctcaagggattctcccacctcactttcccaattagctgggactacaagcatgcaccaccatgcctggctaattttttttttttttttttttttttttttggtagaaacagtttcaccatgttgcccaacctggtctcaaactctaggttcaagtggtctgcctgccccagcctcccaaaatgctgagattataggtgtgagccaccatgcccagctgttttgttttgagacaaggtctcactcttttgcccagactggagtgcagtggtgtgatcacagctcactgcagccttcaattcctgggttcaaacaatcttcctgcttagacttccaaaaagctgggattataggcatgagccactgtgcacaagaattttataaatattaactcacttaatactgcccacaaccccatcagagaagcactgttattatcctcattttacagtcaaggctgctaagcttaaggatgaagtaagaggctggagcatgttgggtggcagtgagggaactttcctactgcatccagaaaggcctctctgaggaggtgacttaggaggaagtgaggttaacagcaggaagaaaaggcctgggagttgaaggttcatccctggtgtgttagaggaacagcaagaagacgggtgtggctggagagggtgggtgaaggcaggggtgctgggagacaaggttggggatgggatggcagggctagagctgctaatggctcatagggaggagcttggagtggttctaagtgtcatgggaaattggtggccacccagtcgctgcgagaaagccgtcagaatggaatcagtgggcctgggtcctgctgtgtgtccttgggagggccacacaccctctctgatcctgtctactcacctgcatcaagccagtttgtacaagctgatgtctgagggcttctttttgctctgcatgctctggttctactgaaggaagagagggacctgttggttgtatccaaatcccaatcccctgggcccaggtcctcagactgtcccattcctgcctcccctctttactcccctgggtctggcctcccagaaaaggttgggaaaccaggggggctgttgcaagccctcaagtggccttgccaaacccagccagagaggctttcttgcaccaggtgacccagacactgcagtgggttgttcgcaactggacagacctagagaacagcatcgtgtcagtggagcggatgcaggactatgcctggacgcccaaggaggtgatgggcgggaggtggggagggggtcccagcaaggacatattgtgggggggggcaatgggtccctgttgacatctgctacaggctttggagtttataccctcttctcccctcactcaacccccaccactataggtcagagtcacagacagggtggcagcagtggttaggagcataaggtttggagccaggccaaatcttggttcctttgcttctgagcttgaggaaagcaggtcacccatgggagtgcagggaaccacaaggaacagcattgcaacagcaacatagctgcaacatgatagtaacataatggcaacagcaacacaatggcaatattccagaacatgagagtaatgcaacagcaatgtaacagtaatgtaacagcaacataaccacaatattgcagtaccagaatagcaacatagcagtgtaatagtaacataatagagacattatagtaacatgatggcaacattccagcaatacaaccacaacatagcaatgtaatagtaacgtaatagcaacattttagtaacatgatagaaacaaaacagcaacatagcaatgcaatagtaacacaacagcaacatcataacatgacagcaacatcccagcaacacgactgtaacagagtaacagagtagcaacataacaatgtaacagtaacaaaacagcaacattatagtaacatgatggcaacattccagcaaaataactgaaattatagtaacggaatagcaacatggcaatgtaacagtaagaaaacagcaacattatagtaacatgatggcaaaattccagcaacataacagtagcattataaggacagaacagcaacatagcaacgcaacggtaacaaaacagcaacatgatataatgtgttagcaatataacagtaacattacagtaacagaacaaggaagaattaattagttgatgaatagggtagaagaaatggtgagagatggacagatgaatggatggaatgggatggaagaatgagagatggagggatgggattggagatggatggatggatgcatggatggatggatgggtgggatggggtggataaaggataagagatggatggatgaatggatggatgggattgggtggaagaaaggataagaacagcagcatagcactaatgtaacagtaacataacagcgttgagtttactgggaggatcaaatgagatcctgcaaagaaatgatttaatagagtgcctggtccattgcaaacactcaatacatgtctgctgctcttattagccctatttcccagattggaaaaccaagactcaagggggtagaatgatctgttcaaggtcacgggaacagcaaaggcagtattggtcttcccactgcacagtcatgtcctttcacaaagacaaagagaaatgtctgctcccactatagaaaaagagattattttataataaacagtggctaataataacaataaaatagactaaaagtagccaccaccatctgtttttagcattgacatagtccatgccctctcttgttgaattcccataacaaccctgtaaaacagcaataaatacgtccattttgcggaagagaaaactgaagctgatagaggtgggccatcttgtgtgaagtcttagaggaaggctcctctgactcagtttcccctcctgctccaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgagtggttctctcacaatgtcttcttcatggagtttaggccaaaggactccagggacaaggccctaaaccctgggcaccagccacctccacagtgtccccacctcaggtcccctagctttcagacccattaccccctaaaatgaactcctcaccttccccaaacctgcttccatctggtgacttcctcatccaccttggtgtccccagatgaggaagcaactccgtgacttccttcttcctttaacattaacccagcacctaatatgtgctgggcagtgtgttaaatgctccaggtacattttccagtttgcacaaatgggatatttgctttcagctgggagacattgggaaaagcacttcatagctcagtctcagttttcccatctgtaaattgggactggtaatactgatctctgagttgttgtgaagtttgagttaatacatagaacatgcttagctcatagaaagtgctccagaaatgtttactaatgcttttattatttgcgttttcactctcacaacaacccctaagtgaggtgctagtactatcccattttacagatgcctcatcaggccccttcactgaatccctttcctccctccctctgaacctacagaggcttcctccctgtcctctccttgtcccctaaaaagcagtggatcctgtctcaccagctccaatctgctctcctgtgatttttttttttttttttttttgagacagagtctcactctgttgcccaggctggagtgcagtggtgtgaccttagatcactgcaacctccgcctcccagattcaagtgattctcctgcctcagcctcctgagtagctgggattacaggcacctgccaccacacccggctaatttttgtatttttagtagagacagggtttcaccatgttggccaggctgctatgaaacttctgacctcaatcacccccctcggcctcccaaagtgctgggactacaggcatgacccaccatgcccagccatcctgtgacctttatcagcatgaatgacactgcatgtcattcccctgctcaaaaccttctactagttccagcttcccttggggtaaagtgtgaattcctgagcttggcattcaaggctctacccaacccaggccctgccaacctccccctctcattcattgctctgccagggcttagccaacattgtggagcagctgcctctcggccaggggggcacatggtgctgtgagctccatgagcttctagttttggaaacccacttggtgtggtttacctggagtgttccccttccttgaactcctattgatccttcaagcttccatgcaagtatcccttcctccatgaggtcttctcttattacctctgtcaaatcccaggcagcatgagcagcactgccttgcttcccttaattgccagaggtccagaccttgataataaacagcattgttggctgggtgctgtggcttatacctgtaatcccagcactttaggaggccaaggtgggcagatcacttgaggccagaagtttgagaccagcctggccaacatggtgaaatcccgtgtctactaaaaatacaaaaattagccgagcatggtgacaggcacctgcagtcccagctactagggaggctgaggcaggagaattgcttgaacctgggaggtggaggttgcagtgagctgagatcgcaccactgcactccagcctgggcaatagagcaagactttatctcaaaaataaataaataaataaataaataaagcattgttcatcacactgtattacatttactcaattgcactgtttcctagaccggatgatgggcacactggagcaaggactctttaatttctatacttccggtgcctaaacaggtacttggcatacagtggggtgacccacatgtttccatcattaattaaacaaataatgttgaacccacaccatgtgtcagacactgaggatgcaatagtagcaagagagataaggatggagggtggataacagcatgggagatggataacagaatggacacatggataagatggaggatgaatggaaggatggatgagggaaggatggactggatggatggatgggagaaaataaatgaatgaaaggattagtgaattgatggatgaatagggaagaagaaacgagagacggatagacagatgaatggatggatgaatggaatggggtggaagagagatggagggatgggattgaggatggatgatggatggatggatggcaggatggggtggaaaaaaggataagggatggatggacggacagacagatggatgggatggggtagaaaaaaggatgagagatgatggagaggtgtaaatagaaggatgaggaaagatggaggaactaaaggaagggtggggagaaagatgggagagagatatcaggataagggaaagatagagaagaacacagatggaagactggatggattgatgggtggatatatagaaaggtagacagatggaaagagagatggaaggtagacctttacacaatgagggatggatagacagatctcgggtacagcagaaagatctccccaataaatgcccacaaaccctctggtcagagcaggcctttcctcccaaccccgggcaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggtgaggctggtggagggggtgggcaaagatgggaggcatggtgggacccggctctgacccaccgcccctccccgccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgaggtatggtcgtcccaccatggctgggacctgcaggtgggagaggaggggatggccatgccctccccaagggccttcaggaaatgcctcccccgataggattatcactctgttacattaataaccacatgtctcttatctgcaattccaagctctgacacagtctctgaataccaaggttttcccccctaaattagcagttagtcttctatatttacttggtggcaaaacccaacctcaactgacacagggctactgatagcctttattgctcttgctcagtatttattttgctatgaaaatattgtttgatatcgggtggtaacctcaccactcactgggactataatataggatttttttttttggtaaatgtcaagtgtggactgggcacagtggctcatgcctgtaatcccagcacttcaggaggctgagagaggaggattgcttgagcccaggagttcgagactagtctgggcaacatagcaagaccctatctctgtggacaacagtattagccaggtatggtggcatgcacctgtagtcctagttacttgggaggctgaggtgggaagaacgcttgagccagggaggcgaaggttgcagtgagccgatattgcaccactgcactccatcctgggcttcgtctcaacaacaaaaagctgtgtggaaagatacacataaaatttactatctcaacctttttttttttttttctttttctttggagacagggtctggctctgtcattcaggctagagtgcagtggtgaggtcaaggctcgctgcaacctccacctcccaggctcaagcattcctcccacctcagcctcccgagtagctggggttacaggtgtgagccaccagggccaggtaatctttttattttttgtagagacagggtttcaccatgttgcccaggctacagtcgaacttgcgtaggcctcccaaagtgctgggattacaggtgtgagcagccacgccgggcccatctcacccatttttcagtgtatagtttctgtagtgttaggtacattcacactgttacacaacagaactacaactctgtacccatgaaaccctaactctccttgtcccctcccccagcgcccagccaccagcattctcctgtctctctgagtgtgactactctagacactgcatagacgcagaatcataggatctgtccttttgtgactggcttatttcacacagcatgatgtcttcaagggtcatccacatcgtagcatgtgtcagattctctacctttttaaggccgaataattttccactacatggatagaccacattttgcttatccgtttatctgccagtagatacccaggctgtttccacctcttggccgttttgaataatgccactatgaacataggtgtataggtatatgcctttagaaaaaccaaagtggctgggcgcggtggctcatgcctgtaatcctagcactatgggaggccgaggcgggtggatcacctgaggtcaggagttcaagaccagcctgaccaatatggtgaagccccgtctctactaaaaatacaaaaattagctgggtgtggcggcaggcgcctgtaatcccagttacgtgggaggctaagacactgagacaggagaatcgcttgaacccgggaggcagaggtttcagtgagccaagattgtgccactgcactccagcctgggtgacagagtaagactccgtctcaaaaaaaacaaaaaaaaacctaaggtgttctggatttataaacccctctgaccctgagggtgtccgaagggcttgtggtaggcaataatttccagcactagagaggcagcgttgcttggtgggtaagagtatacacaggtgacagactgcctgggctcaaatccaggccccccaccccacacccccacccccgccccgccctgccacttactagctgtaggatcttaggcaacttatcttgtgtgcctcagtttcctcatctgtaaggtgggaataatagcacctacctaccttgcaaggattgaattatatgcacaaagttgttgaaacagtggcaggcatagagcaaagagtaaatactcattttagtcctgagtcacactcctgataacatcatttcacagagttggaattggaggcctggggcttgcctgacgtcacacagcttaaaagtagtgaggttgggacaagacccaggcactctaacgcctgcatgaccatagtaggttctgatcatgtaaaaggatgctgtttcatggaagggcttactgtgcaagacagccatgctggggccccaggggtcagttcccacctgggtcaggggctcactgggctcacaacctggaatctcaactcctccaccctccacgaagggtgctactccatgccaagggcttattctgtgacaagcctacacactttttttttttttttttttttttgagacagagtcttgctctgtcgcccaggctggagtgcagtggcgcgatcttggctcacttgcaagctctgcctcccgggttcacaccattcttctgcctcagcctcctgagtacctgggactacaagcgcccgccaccacgcccggctaattttttgtatttttagtacatacagggtttcaccgtgttagccaggatggtctcgatctcctgatctcgtgatccgcccacctcagcctcccaaagtgctgggattacaggtgtgagccgccgtgccccgccacccacacacttttatgtgccatgtcgtcacgattcagcgaggacggatccattaggagcacagactctggggtcagaggacttgggttcaaattatggacccaccactagccttgagaccttggtcaagccactgagcttctctgtatctgtgtcctcttctctcaaaagaagagaacaataatatctaccttggtggacattatgaggattgagtgaatatatacaagcacttagaatgtgtttggcacaaggtggaaactagaaatagaactggacatagccataaacaggccaggcacggtggatcacgcctggaatcccacccaggtgttgtacacatctgtatttaaggcccacgtgacaccagccttgaatgtcttaggaagactgtagatttgattcttgaagcagcagtcagtcattgtaggtttgtttgcaacggcatgactgaagtgaaagctgtgctttcgctgttgggggaaatataaattagtacagtcactatggaaaatagtatgatgatttctcaaaaaacaaactagaaatagaactaccggggcgcagtggctcacgcctgtaatcccagcactttgggaggctgaggtaggtggatcacctgagagtttcaaacaagtcggaccaacatggtgaaaccccatctctactttaaaaatacaaaagccaggcatggtggcgcatgactgtaattccagctacttgggaggctgaggcaggaaaactgcttgaaccgggaggcagaagttgcagcgagctgagattgtgccattgcacgccagcctgggtggcagagcaagactccgtctcaaaaaaaaaaagaaaaacgaagaagaaaaaaagagccataaacagaaaaaagaaaatagccatttcacaggtggggaaactgaggcacaaagggtttgaatgacctgcctacagtcagcctgctcaaagatggcaggaacaggcttcctatcagttctgcagaccacagaccccagaccccatgtgtggggatgcctgaacacaggcacctcactcctgcactgcttcagggacctgtttctgggcacacccacacatcaccatgtgccgacaaacgcacgtcccagctaattgtcccaatcgttcccagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccggtaaggctcccgccccggcctgacctcacagcagccctgcagtggtgggggaaggaggcggaggcagtcctgggccactgggcttcgggttagagctggaggggtcctgaatggggccagagcgggaggaatgcccgggaacacatgccaagtgggaaagctgcccaaggacatgcgcccagcacacgcttccaacccagctgtgagggccagggagccgcatggaaagcaggacttctatggagaaaacctcagcgcagacacactgggctctcacagctgccgagagcctgggctggtgtccaaagagcctctctgtctccctctcccccacagggttctggtcatggacaaggggcaggtggcagagagcggcagcccggcccagctgctggcccagaagggcctgttttacagactggcccaggagtcaggcctggtctga

SEQ ID NO: 37971 - DNA, 2284 bp, Homo sapiens
cttagcgacagacagacgctgggacccacgacgacagaaggcgccgatggccgcgcctgctgagccctgcgcggggcagggggtgagtgccccccatcgcgccccactctccttttccaggcttggtttggctgcagatctctcgggctgcgatactggggagaggagagacccccaaattcctggacccgggaagcgaggagacttactccggccccctcactgcagcgggttggatttctttcaccaagccagcagccgagagcccagctctatttaaggggccaccagacctcccagctactaggggctttgacccttctttgcataaagctagtgggtcccccaagccctcctacccccggagagcccttacctctctggtttctttttccattgctcttagcaaaggactccagggagtggagttcatggagtgggggtgggggttgcaaactgccagcatttcgagggccagggagttgaagcaataaactggcaatgaactgagggctttctctgtgcctagccttgtgcccaaccttgtgccatgctgctatgaactttgctgctattcatccatttaatacaactcatagaggtagagtctcgttatcccccttttgcagggaaggaaactgagatacagagaggttaaagtttgcacagccggtgagttgtgaaaccaggaggagtaaaaagacagcggagagagaattgaagaggccacgtccactaaacttcaaatttcttctagggttagataggaccagcagacctgctgagatgaaaataacagatcaagctgggccggtggctcttgcctgtaatcccagtacctaggaggctgaggcaggaggattgcttgaggccaggagatcgagaccagcatagagagacccccatctctacaaaacataaaaaaaaaattagccaggcctggtgaggcggcttatgcctgtaatcccagcactctgggaggccgaggtgggaggattgcttgagcccaggaaattcgaagctttgttgagctttgattgtgccacttcagcctgggcaacagagtgagaccctgtctctaaaacataaattaattaataataaaaaataaaaataaatcatacatcaagaccaccagttgaacgaggtttggggtcagataagcctgggtcagagtcagctttgccacttcccatttgtgtgtccctgggggaggcagttccctgattggtgcctcagtctgctggtttctgaaatggagacagtactgtctgcatcctggagttgttataaggattaactgacagtccatgcctagcaatgattatggagcccaggtctcctagaccacatggcccagttccctgggttcaaatcccagcccttccactcctcagctgggtaaagtcagcaaagttactcaacctctctggtcctcagcttcttcatctgcatatcaatataattgcaactacctagggttaatgtcaggatgaaaggaattgagaattagtaggtattccaaagagtacttggcacatttttgtgtaaatgttaaagatccaaaaagttgcctggccccccaggcaggtgagctggggacccctgccttgtaccatcctaagggtcctctttgtgttccctcaggtctggaaccagacagagcctgaacctgccgccaccagcctgctgagcctgtgcttcctgagaacagcaggggtctgggtgccccccatgtacctctgggtccttggtcccatctacctcctcttcatccaccaccatggccggggctacctccagatgtccccactcttcaaagccaagatggtagctgccatccctgggagcctggaaccaggcaatggtggggggaggcaggggacaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagggccacattaggatgaaccttttaaaaagttatgcatttatttttatgtttccccactagctgtattataggacaatttttatatgtgatatgtatttaccttagtgtgttaaataaacactggcattcc

SEQ ID NO: 37972 - DNA, 64714 bp, Homo sapiens; identical to SEQ ID NO: 35642

SEQ ID NO: 37973 - DNA, 42923 bp, Homo sapiens
ggcctcccagagactcgcggacgctcacgataaccaaggacgaccgcgaaccaaggtaaagccaacgaggccacctcgtgcgcgacggaggcgtctttgccgccccttccgggacgctcacggtggtcgccgcccccagcagggaaatgttttgcctccagagcgtccgcccagaagaagcggacagcgcgcttgcgcaagagagccgggccgcggcggcccgcgcctgcgcaccaggactcggcggcggcttgcgcctgcgcggcgcggcgctgcggagaccgttggttcatttgcatgtccccgcctcgcgcggcggcggcggcgggtgaggagcctgaggcggcggcgggggtggctccgcgcgcggtggtctcggggtgaggcccgggccctggcgtcgtcggtgggtggctcccggggtgggaagctcgggctcggccttgggggcccgccccgggctccgtgatggcgtcgcaggctcggccctctggctgcggcggcggccgcgtccccgccgggttggcctgggtggccggctgcggcctcccgggcccggcgcccccatttcctcgcccgcagaggccgggagacggcgggccgcgtccacaaaggctcattggttcagtcgttcattcattcctcccgaactcggagcggcccccgctcgggaggagataacggcgcccagcgctgcatcgggcccttgccctctttagaaccggttcagcccccacaccagcccctttactggctgcccattccataggtggggaaacggaagcacagaaagcttagaatcgtgtgatttgaacctgggtcacctgacccgggaaccctgccctttgccagcagagaacaagggggcgccccgggaaaagggctgaaggatgggactgggggaggcgggtgggggaggcggtgatcgtgatgggaaatggaccctacgggttgtctcttgaagttggaggttttgcgaagcgggatatcttgatggttaaggatgcagcccctggaccccaaaatgttgcttaatctttttactcattcttcggggctttggatgcacgaataccctttttgccaggttcaaatctgggctgtctggtcttgaatgggtcgttgagtctgtctccctttgcctcctcaccctaatgtcattcataacaggacccgcctcttcagtgggtggttgggagatcgcgcaaggacccagcgcagaatgaactgtcactagttcattgtcattggttgggggtcccgccactcactgtcaagaggcttcttttagaagggaaggaagttctcagagcctctgtgccctgctgagtctgtgaatgggaaaagagtgatcctgggccaggcgcagtggctcacggcctggaatcccagcactttgggaggccgaagcgggcgaatcacttgaggtcaggaattcaagaccagcctggccaacatggtgaaactccatctctacctaaaatataaaaattagtcggatgcggtggcggactcctgtaatcccagctactcaggaggctgaggcaggagaattgcttgagtccaggaggcggaggttgcagttagccgagatcatgccactgcactccagcctgggcaacagggagagtctcaaaaaaaggaagaaaaaaaaaaaaaagattgatctcttctttcctaaccacgatttgcgagggttgtggtcccacccttcctactctgttatgctcagttatgtgtgttggttgacaccttcctccagcagatagaactgctttcacagagctgcttttaatggattccaaggagatgggcccagagaaggtttgtcttgctccttttcagccagcacacacctgtgaacttcgtgagggcagagacccccttaaaagagtccagacaaggtgggcagattgcttgaggtcaggagttcgagaccagcctggccaacctagcaaaaccctgtctctacttaaaaaaaaaaaaaaaaaagataaataaaaagggtccagcttgcctctgaagtaccatgcgaggattatggattactgcctccttacttcgaggattaagtgaaatagagcaggttctgtgagcacgcattttttttttctttgagacagtctcgctctgtcccccagtctggagggcagtggcatgatctcggctcactgcaacctctgtctccctggttcaagcaattcccatgcctcagcctcctgagtatttgggattacaggcacgtgccaccatgcctggtgaaatttttttttttttttttttgagacggagtctcactctgttacccatgctggagtgcagtggcatgatctcggcccactgcaacctccgcctcctgggttcaagcaattctcttgccacagcctcccaagtagctgggattaaaggcaggcaccaccatgcccggctaatttttgtatttttagtagagacagggttttgccatgttggccaggctggtctccaactcctgactttaaatgatccgctcacctcagcctcccaaagtcctgggattacaggtgtgagccaccacacccagcctgaattttttgtattttagtttcatcatgttgcctaggctggtctcgaactcctgagctcaggtgatccgcccacctcgacctcccaaagtgccaggattacaggtatgagccaccgcgcccagctccaagttgttgctcttagtgtatttttttctctctcaccatagggcaaaataacatggcagccagacgaattacacaggagacttttgatgctgtattacaagaaaaagccaaacgatatcacatggatgccagtggtgaggctgtaagcgaaactcttcagtttaaagctcaaggtaaaataaagtgttgttgttgtagttgttgttttggtaggggtgtatcttagggccaaggcaggaagattacaataccttgggcaaataataccagtcctctgatccttagtttccttatttaggaggaggtaaaggtttttattttggtttggtttcttttttgtgatagggtcttactctctcccccaggctgaagtgcagtggcgcagttttagctcactgcacccttgaactcctaggctcaagccatccttccatctctgcctcccagagtgctgggattataggcatgagccactgcacttggtcaggggataatgttttgatctgtcagtcatcattatgtagttatctggagcttctcactggatatcctccccgacccacctcaagacagttttgtttattgtttgtttgtttgtttgtttgttttgagacggagtttcactcttgtctcccaggctggagggcaatggagggatcttggctcactgcaacctccgcctcttggctcactgcaacctccgcctcctgggttcaagcgattctcctgcctcagcctcctgagtagctgggattacgggcatgcaccaccacgcccagctaatttttctatttgtagtagagatgaggttttaccatgttggccaggctggtctcgaactcccgacctcaggtgatccacttgccttggcctcccaagatgctgggattacaggcatgagccaccgagcccagcccagttttgttttttggtgttttttatgtttttgttttttttgttttttgttttttttaatagatatggagtcttgctatgttttcaggctggtctgcaactcctgggctcaagtgatcctcccacctctgccttcagcatgttgcgattacaggcgtgagccactgctcccagccccaagacaggttcttggatccatttcctggctccatccctgtcaccgctgcccaggtttaagctctactagttcttttttttttttatttgagacagagtcttgtactgtcgcccaggctggagtgcagtgacgtgattttggctcactgcggcctgtgcctcctggattcaagcgattctcctgcctcagcctcccgagtagctgagattacaggtgcctgccaccatgcccggctaatttttttgtatttattttagtaaagatggggtttcactatgttggtcaggctggttttgaactcctgaccttgtgatctgcccgcctcggcctcccagagtgctgggaggatcacaaggtcaggagatcgagaccatcctgtgaatggtgaaaccccgtctttactaaaaatcaaaaaaaaaaaaaaattagccaggtgtggttgtgggtgcctgtggtcccagctacttgggaggctgaggcgggataatgccgtgaacccgggaggtggagcctgcagtgagccaagattgcgctactgcactccagcctgggcgacagagcgagactccatctcaaaaaaaaaaaaagaaaaaaaatggccgggcgcagtggctcaagcctgtaatcctagcactttgggaggccgaggcgggcggatcacaaggtcaggagatcgagaccatcctggctaacacggtgaaaccctgtctctactaaaaatattagccgggcgtggtggcgggcgcctgtagtcccagctactcaggaggctgaggcaggagaatggcgtgaacccaggaggcggaggttgcagcgagccaaggttgtgccactgcactccagcctgggtgacagagcaagactccgtctcaaaaaaaaaaaaatttatctgggcatggtggcatgcgcctatggccctggctacttgggaggctgaggcaggaagttcgcttgtgcccaggaagtcgaggctgcagtaagctgtgtttgtgccattatactccagcctgggccaaagagtgagaccctgtctcaaaaaaagacggccaggtgcagtggcttacacatgtaatctcagcactttgggaggccaaggtgggcagatcacctgaggtcaggagtttgagaccagtctggccaacatggtgaaaccccgtgtctactaaaaatacaaaaatgtggcaggcccctataatcccagctacccaggaggctgagacagaagaatagcttgaacccaggaggtggaggttgcagtgagccgagatcgcaccactgcgctccagcgtgggtgacagaacgagactccgtctcaaaaaaaaaagacagattagggggccgtgggtgggagaggactagaaacctagcagtatgctaggtgattctggaacatttctgtgttgcaaagcagtctatcgtttagcctttctctgtttctctgctccactctgaacttttcatctcctcataaagggtatgagaaaattctcttgagtagaatccagccatcactctctgtcactaatgttccctccctaatcatgccatcaataccaatcatcaatacctgggttatcacagtggatttcttgcaggaacatccacgtctgtgctcatctcctttaatctgttccctgtgcagcagccagtgagatcatccctctgcttagaactcttcactagccttctgtctctcccagagtaaattccagagtaccactgagggcccgacttggatctggtactccttctccatttgtgtctcttatattagtggttccctaactttgtagcacgttagcgtcacctgggggccttttaaaaaccctgatgcccaggtcatccccttatttaattaagtaagaatgtctggggaggtggtccctggggctccagtagcagagtttgggagctgccttcctaccacttggcctttcattccctgtgttcccttctgtctacattggccccctactggtcccacctcagggtcttgtcctcattccccctctgcctggaaggcttccctttgtaactgtacggtctggctcctcatgccaggccactgctgctagataaagtgtcagagctatgcagcgtgacacggtggctcacgcctgtaatcccagcactttgggaggccgaggtgggcggatcacaaggtcaggagttccagaccagcctggccaatgtggtgaaaccctgtctctactaaaaatacaaaagttagccgggcatggtggcgggtgcctgtattcccagctactcaggaggcggaggcaggagaatcgcttgaacctgggaggtggaggttgcggtgagccaagatcgcacccttgcactccggcactccagcctgggcaacagagcgagactctgtctcaaaaaaaaaaagaaaaaaaaaagtgtcagagctaccctccttgactagcctgtctcaaaatgtcattgcctcctcaggttcccacgtgcttgatttgtcttcttggtacttaacttgcatctgatatatttttgtttattgtctggctctctcaactgacaagtttggaagagttctcattttcttgctgtaacttcagtgcctagtacagtgcttgcgcacagtaggtgcccagtttgtacttgttgaacaagtgaactaggatttatatacgactttggcttcctgtggcctcttaacctattgctacctcctggcacctctccttccctgttcatttgattttttttttaactaggtcatcgattctgattgaaaagctagaaagaaaggcattccatgaaaactctccctgaggcccactgttctcatatgcccgtagttcacttctcttcctcgcttcttacagtttctccatgtgtgattaagcaaatgcaagtacatcttcccctccgcccttttttatttttgacagagatagggtctcgctatgttgcccaggctggtctcaaactcctgggctcaagtgatcctcccacctcggcctcccaaagtgcagggattataggtttgagccactgtgcctggcccatttccccttttctacatggagaaggacagaattgggcactgttcagtttccatcatggcctctcttgatgtatcttgttaagcttctgccttccctcctgcctgcctcggtctgtggtttttcagctccagagagagggttgattggcctggccgacctttccgagggatgggttcagccagctttgggtcagctgtggtgggtgtggtgttagctatggttcctctagcctcacggtggcactgtgggctgagacttccttctaagaggcagtgaaggcaggtagcctcaataaaacctgtctgttctgagatagaagtagaaacacagaagtgctccagttgcagtaaaaatatccaggttatttggggaccaaacaccctttcctcagactaaaagagggattgtcaacccagatggctagagagtagggggatctgaatgagcgagggctgttggtgccaacttagagagtctgtgtcttgcccgtcaggctgctactgcccagcctgggttgacgtcatcagggcaaactcaggcttggtgcttataggtcttctgttttagtaagtagtcgatccagatttttaagtgacaccacacgcattttaaatgttggcagcaaatacagattggcaaaaagcactgaggtgtataaagcagttttgctgcctggtgatccgtggactgtttgtttgcactgtttgcattctctggtctaaagtatcttttggcttcttcttttttttttttggatggtttatttcagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatggtaaggaaatcagccaaagtttctatttgttgtttttcgtgtttctttggtaatgtcttttattcgagatttttttacacagaagttctttagccaattggaaacatatcaggattttagtagaaaacgcacattggccaatatatgtctgccattcattctgtgaatgtgtattaggaatctgctgtttaccatagaagtctttagacagccgggtgtggtggcacatgcctgtaatcccagcactttgggaggctgaggcggcagatcacttaagaccaagagtttgagaccagcctggccaacatggtgaaaccccatctctactaaaaatacaaaaactagccgggtgtggtggcacgcacctgaaatcccagctactcgggaggctgagttaggagaatccacttggacctgggaggcggaggtttcagtgagctgagatcaccccactgcactccaacctgggtgacagagcaagactctgtctcagaaaaataaaaatttttagacatttttaggtcaaatacctctctgggaatttggtagaaagctgtggccattgccagaaaaaatgctcatctattcacgcacaattttacctatatcatccgggggattcgtacctttctgcagccaaggttaagaacgcttgttcctttttttttctttttaacctttgaaaaaaagaagggttgactttctttccttgtttttgtttttttgagacagggtcgtgctctgtcacccaggctggagtgcagtggcatgaccatggctcactgcagccccgacctcctaggctcaagtgatccttccgcctcagcctcctgagtagctgggactataggcatgtaccaccatgcctggctaactttttttgtatttttttgtagagaatcatgttgcccagactggtctcgaactcctgagctcaagtgatctacctgcctcagcctcccaaagtgctgggattataggtgtgagtcactgcacctggcctggaacccttgttccaacatgtccccacaaggtattactagaagggagaaaagacacagagcactgtctctgaggaatccccaggctcctgagggaagaaaatcacaaagaccagtcacttgtgagccaggggtggtagcatatgtctgaaatcccagctacttgggaggctgaggagggaggattgcttgaggccaggagttcaaggctgcagtgacctatgattgcatctgtgaatagccaccgcactccagcctgggctagaatcaccctgtctctcaataaaccaaaacaaaaaaacagtcacccctgtgctagaattaaagcgacacaggagaggctccagtctagcctggaaagttggagaggtcgtgcttgagctgtattgagggatgtgtagggaacagccaggtcattccacatagtggatacaccttttcgccctactcacttttgtagactggctaaagttggtgaatcacttaagtacacctgctaattagcagttatcattggctttctggggagaggaaaaggccaaggaggagaaatagaagtgatgagctgtttggtttccctcttccttcctcctaagctcccagaatggactctcacagcccagacatcccagaggtcacgagcacacatggtaatcatgctgtcttaactcttgtgatagggagaaagcacttttcccacgatgtggttttcaccttccattgcccccagtccagtggcgaagtctcatttgttcctgactttctttgctctttcaccaccctcaggaagccccaacagcactagacactagataggtcccaccacatacaggtggccacacctactcccagagagggatccttccagaagtaggctcagggcttaagggaccctactccccaatccctcacaaagtgatggcatactgtatgaaggaagaaaagtcaccgataacctaaagtggttataacccacccacttaccctcccacagtctttgatgttccccctgttttcctgcagctgcaggcatgctggactgaaaatgctaccgcctgctcttctacatgattgccagaaagccctctttgtttccacagcctttgctacatcctgatattgacctaatgtaaattacctcacctttcccttgatgctggactcatgctgccttttactagaggtttctgaagccagacagacctgggttcacatgtagttagcatctgcaagcctcagttccctgtctggatagcgggataggtggcagcagggcccacatctcatgaggctgccccaccgctgcttatgttcctgttagaaatgctataatgggccaggcgcagtggctcatgcctgtaatcccagcactttgggaggccgaggcgggtggatcatgaggtcaggagatcgaaaccatcctggctaacacggtgaaaccccgtctctactaaaaatacaaaaaattagtcgggcgtggtggcatgtgcctgtagtcccagctactcggaaggctgaggcaggataatcgcttgaacccaggaggcagaggttgcagtgagccgagatcttgccactgctctccagcctggcgacagagcgagactctgtctccaaaaaaagaaaaaaaagaaaaaaagaagtgctggaatgggctgggtgcagtcgttcgcagctataatcccaacactttgggaagctgaagcaggtggatcacctgaggtcaggagttcgagaccagcctggccaacatgacgaaacctgtctctactaaaaatcaaaaattagcctggcatggtggcacatgcctataatcccagctacttgggaagctgaggcaggagagatgcttgaacttgggaagtggaggttgcagtgagcctagagcgcaccactccactccagcctgggtgatgagcaaaagtccatctagaaaaaaaaaaaaaatgctggaatgacatctttggttgaatgctttggttattactgttagttttattgtttttaattctccttgaaagggtacattctcaggagtaggattgctgggccaaagctgtgacccactttctgacccttgttcgtggtcatcctagctaaagatgaccaaatttgcaggggtccctaaatttcattgctgactgtaaacctcaacatcttttgtaaaatcatgtaaaactagtagctctgtaaaaagagagccatgaaaaaaaaagcagtttcataggggacatacttggaataacgtggcagttgaaggattgactcatcatgtgtgaggagctcacactagtgtttaaaataagctgaaagctgcaacatggacacagacgggcacaggactatgcaatcatttacagaacaaactggaaaacctcgctagttcagcagtgattttaattgagttgagtggctgaacaaatagaccattctttgctttttttttttttttttttttgagatggaattttgctcttgttgcccaggctggagtgcaatggcatgatctcggctcaccgctatctcagcctcccaggttcaagcgattctcctgcctcagcctccctagtagctgggattacagtcatgtgccaccacacctggctaattttatatttttagtagagacggggtttctccatgttggtcaggctggtctcgaactcctgacctcaggtgatccacccgcctcggcctcccaaagtgctgggattacaggaatgagccattgtgcccggccatcattctgtacttttaaaactagacaattgttaggaaactaaacaatcttaccattcgaagaaacatgttctgtgttgctggcagcattgtaaatttaaagtcatattggaggacattcacactttaaaaaatattttgggcagggcatggtgtctcatgcctataatcccagcactttgggaggtaaaggagggtggatctcttgagcccaagaattggagaccagcctgagcaatgtggtgaagcctcgtctgtacaaaaaaataaagctgtacgtggtggcgcatgtctgtaatcccagctacttgggaggctgaggcctgagaattgcttgagcctaggagttcgaggctgcagtgagctgtcatgggaccactgcactccagcctgggcaacagagtgagaccccatctcaaaaaaaaaaatttgcctttttttttttttgagacagggtctcactctgacgctcaggctggagtgcagtggcgcaatctcggctcactgcaagctccacctcccgggttcacgctattctcctgcctcagcctcccaagtagctgggactacaggcgcccgccaccatgcccagctaatttttttgtatttttttagtagaaatggagtttcatcgtgttagccaggctggtctcgatctcctgacctcgtgatccgcctgccttggccttccaaagtgctgggattacaggcgtgagccactgtgcctggccaaaatttgtttcttatacattcagcagatattttctgtgaacatgtaatttgggatcactgacctttttatttatttatttatttatttttttttgtgatggagtctcgctctatcccaccatgcctggctaatttttttttttttttttttttttgtattttagcagagacggagtttcaccatgttgcccagtgtggtcttgaactcctgagctcaggcaatccaccccgctcagcctcccaaagtgctaggattacaggtgtgagccaccgtgcccggctgaccttttttttttttcttttttttttttaattggagaaaattttttgtgaattgatacatatattttctgattacaaaacacaagttttttttttaagttcttaaagcataaggaaaatgaaattcctgataattctaccccctataacctctgttaacatatttcctaacatatttccttatagtcttctttctatgtatccatatttatattttttattcccacctttatattgagaaccataacctagatacatttttgtatattttatactagatatttatattttccactttaatgttatgaacactcaaattattaagtaatatgtgaaaaatgatatcaaattgctatatatctttctttttctagagcatatacataaattgctctgtccagtcattgaaagctgtgactgtttctctcctagtggttatactgttacattttttaggaggagattttccatattggttgttttcctcttttcaatgctggtgtcttgtgaatgaggatttcggttgttgatgcctgcttgggttcagcactaagcccccaactactcaactatcctcgtcttctcagagcccacattcagcatatttctcagagaagctgttctgtgtgttccagctgtcccccagcgagcagatcacagggtagtgggcaccatcgaccagcttgtgaaacgtgtcatcgaaggcagcctgtctcccaaagagagaactcttctcaaagaggaccctgcttactggtaggtctttaaatgtccacgctgtgaatccctctcatggagtatatggcaaaatttgggtcactctgatggtattgagagcagagggtgagatacttgagcaagtggtgttctccagtgagaagagcatgagggtggctcagatttatgtgggttcagcaagccccagctctgctgcagaccagtggtaggccagctgggtgggtggccttctctcacctgtgactacagctccaagtccctgctgggctgttttaaggatgcagtgagatgtgcatgcagagaatacagagtaagggtagtaagattagtaatacatcattgcagttgtttgcaatttattgctaatatttgttaaactgtcttttgcttaattgcctctttatgtaaatagaacaacttttttttttttttttttttttgagacggagccttgctctgtcgcccaggctggagtgcagtggcgctatctcggctcaccgcaacctccgcctcccgggttcatgcctttgtcctgcctcagcctcccgagtagctgggactacaggagcccaccaccacgcctggctaattttttgtgtttttagtagagatggggtttcatagtgttagccaggatggtctcgatctcctgacctcatgatccacctgcctcagcctcccaaagtgctgggattacaggcgtgagccaccgcgcccggccgaacaacttattaaaattacagtttgcgtcctaaatatagtactttcttattagagaaagtaaagaacaagccagagaaagagtcttgctctgtcacccaggctggagtacagtggcgcaatcttggcttactgcaacctccgtctcctgagttcaagcgattctcgtgcctcagcctcccaagtagctgggattacaggtgcacgacatgaggcaggtcacctcagcaaagaggcaatggccagttctgtccacagggctccagtggcaacaaataatgcttgtggggtgtgagggtggaaggtctcaaatctgtgtatttttagtagagatggggtttcaccatgttggccaggttggtctcgaactcctgacctcaggtgacccacctgccttggcctcccaaagtgctgggattacaggcgtaagccactgtgctgggctgagacaccatttctcttaaaaaaaaaaaaaaaaagtgatgatcagtgctttgattgtatttctgcctacctttctggcagtttattatgatatctgggcgtgaaactgctgggttaaagctcatgttagaggcttttgatttatgtcagtttctcagctgcagcactttttatttttattattattatttgttaacggaatcttgctctgtcgccaggctggagtatagtggtgtgatctcggctcactacaacctctgtttcccaggttcaagcaattcttgtgcctcagcctcccaagtaactgggattacaggtgcccgccaccacacccagctaattttttgtattttagtagagacggggttttaccatgttgcccagggtggtcttgaactcctgaaatcatgcgatccgcctgccttggcctcccaaagtgctgggattacaggcgtgagccaccgcgcccagcctcagctgcagcactgaggctggatcattctgtattagggttggagctgtcctggacattgcaggctgtttagcagcatctgtggcctctatccgtttgatgttagtaggaccttctgtctcactagtaacaacccagaatacatccagacactgcctggtgtcccatggcaggcagagctgcccctgatggagaccattgatgtttatcattagattactctccataggttatctgtactaattgactttctcactgctactctgtaggtgtgctgtgccctcttttgttttctgttttttgttagtgacaggatctcactctgttgcccaggctgcaatgcaggggtgctatcacagcccactgcagccttgacctcctgagtgtgccctttttggtagtcagattgtacccatactggacttgctatgcttgctgttgtaattactaaagatgcttgaaaggcatacatttccatgtctttggtcctacccaccatgatttaccaaggggaaggttggagcttattgtggttttatttttacaaaattcttgagtttggattattttcatgtattgaatgaggtaggcatgtaacttaaaagttaaaaattcccaaataacctaattgtcccagcatcatttattgaatactttttatttaataaacacttgtgccttctgtgcagttggtactgttctaagcacattactgatttaagcactagctggttgaatcctcataaacaacgttgggaggcaggtctcttgctatgcttattttacagacaagaaactttgaggctccaagagccctcttgccttgaggatccacaactagtaagaggcagagttgagattcaaatccagggtctgtggtctgaaccagtgtgcatgttgaaggattgtcagattgacagatgcaagcagataccgaccctcttggtaagaaggcatccagacttagaaggcccaggggcactttacaggtggttgataaggtgattaggctggaggaataggaggccctgagaggcctgggggctggtgcctctgccccatgacccctgcacatggcccagtggtctcatgaccactgataaccaggggcagcagacggaagccagagtcaggggtatgtttggatagggggcagggcagggtacaaaatcagaaataagcggccgggcatggtggctcacacctataaggtgggtggatcacgagatcaggagatcgagaccatcctggcgaacacggtgaaaccctgtctctactaaaaatacaaaaaaaaattagccgggcctggtggcgggtgcctgtagtcccagaaataagcatcaaactaagaactgatatttgaggtaaaccagtatcatgaaagagcatcaccaaactcaaccaactcctgacaccctagaagacagagtcactatgagaaagaggaggtgtagtctataaatatgtatgtgcaatgaatagtctcaggtaataagagtatattgtatccatgaaacagacactggttgctatgaaaacgattctattaaggatcttggaaatgaaaaatagattgaaataaaaatctcagcggttggctgatagaatagatcctgaagaaggaaagatttaggagttggtcccagagactttatcatccaaaaactccttcacaaggaattacctggctgggtgcagtggctcacgcctgtaatcccaacactttgggagaccgagggggacagatgacttgaggttgggagttcgagaccagcctggccaacatagtgaaaccgtgtctctaataaaaatacaaaaaattagctgggcatggtgacaggcgcctgtaatcccagctacttgggagaccgaggcacaagaatcacttgaacccgggaggcagaggttgcagtgagccaagatcgcaccactgcactccagcctgggtacaacggagcatgactctgtctcaaaaaaaagagaaggaattaccaagagactgtaagaggaaagagtgtgatacaaaagcacagcaataagtaaagaaactgctaaacttaggtttctggtgtgcatgtttgaattcttaagtcaaaatgctccttgtatgttgtatttaacaaaacagtcaattgaacgcataatgaaaagccaaatgtttctgctgtgacctgtttccatgttccactccttgaaggcagtcacttagttcttcaaactacttctcacggctacctctgtatctctttttattatttatttatttatttatttatttatttattttttgagacagagtctcgctctgtcccccaggctggagtgcagtggcgggatcttggctcgctgcaagctctgcctcccgggttcacaccattctcctgcctcagcctccctagtagctgggactacaggcacctgccaccacacccggctaatttttttgtatttttagtagagacgggatttcaccatgttagccaggatggtctcaatctcctgacctcatgatcctcctgccttggcctcccaaagcgctggaattacaggcatgagccaccgcacctggcttacctctgtatctcttaataagcctatgttgctttttcttgactgaacagttttatgcatgaccattgacattctctgaagatatatgtggattaataagttcttttttttttttgtttaaagagatgagttttcattctgttgcccaggctagagcacagtggcatgatcatagttcactgcagcctcaacctgggctcacaaaatccccctgcctcagcctcccaagtagctgagactacaggagtacaccaccgcattcagctatcagcttttttttttttttctttttttaagaaatgggtttttgctctgttgcccaggctggtgtctaactcctgggctcaagcgatcccccagatcactggggttacaggcatgagccatcatgtccagccttaataaattctttttattagttagcaagtgaaaaagtcagacctctaggaggcagatataagaagggcttcttatctccaccctctgagggccagcagagatttgagaccttccaccctcacaccccacaagcatgatttgttcccactggagccttgtggacagaactggccattgcctctttgccgaggtgacctgcctcgtgtcgtgcactaaagatgtcagaagagccaggtgcggttactcacacctgtaatcccaccactttgggaagccgaggcgagtgggccgcatgaggtcaggaatttgagaccagcctggccaacatgatgaaaccccatctctactaaaaataaaaaattagctgggcatggtggtggctgcctatactcccagctactcaggaggctgaggcaggagaatcacttgaacccaggaggcagaggttgcagtgagctgagatcgcaccactgcactccagcctgggcgacaagagcaaaacaccgtctcaaatcaatcaatgaatcaatcagaagtatagacagacacatccactatggctttacttccttgtttggaacaccaaggggcaggcttccgtccttttctatgagagagtgcaaagcatcaagcctagaaaatgataacaacagtgcaggatataaagctgaaggaatatgtcatactttgttttctctcatcttctaaattgtcccctgggagtgggccagccctgaccatgctctccagggagagcccaccaggtcctacgtgttcacacactcaggaaaacaagtggctaagaatccctgtggtctagcctcagcaggattgtccaagcaccccaaagttaacataaaatctaaataattgatgtttggggtgaaataaaagaaactaaaatcccagatgatctaaatatgtgaggcacaaggggaaggagggaggtaggtgtgcaggcctttgtcttgtttgacatgaggatagagctaaagggtaattctggatattgatacaaaataaaagtttaggtatgtgtgtcgattagccattaaaggaacagaagtgaggtctataacttccgtactactatagagagaaagaagcaaaaacacaggaattggaaaacacagagatgggaaattgcatagcaggtgaacgctaccaaaaagaaaggatgtagagaattgtttaggcaaaaaagactttaaggagaacagcactaaaaggagcaaaagaagttcctgataaaagggaaagtcatcacgaacatatagattgtgaatcttggtgcctgcactacatagctttgagccatgtaaataaacaacctttagaaatcatttaagtccagagctgggtgcggtggctcatgcctgtaatcccagcactttgggaggccaaggtgagcagatcacctgagatcaggagttcaagaccagcctggccaacatggtgaaaccccatctctgctaaaaaaaattcgaaaattagctgggtgtggtggcgggtgcctataatcccagctactcgggaggatgaggctggagaatcacttgaatccaggaggcagaggttgcagtgatccgagattgcgccactgcactccagcctgggtgacagagcgagactccgtctcaaaaaaaaaaaaatcatttaagtccaaaaccatgataagaggaattggatgaatccaaaaccatggtaggagacattaatgtttctctgaaatgcgtagacgacgtaatccaaataaggttgtggaagattttataacacaggaaatgagcataaacagagacaatctgctaatatttgttgagcggttaatgactactaggcagttttcatagcacttgcctcctagtgaaaagcttataacgcaggcctcacagctgtatgatgaagtagctactgcttatcatcttccctgtcttacagatggagaaactgaggcacagaaaggttcccagctaataagtggctatgctgagatttgaagccagcagactggcttgttgagtgttctctgttcttgatgttatgttccactggaacttgggagatgcatttgggactgacatcctcggactgcacttggcatcagaaccatccaggaacaaggaaagccatcagagccatgagtgactggggcagtcaggtcacctggccctgattctgcgctctgcccttgatgaggagttgccttgctggggctgtgtttgacttgagaaccagagtgcccatgttggtcagcattctcttaattgagcgctattgcttattagggcatgatcttgcaggatgccaccgttagcccaacagagtgccagggcagcagtggagccggtactcagtcgttttgtcaggtccagacagacctcaactggctaacagtgtcagcaggagcttgtgtatggagctgcctgccagggacatgccacatcacacagtgctgccaatgctgtgcaacacacagccaccttacttctagttggcttgtcactggtaatctggaacctcatctaataactgatatgtcgctacttaatatcaaacaatctgaaagccacctgaaatactgccatacttactaagcaatattcttctttaacacaaactgaaatcaaatattcacaaaagtctgttatgtttgttgtggggtggttatttatttatttatttttaaagagatggggtttcgccatgttgcccagactggtcttgaactcctgggctcaagcgacccacctgcttccgcctcccaaagtgctgggattacaggcgtgagccaccacgcccatcttaaaagttcgttatgtatgaaatcacagagaaaatcacagcacacccaggaaattcacgtgggccacattatgccaatacagcaaactagaaaccagcaacaaccaaaataaaacatgtttctgaataacttttgagtgaagggtaatcatagctgaaattagaagcaatttagaaggaagtggcaagaagaacattatataccagatgcagtcataaaaatacttaagagaaagagtgacttcaggtgactttattagaaatagtgggccaggtgcagtggctcacacctgtaatcccagcactttgagaggctgaggcgtatggctaccttgagcccaagagtttgagatcagcctaggcaacatggtgaaatgtcctctcaaccaaaaacacaaaaattagccaggcgtggtggtgcgcgcctgtagtcccagctactggggaggctgaggtgggaggatcacctgaacccagaaggtcgaggctgcggtgagctgtaatcaactcatgaagctagaaggaaaatgatgaaaaaagtaaagacactagaaggagaaggttttttttttttttaaagatagggtcttgctctgttgcccagactggagtgcagtggtgcaatcacagctcaccacagcctctcgacttcctgggctcaagtgatcctcccaccttagcctccagagtagctgggactataggcatgcaccaccaccctggctaatttttttattttgtggaaatgggatcttgttttgttgcccaggctggtcttgaactcctgggctcaagcaatcctcccgcctcagcctctcaaagtgctgggattacaggtgtgagccaccacgcccagctgaatatttttctgttagtacatgtagctcaaccttctctttactgttctcatcatgatgactgggtcataagatttcacacctgggccgcaggctccttggttaatgttctcttgtggttcacatcacactttccttgatgcagtcaaaagctcaccgagcactcatcctggctgggccatttaaaaggtgtcaattctgcctgccagggtgctatggctccaaggtgactggtttgtgtttccaggccatcaagagctgggagctccctcacggctgctgctgatggaaatcaaggaggaactcagttcaaactcccgattgccctgtggtcactcttagcagggcagctgtcttgggcctagctctgggtcctcagtagagccaggcagagcctctgagacaggagaggacagtgaggagttggccacttagaaagggtttgtgtttgaaggaacaatttgggacctggtggtgttttcataaatgtcccgttatgcttgttttgttatctaggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacagtgggtgctcactcctgtccccctcctctgggccccagtccctactctcccatctccagggtctctttagaattgggggggcctgcaatctaggcaaggcagtggataaaagctctagggacctggccaggacaagtgtacatgttggcgctttctctcttgctttcttgagagagctgcatgcgagtcctgcagctccctcctcctcttctgagagcggagctggtatgaggtgctgccccatgccttcgtgctccccgacagggtcctgctgctggggccgtgggcggtgcattgcctgaacttgggatcccatgtcctgctatatcctggcctcccttgatagtcttcgggactgccttgttctcattgcgcctcctcatccccagggtctccacagttcctgttcttggggttcgctgacctgcactgcttcctccgaatcgactaacttcaccccttctgtttcttctgtcaccttagctgtttctttctctctgtaccacaggcctgctctctggccagtgcttcctaagcactaagtgggaaggagagagcaaaaaagtgtccacaactgctgcattatttaggtgttgctgtgtcgtgagccgttccaaactgtggcttaaaacaggaggcatcagctgggcgtggtggctcacacttgtaatcccagcactttgggaggccaaggcgggtggattgcctgagctcaggagttcgcaaccagcctgggcaacatggtgaaacccgatctctactaaaaatacaaaaaattagctgggcgtggtggcacatgcctgtagtcccagctactcgggaggctgagctaggagaatcgcttgaacccgggaggcggaggttgcattgagccaagatctcaccactgcactccagcctgggcgacagagcaagactccatctcaaaaaaaaaccaaacaaaccaaccaggaggcgtccggtattgtgaatttgccagtggctgggtcatctgctgagctagcccacacatgtctgcggtcagtggcaggtgtccaggctgtcagctgagatgatggtgtggctgggccacatgcctgtcatccccccagcagccagcccatgtttgttcacctggcaattggggttggggcttcaggagagacagtggaagtactcaagtcctccaaggcccaggcttggaactggcaatgggcttttccaccacattctatagctgatgtgagtcccaggaccagccctgattcaaggtggggatacacagagttcacttcttggtgacaaagggtccacatgtgacgaagggcaaggctacagggaggggacatgcaggccatctttataatcagcctccacaaccctgcagtgtttacacggggagcagcagctcaggagtcatgcctgacaggtgctttatgttttgtagttgacatgaagacaatggagactgcagagaaactggctagatttgttgctcaggtgggaccagagatcgaacaattcagcatagaaaacagcaccgataaccctgacctgtggtacgtacccccccgggtctcatcacacctttttctttctcagagagacaaagtctaaggatgttgcttaggctggatttgaattcctgggctcaagtgatcctcctgtttcagcctccagagtagctgggaccacaggtgtgctccactgcaactggccattacaccctttagatttgagtgtgttcacgccacaagcatgtcctgagccagcccacagcctggccaatgcattcctactatgggggttataccaggagtaagtcatgacttcacttcagctgagccaggggcctaagggagaaagatctgttctaatcacccgagttcaggagttcgagaccagcctggccaccatgctaaaaccccatctctacaaaaatacaaaaattagccgggcatggtggcaagcacctgtaatcccagctgcttgggaggctgaggcatgagaatcgcttaaacccgggaggcggaggtttcagtgagctgagattgagccactgcattccagcctgggcaacagagcgagacttcatctccaaaaaaaaaaaaaaaaaaaaaggctaggtgcaatggctcatgcttgtaatccccgcactttgggaggctgaggcgggtggatcatgaggtcaggcatttgagaccagccttgccaacatagtgaaaccccgtctctatactaaaaataaaaaaaattagccgggtgtagtggcaggtgcctgtaatcccagctactcgggggaggctgaggcaggagaattgcttgaacctgggaggcggaggttgcagtgagccgagatcgcgccattgcactccagcctgggcaacaagagtgaaactccatctcaaaaaaaaaaaatctgttctaggggacctgccttcatctcgggcatcaggaaaaacctccccagagggacatttaatctgcatccaaaggctaaataggagttggccaggggaggggagagaggtgaggatttgctgctcactgcatgatagtagtgatagtcagcccttgcccaggtctgacagcaggcacttctacacagggataaggtggcgtgctcatgctgggagcaggtacctttgccctctccattccttggataggtggagctcagctcaaaagcacacagcccataggcaagaaaacctgggtgaggagccagcactgcccctggggtttttccccggggtgacatgagatgtcccctccagagaaaggctgccggtaggaggcacccatcttcccattactgagccagaaccctactgagggggctctcaactcctcgtgctggtcctagcttgttggacagtcatgccttcatccagttaaaattacagttgaaaacgtgcatttctcagagcatttatgggattcagtggtgacagaacatactctttcaacttgcttgggacctgattgcacaagccaagccctactcccctccgcagccttggcttatgactgggtcctgcactaaggtaccacctgccttgtggggcactgaccacctacagacgggaagcctgaccaggcttacagtcaggttttgccttttacaggcagtagtggccttggggagctgctgggccctgtagacctcggggtcggacctgtccactgtgtatgtgggatttcctctggcagggttggataaggaggacagctcagtgcagggcagctgggggcatcccatgagtccttttttctttttcactttcttttttttcaatgaaaagtacagtttaaaggagaattttgcattagcctgggtacttgggctgtagtacttgttgggttttgggtgattcctccccatctgtgacagccttttctgagcagtgtccttcagagtactctgtcctgtccttccctggaaggagagccctggatcctgaccacaatactgggcaaggtgttggacgctatccagccatgcttgtaaatgggccaagatgactttgtgtttcttttgcctttagaaaaaatttaattctaatgtgctcaagcttattgagttaattcattttgtgggtgtggttatgttataaagttgtcatacaatccgttttatttatttatttatttttgagacggaatttcactctgtcgcccaagctggagtgcagtggtgtgatctcagctcactgcaacctccgcctctcgggttcaagcgattctcctgcctcagattcccaagtagctgggattacaggtgtcacccagctaatttttgtatttttagtagagacggggtttcaccatgttggccaggctagtcttggattcctgacctcaggtgatctgcctgcctcagcctcccaaaatgtgctgggaggcatgagccaccatgcccggcccagattcatttgtttctgctgatatttagttgtatgtgtgtgtggtgtgtgtgtgtggtgtgtgtgtgtgtgtgtgtgtgtgtgtgtgtgtgtgtgtgtgtgtgtttgttagcctggtatagtggcatttgcctgtggtcctaactacttgggtggctgatgtaggaagatttcttgagcccaggagtttgaggctgcagtgagctgtgatcacaccactgcactctagcctggacgacagagtgagaccccatctctaaaaatgtgtaataataattataaagccgtccagcttttccaataccattctttgaaagacccaccccttttttgtagtagtttgagaggttaccttaatcaaatgctgggtttctggtctttctattctgttcctttggtctgccttatggactactatgctgtttaactctagaggctttggggcattttatagtgcttggtggggctggaaccccttatgagtcttgttcagagttttcccagatactcttacatattatttttctttatgaactttagaaccatcttgccctgattcagaatgggattttattgggatatattaatatgctaactggggggacttggcacatttatgaggttgagttgccttacgagggccatttttcctttggtccaagtggactttggtgctttcgggagtgtttcaagtttctcataccagccacagcttcatagctgtggttacaagtcgaggtggccaccagacccctgaggcacagagaggcctcatctccacgcccatgtaggtggactgcaggccccagagcgggaagtgctaggggtgaggagcctcctcggggggcaccttacggttccatggtgcacatgttccagcagtaactgtgcagctcctcctggcatcgctccatgcttctcatacctgggaggaaccagagtcaaaatgggcacatggaggcccagagaggccagtgatgtaaccagaaagggtgagatgggtctcaagccagatctctattccagcattttcccaagccctgcataccttgttcgtccgcctctgtcccctggaaagcagttaggcttcttgaattctagctccttattaagttactagtactcctcaaattttctatcattgagaggctgcaccatcaagccatagccgcgtagagactggtcaggttattctttcccttgtcccacctccaccttccttggatcaatcccagcagtttcagcaaataaaaatgttgagagattccatctggttacccaatgtatttcctctgtgccccaggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaaggtgagtgcccgcctgtcggcacagttgcctctagcacagttcttggttggtgggctgtgagagttagaagagacaggtggagacattttaatccaaaagagttttgtgcaccactccaaaatgtgagccgacactcatgtttcccagtggtctgaaggcattgctctaaggacatgtttccttgctaccctgtggcttctggcactctacttgctgctggacatttccctgattgcctggattcaggtcggggcatccccaactgtggaggggatgggcctgggtcatctcagctgttttcctgcctgtgactttgtcagctgggggcccttctgagcccctggaaggcccagggtgctgataagctgcttcatgtcatgacagtgagatgggaacagagcaggggtggtcccaggcagtggtcagtgggacctgcctcggccatgagaggccatctcctgctctcctgtggggaggttccgggttcttgaggtataatttaccagcagtgaaacgcacccttttcaagtggaccatttgaattttgttgactgtgcagaggcgagaacccaccagtacagcagagctgaagcctgttcccagaacgggtctcttgtcccattgcagtcccctgcccgattcagcaaccactgactgttttccaagccccaggtattctatctttcctagtctgtcagtacatagaattgcatcgcatgtggccttttgatgggcacgccgtggcccagatgactcctgtgcccccaatgccctccaagctgtctccccacagtcaggcctggaccgtgctttcacatgggacttctgctgcaaaacctatgtgtgaagttgtagtgaatggtgccccattgtgggactgtgttaaacagtcacctgtgtgttctacatcattcagacagtcacatttacatgtgacagtggccttatggtttttcctgctttggaatagtcctcatgttttgtgtttgaaaaatttggtgttgcagtgaaatgctaaccattctactataacctttaccatccttcaaaacttctcatggggccaggcgcagtggctcgtgcctgtaatcccagcttagcgggactgaggcaagaggatcgcttgagcccgggagcttgagaccagcctgggcaagatggccagacctaatctttacaagaaaaaaaaattaatgtaaaaaaaatgaagtaaataattaaacttgtcacggatggcaggtagtgtatcagagtgcttgttatgtatgctcttcttggggggaggtggagttttttatttctgcattagaagctctcagttctttgggtagttgatgagataaaaaccagacctgcgccgggtgtgctggctcacacctgtaatcccagcactctgggaggccaaggcgggaggatcgcctttggtcgggagtttgagaccagcctgaccaacatggagatatcccatctctactaaaaatacagaattagcgaggcgtggtgacgcattcctgaaatcccagctactcgggaggctgaggctggagaatcgcttgaacctgggaggtgaaggttgcagtgagctgagatcacaccactgcactccagcctgggcaacaagagcgaaactgtgtctcaaaaaaaaaaaaaaaaaaaaaaaaacagacttgctaatctccctttcataaaaaatagaataaaatgatatgatgtggttctctatatgagaagcatggttgtttttcactagaaagttttaggcagactttaattctttttttttttttgagatggactcttgttcttgtcgcccaggctggagtgcagtggcacaatctcggctcactacaacctctgcctcccgggttcaagttattctcctgcctcagcctcctgaatagctgggattgcaggctcccgccaccacgcctggctagtttttgtacttttagtagagacggggtttcgccatgctggccaggctggtctcgaactcctaacctcgggtgatccgcccatctcggcctcccaaagtgatgggattacaggcatgagccactgcgcctggccagactttaattatttcccagtgaattagctgcagataaactaggagggcacagtatcacaaatattttgttgaagcaaaatatatttctgtagtcatggaaaataatccatgtattggatcttttgttataaatgtggggactcttaggtttgaatagactttccaaaagcaaggcaccgctcagtgaacccttcattatggcccaagctgcctaccctgagcgtgtcccgtctctgctcactccaggggtcatacatgttcattcttgagaggagctggggctcagcagctgccatgcagagcctaagacaccttctgtcatcagagaactgttagccaaaatagactgcaagatcttcagtctctaagtaatttaggaaaagcacatgtatgtgtatgtgtctctttcttttgtcttctagtccatgaaccagttcgaattgcctatgacaggcctcggggtcgtcccatgtccaaaaagaaggtgagcgtaatcattggtagtcctcactcaaagtatagttggttagaatttgttggagttccaaaggatgctgcagcttgtgattaagctgtgctaacatttcaaactgaggtattaatgtgtaaaacacaacagagacttttctcttgggagggcttttgaaaactgttttgcctttgtccaaagcatagactagtgattcatctgtgtaatggatagttgagatccctgtaatggatgcagtgggatttgagagataaacgagataatgtcttggcccttaagaagttcaagctaggccaggtgtggtggctcacgcctgtaatcccagcactttgggaggcagagggcgggtggatcacaaggtcaggagatcgagaccatcctggctaacacgatgaaaccccgtctctactaaaaatacaaaaaattagccgggcatggtggcaggcgcctgtagtcccagccactcaggaggctgaggcaggagaatggcatgaatctgggaggcagagcttgcagtgagccgagatcgcgccactgcactccagcctgggcgacagagtgagactccgtctcaaaaaaaaaaaaaaaagaagttcaagctaaggccgattgggtgtcttacacttgtgatcccagcagtttaggaggccaaagtgggcagatcgcttgagtccaagagtttaagaccagcctgggcaataggcaaaaccctgtctctgcaaaaaatacaaaaattagttgggcatggtggtgcatgcctgtagtcccagctactctggaggctgaggtggaaggatcatttgggcctgagaggtcgtggctgcagtgagctgattgcaccactgcaccccagcttgggcgacagactgagagcctgtctcaaaaaaaaaaaaaaagttcaagttatccaggtgcactgattcacgcctgtaatcccagtgctttgggaggccaagacagggggatcacttgagcccaggagtttgaggccagcctgggcaacatagtgagacctatgtctcctcctggtctccttaaaaaataaaacataaaaacttacaagcttagtagactggaagggtggtgaagagagttcactaatctgctagtaagcagagcgtggtgtgtgcggtcagcacctcctacgtgccaggtcccgactgtccacctggaggcagcagcaagcagggccaacagtgaaagagaaatggatgaggcagtcctggggatgctgtgggcaaagagaagcaggtcaaagagagggagaataaggtggggtcgaggggatgccgctgaattgggaaagccaagggaggtctctcttgcagatgacgttggcacaagcctggaggagctgaggagaaacagtgtagagatctgagaagggcacagcctcggtagagaggctggggcagcaagaggcctttgtggcagcagaggaatccggggggtggtcacacaggacctcaacagatgttaacgctgtggccctttctcagggaagggagggtacctctgggacctgtggtggatgtggccactagggtggagagcagcctgtgggcgggaaccaggaggaggctcaaacttaagacagttggaccagggcatgaggagcaatgagaaggggagaagatggagtgggtgacacctgcttgtgggctgggtgtgcaaaagccaggagtccagatgaccccagggttgtcagcttgggcagaagagggacagaactgccattcactgacctggagccaggttatggaaagggggcaggtacactccagatggcctgggggacacagtgctgggggcaagcagggtcacctgggacacatgtggagagacttcaccagtccttcatggtcagggaggagggcggggagccaggcgagatcgctctgctggtgtcaggcagtgccatgttgcttccaaccccttccgagtgacctaggtcagtctgaccccaattatggcaggaaggagggaccttcccgagtccagagctcatagtccttactgatgtgccaggttttaggctgagctggcatctggtgccccttggtgtggcctggataagggcacggccagatgagggcacagcaggaccttggtgtcaggcacagctgtactctagctcagccctgccaccgagtagttttgtaaccttggcgtgtaacccctgagccacggatttgtctgtaaaatgggatggccacacttacccagcaggtaggaggtacagtgaggattaaactgaacgcggttcctggtgggtgtcctgcacatgctgctgtctccttggggctctgcacctgtcctcctgtctgccagtgactgtgggtggaagggaggccgtggtggctgcagctttcctctgcaaacctccacctcgcccacagggcttggctttcctccagctgtccaggaaaccaccatcatgattgttaaacacagatttgaacattcacgaagaaacttccaggctgagccaaaccctcttcctcccactgcacctccaagcagccttcctgaaagggaaaagagtacagacctgccctctggggacccctgtgccctgccatgaccagcctttccccttccttccctacccgtcatcccagggcccaggtcgtgcacagctcccagaagggcctgacggatgccccgtttctcatctcagccggtgggttctgtcacctcttttctccaggccactttctcatggcaaggggccccccagtgtagcaggtcctgtctggtgtcccctggtttgcaggggtgtctcttcactgtttgtgcccctcttcctgtcccagcccatagcatagctcctcccttcatacctcccctccttaactgccctgcagagacacttctgcccacaccgcctcaccaagaccacctcatgccattatggaggggccgcctgcatccagtaactcacgcacacacacaagatacacacatgtgcacgcatatgcacacacacatgcatacacacacgcacacacacatgcatacacacacacagctactttatataataccctcggagatgcctctgaagagaacaaagggaatttccctccgcctttgaaggtccaagtctaagcctgttgaaatgaactgacaataagaagattaacaggataaaaaaaggtgtgcggtggcttacacctgtaatcccgggactttggaaggccaaggcagggggatcacttgagcccgggagttcaagactgcagtgagccatgatggagccactgcactccagcctgggtgacagagcaagatcctgtcttgaaacaaaaaagttatacatatttattcacgtgcataagcacaggagccatataaaacattatgaaaactcaaagaagggccaggtggttgaagctgaaatacctctttgtaggggagagggcagatgggaggctgtaggtaactttagaggggaagcagatgattttaggagagatgaatggaggcaggcatcatcttgtgaatgatcctcattgagaattgaatgggactagagaacagccagtggtctgggctctaggtgtggtgtttaatgttccatctcttcttgtgtgataggagttttcaactctggttaatgacatttcagggaagggatccaaggcccttgtgttcttctttggcaagtccagtttctaggtagatagggaacttgaagaaaacagcttcctcctgtgctttgggagggaccttgaggctgctactttagtcccacctgtcaaagtgctataattcggggtatcgctttctttctttctttctttttttttttttttttttttgagacggagtctccctttgtcgccaaggctggagtgcaatggcatgatctcaactcactgcaacctctgcctcccaggttcaagggattctcctgcctcagcctccagagtagctgggattacaggggcgtgccaccacacctggctaatttttgtatttttagtagagatggggattcaccatgttggtcaggctggtctcaaactcctgacatcgtgatccacgcaccttggcctcccaaagtgctgggactacaggcgtgagccaccgcgcccagccttagggtatccgtttctgaccccctacatcttgctgcatgttgagttctcagcacctctccaggttgttttgtccctttctagggtgagaacactgaggccccaggagctccagaggcccaggccttccttatgggagcacttgctctctcctccctccctccctcctgacctgaggccctgctctctcccttctccctttcctctcccagcccctggctcccccaggctcagccttttgtgccttgtctccaagctcctttgtctctggagtgcctcccacatgcacccctaacgttagggaagctgattcctgggcacctcaatgcagatggcaagggggggatttgtcttttggttgaattatacctcgtgaggcctgcatgacatcatggggcaggttgctaagctgatgagggctgactgcccaaagacctgagctcacagcactcagcatgcccttctcaccctgcttcccatgcccagggtcatctaaccctctcccagccactcccacctgtcccctgctcagacccccagcaccagcccccgtgatcctcctcagcaccttcctccctccctctcaagagcacatgaaccctcacagcctccccaggtcgttcagtaaatgccttaaataaatacatcagccaggcgcagtggctcatgcctgtaatcccagcactttgtgaggctgaggcgggcagatcagctgaggtcaggagtttgatcaagaccagcatggttaacatggcgaaaccccgtctctactaaaaatacaaaaataggtgggcgtggtggcacacgcctgtaatctcagctactcgggaggctgaagcaggagaatcgcttgaacccaggaggcggaggttacaatgagttgagattgcatcactgcactccagcctgggcaacagagcaagactccgtcttaaaaaaaaaaaaacatcaaaagctgggtgcagtggcacatacctatagttccagttaatggggagactgaggtgggaggatcacttaaagccgggaatccgagaccagcctgggcaacatagcaagactctatatttaaaaaaaacacacacaagttttgtattttgtttctttttttagacagtctcattgtgttgcccaggctggaatgcagtggcacggtctccgctcactgcaacctctgcctcccaggttcaggcgattctcatgcctccgcctcacaagtagctgggattacaggtgcctgccaccatgcctggctaatttttgtattttagtagagacggggttttgccacgttggccaggctggtctggaactcctgacctccagtgatccacccacctcggcctcccaaactgctgagattacaggcatgagccaccacgcccagcccacccacacaagttgactcgtgaagagccaaggaatacatggcaaggtcttggactgcccagctgggctctgtcacacagcagtgtgtcatgaatattcatgagtgaatagaaattccttctgctacagccctgcaggctcctcctccagaggccccagggccctgtctgtctccagatctccatctagtggcccagagattgctgcacttccccaccacccacaggagcaatcaacagctgtactagctctcagtgaggtctgctctgtgctagacacagaccccaatgtccaagtagaactcagtcctgaggacagacagacaatgcagccagggagtgaatgaagcactcggggaggggtatgttggggtggttcagggagggtgctgccagccagttctcacccactgtctggcccccatcctgcctgcaggcctgtgccctggtgccccccactcttccctgggctgcgccctgtggtcatcacagggccacccttctttatccagggttccgctgagggccttcctactgactccttgaccccgggactggccattcccttacccagttttcctcacagtcttggcaccagggttatagtggtagctgagaggcacgactgacctcaggccagtgacctctgacttagaagttccatcccacccagggatgttgcagagaactggggaagtgactggagcttgagcctgagcatctggggagtcaggagggcatttgggggtgaggggctccaggcatagcctaggacagacccttgatccaggcatctccctgtggcccacatgcctggactctcctctctcctcagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaataggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctccaaaaaaaaaaaaaaaaaaggccggcacggtgactcacgcctataattccagcactttgggaggccgaggcaggtggatcacgaggtcaagagatcgagaccatcctggccaacatggtgaaaccctgtctctactaaaaatgcaaaaaattagctgggcgtggtggcgggcgcttgtagtcccagctactcaggaggctgaggcaggagaatcacttgaacccgggaggcggaggttgcagtgagccgagattgtgccaccgcactccagcctggcaacagagcgagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcttctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgc
